US008569030B2

(12) United States Patent
Lee et al.

(10) Patent No.: US 8,569,030 B2
(45) Date of Patent: Oct. 29, 2013

(54) **TYPE II RESTRICTION-MODIFICATION SYSTEM METHYLATION SUBUNIT OF *ALICYCLOBACILLUS ACIDOCALDARIUS***

(75) Inventors: Brady D. Lee, Idaho Falls, ID (US); Deborah T. Newby, Idaho Falls, ID (US); Jeffrey A. Lacey, Idaho Falls, ID (US); David N. Thompson, Idaho Falls, ID (US); Vicki S. Thompson, Idaho Falls, ID (US); William A. Apel, Jackson, WY (US); Francisco F. Roberto, Idaho Falls, ID (US); David W. Reed, Idaho Falls, ID (US)

(73) Assignee: Battelle Energy Alliance, LLC, Idaho Falls, ID (US)

( * ) Notice: Subject to any disclaimer, the term of this patent is extended or adjusted under 35 U.S.C. 154(b) by 0 days.

(21) Appl. No.: 13/604,979

(22) Filed: Sep. 6, 2012

(65) Prior Publication Data

US 2013/0029400 A1    Jan. 31, 2013

Related U.S. Application Data

(62) Division of application No. 12/800,045, filed on May 5, 2010, now abandoned.

(51) Int. Cl.
*C12N 9/00* (2006.01)
*C12N 1/20* (2006.01)
*C12N 15/00* (2006.01)
*C07H 21/02* (2006.01)

(52) U.S. Cl.
USPC .................... 435/183; 435/252.3; 435/320.1; 536/23.2

(58) Field of Classification Search
None
See application file for complete search history.

(56) References Cited

U.S. PATENT DOCUMENTS

| | | | |
|---|---|---|---|
| 4,237,226 A | 12/1980 | Grethlein | |
| 4,581,333 A | 4/1986 | Kourilsky et al. | |
| 4,624,922 A | 11/1986 | Horikoshi et al. | |
| 5,098,825 A | 3/1992 | Tchen et al. | |
| 5,882,905 A | 3/1999 | Saha et al. | |
| 5,916,795 A | 6/1999 | Fukunaga et al. | |
| 5,948,667 A | 9/1999 | Cheng et al. | |
| 6,083,733 A | 7/2000 | Groenberg et al. | |
| 6,268,197 B1 | 7/2001 | Schulein et al. | |
| 6,426,211 B1 | 7/2002 | de Buyl et al. | |
| 6,506,585 B2 | 1/2003 | Danielsen et al. | |
| 6,777,212 B2 | 8/2004 | Asakura et al. | |
| 6,833,259 B2 | 12/2004 | Bhosle et al. | |
| 7,727,755 B2 | 6/2010 | Thompson et al. | |
| 7,858,353 B2 | 12/2010 | Thompson et al. | |
| 7,923,234 B2 | 4/2011 | Thompson et al. | |
| 7,960,534 B2 | 6/2011 | Thompson et al. | |
| 8,071,748 B2 | 12/2011 | Thompson et al. | |
| 8,202,716 B2 | 6/2012 | Thompson et al. | |
| 2003/0134395 A1 | 7/2003 | Shetty et al. | |
| 2003/0233674 A1 | 12/2003 | Gabor et al. | |
| 2003/0233675 A1 | 12/2003 | Cao et al. | |
| 2004/0029129 A1 | 2/2004 | Wang et al. | |
| 2005/0112742 A1 | 5/2005 | Thompson et al. | |
| 2006/0105442 A1 | 5/2006 | Wu et al. | |
| 2006/0211083 A1 | 9/2006 | Katzen et al. | |
| 2007/0082381 A1 | 4/2007 | Wilting et al. | |
| 2007/0134778 A1 | 6/2007 | Benning et al. | |
| 2007/0148728 A1 | 6/2007 | Johnson et al. | |
| 2009/0203107 A1 | 8/2009 | Thompson et al. | |
| 2009/0215168 A1 | 8/2009 | Lee et al. | |
| 2009/0221049 A1 | 9/2009 | Shaw, IV et al. | |
| 2009/0226978 A1 | 9/2009 | Thompson et al. | |
| 2009/0253205 A1 | 10/2009 | Thompson et al. | |
| 2009/0263859 A1 | 10/2009 | Thompson et al. | |
| 2009/0269827 A1 | 10/2009 | Thompson et al. | |
| 2010/0203583 A1 | 8/2010 | Thompson et al. | |
| 2010/0311110 A1 | 12/2010 | Thompson et al. | |
| 2011/0081683 A1 | 4/2011 | Thompson et al. | |
| 2011/0275135 A1 | 11/2011 | Lee et al. | |
| 2012/0015407 A1 | 1/2012 | Thompson et al. | |

FOREIGN PATENT DOCUMENTS

| | | |
|---|---|---|
| DE | 197 17 893 A1 | 1/1999 |
| WO | 81/00577 | 3/1981 |
| WO | 99/06584 A1 | 2/1999 |
| WO | 03/068926 | 8/2003 |
| WO | 2005/066339 | 7/2005 |
| WO | 2006/117247 A1 | 11/2006 |

OTHER PUBLICATIONS

Accession C8WVZ2. Nov. 3, 2009.*
Whisstock et al. Q Rev Biophys. Aug. 2003;36(3):307-40.*
Miele, E. A. et al., 1983, J. Mol. Biol., 171: 281-295.
Mielenz, 2001, Curr. Op. in Micro., 4:324-329.
Mosier et al., "Industrial Scale-Up of pH-Controlled Liquid Hot Water Pretreatment of Corn Fiber for Fuel Ethanol Production," Applied Biochemistry and Biotechnology, vol. 125, 2005, pp. 77-97.
Neddleman and Wunsch, J. Mol. Biol. 48: 443 (1970).
Ng et al., 1981, Applied and Environmental Microbiology, 41(6):1337-1343.
Ohta et al., "Purification and Characterization of an Acidophilic Xylanase from *Aureobasidium pullulans* var. melanigenum and Sequence Analysis of the Encoding Gene," Journal of Bioscience and Bioengineering, vol. 92, No. 3, 262-270, 2001.
Olins, P. O., and Lee, S. C., 1993, Recent advances in heterologous gene expression in *E. coli*. Curr. Op. Biotechnology 4: 520-525.
Ooshima et al., "Simultaneous saccharification and fermentation of cellulose: Effect of ethanol on enzymatic saccharification of cellulose," Department of Applied Chemistry, Faculty of Engineering, Osaka City University, Osaka 558, Japan, Jun. 5, 1984.

(Continued)

*Primary Examiner* — Christian Fronda
(74) *Attorney, Agent, or Firm* — TraskBritt

(57) ABSTRACT

Isolated and/or purified polypeptides and nucleic acid sequences encoding polypeptides from *Alicyclobacillus acidocaldarius* are provided. Further provided are methods for modulating or altering recombination inside or outside of a cell using isolated and/or purified polypeptides and/or nucleic acid sequences from *Alicyclobacillus acidocaldarius*.

7 Claims, 228 Drawing Sheets

(56) References Cited

OTHER PUBLICATIONS

Pajunen et al., Microbiology (2005) 151, 1209-1218.
Patel et al., (2006), "Medium and long-term opportunities and risks of the biotechnological production of bulk chemicals from renewable resources: The potential of white biotechnology". The BREW Project. Final Report prepared under the European Commission's GROWTH Programme (DG Research), (publica.fraunhofer.de/eprints/N-48834.pdf).
PCT International Preliminary Report on Patentability of the International Search Authority for PCT/US09/32333, dated Aug. 3, 2010.
PCT International Preliminary Report on Patentability of the International Searching Authority for PCT/US09/00442, dated Jul. 27, 2010.
PCT International Preliminary Report on Patentability of the International Searching Authority for PCT/US09/34701, dated Aug. 24, 2010.
PCT International Preliminary Report on Patentability of the International Searching Authority for PCT/US09/35275, dated Aug. 31, 2010.
PCT International Preliminary Report on Patentability of the International Searching Authority for PCT/US09/35331, dated Aug. 31, 2010.
PCT International Preliminary Report on Patentability of the International Search Authority for PCT/US09/35307, mailed Jan. 25, 2011.
PCT International Search Report and Written Opinion of the International Searching Authority for PCT/US10/51095, dated Dec. 2, 2010, 11 pages.
PCT International Search Report and Written Opinion of the International Search Authority for PCT/US11/34852, dated Oct. 21, 2011, 12 pages.
PCT International Search Report and Written Opinion of the International Searching Authority for PCT/US09/00442, dated May 18, 2009, 8 pages.
PCT International Search Report and Written Opinion of the International Searching Authority for PCT/US09/34701, dated Jan. 12, 2010, 10 pages.
PCT International Search Report and Written Opinion of the International Searching Authority for PCT/US09/35275, dated Feb. 25, 2010, 13 pages.
PCT International Search Report and Written Opinion of the International Searching Authority for PCT/US09/35331, dated Feb. 23, 2010, 10 pages.
PCT International Search Report and Written Opinion of the International Search Authority for PCT/US09/35307, dated Jun. 10, 2010, 10 pages.
PCT International Search Report and Written Opinion of the International Search Authority for PCT/US10/25521, dated Jul. 14, 2010, 12 pages.
PCT International Search Report of the International Search Authority for PCT/US10/25521 Jul. 14, 2010.
Pearson and Lipman, Proc. Natl. Acad. Sci. (U.S.A.) 85: 2444 (1988).
Perlack et al., "Biomass as Feedstock for a Bioenergy and Bioproducts Industry: The Technical Feasibility of a Billion-Ton Annual Supply," USDA and DOE, Apr. 2005, 78 pages.
Peyton et al., "Biotransformation of Toxic Organic and Inorganic Contaminants by Halophilic Bacteria," Halophilic Microorganisms, Antionio Ventosa (Ed.), Springer, 2004, pp. 315-331.
Ragauskas et al., "The Path Forward for Biofuels and Biomaterials," Science, Jan. 27, 2006, vol. 311, pp. 484-4589.
Ramos et al., "Biomechanical and Biochemical Pulping of Sugarcane Bagasse with *Ceriporiopsis subvermispora* Fungal and Xylanase Pretreatments," J. Agric. Food Chem. 2001, 49, 1180-1186.
Saeman et al., "Quantitative Saccharification of Wood and Cellulose," Industrial and Engineering Chemistry, Jan. 1945, vol. 17, No. 1, pp. 35-37.
Saha et al., "Dilute Acid Pretreatment, Enzymatic Saccharification, and Fermentation of Rice Hulls to Ethanol," Biotechnol. Prog. 2005, 21, 816-822.
Sanchez-Pescador, R., 1988, J. Clin. Microbiol., 26(10): 1934-1938.
Sa-Pereira et al., "Rapid production of thermostable cellulose-free xylanase by a strain of *Bacillus subtilis* and its properties," Enzyme and Microbial Technology, 30 (2002) 924-933.
Schafer et al., "X-ray Structures of the Maltose-Maltodextrin-binding Protein of the Thermoacidophilic Bacterium *Alicyclobacillus acidocaldarius* Provide Insight into Acid Stability of Proteins," J. Mol. Biol. 2004, 335:261-274.
Schäffer, C. et al., 2001, Prokaryotic glycosylation. Proteomics, 1: 248-261.
Scheffel et al., "Functional reconstitution of a maltrose ATP-binding cassette transporter from the thermoacidophilic gram-positive bacterium *Alicyclobacillus acidocaldarius*," Biochem Biophy Acta, 2004, 1656(1):57-65.
Schell et al., "Dilute-Sulfuric Acid Pretreatment of Corn Stover in Pilot-Scale Reactor," Applied Biochemistry and Biotechnology, vol. 105-108, 2003, pp. 69-85.
Schneider, "Import of solutes by ABC transporters—the maltose system. ABC protein: from bacteria to man," Elsevier Science, London 2003, pp. 157-185. [Retrieved from the Internet on Jan. 24, 2010; <http://www2.hu-berlin.de/biologie/baktphys/paper/1_ABC/r.
Schwarz, Wolfgang H., "A list of cellulolytic bacteria," Technische Universitat Munchen, Apr. 24, 2003, 8 pages.
Schwermann, B. et al., 1994, Purification, properties and structural aspects of a thermoacidophilic a-amylase from *Alicyclobacillus acidocaldarius* ATCC 27009, insight into acidostability of proteins. Eur. J. Biochem. 226: 981-991.
Seffernick et al. "Melamine Deaminase and Atrazine Chlorohydrolase: 98 Percent Identical but Functionally Different" Journal of Bacteriology vol. 183, No. 8, Apr. 2001 pp. 2045-2410 (6 pages).
Shallom et al., "Microbial hemicellulases," Current Opinion in Microbiology, Current Biology Ltd, GB, vol. 6, No. 3, Jun. 1, 2003, pp. 219-228.
Simpson et al., "An extremely Thermostable xylanase from the thermophilic eubacterium Thermotoga," Biochem. J. (1991) 277, 413-417.
Smook, G.A., "Handbook for Pulp & Paper Technologists," Tappi Pr; 2nd Ed. (Jun. 1992) pp. 65-88.
Subramaniyan et al., "Cellulase-free xylanases from Bacillus and other microorganisms," FEMS Microbiology Letters 183 (2000) 1-7.
Sunna et al., "Glycosyl hydrolases from hyperthermophiles," Extremophiles (1997) 12-13.
Supplemental European Search Report for EP 06 82 7231, dated Nov. 12, 2009, 6 pages.
Techapun et al., "Production of a cellulose-free xylanase from agricultural waste materials by a thermotolerant *Streptomyces sp.*," Biotechnology Letters 23: 1685-1689, 2001.
Thompson et al., "Comparison of Pretreatment Methods on the Basis of Available Surface Area," Bioresource Technology 39 (1992) 155-163.
Aden et al., "Lignocellulosic Biomass to Ethanol Process Design and Economics Utilizing Co-Current Dilute Acid Prehydrolysis and Enzymatic Hydrolysis for Corn Stover," NREL/TP-510-32438, National Renewable Energy Laboratory, Golden Colorado. Jun. 2002, pp. 1-88.
Avella et al., "A New Class of Biodegradable Materials: Poly-3-hydroxy-butyrate/Steam Exploded Straw Fiber Composites. I. Thermal and Impact Behaviour," Journal of Applied Polymer Science, vol. 49, 2091-2103 (1993).
Badger, P.C., "Ethanol from cellulose: A general review," In: J. Janick and A. Whipkey (eds.), Trands in new crops and new uses. ASHS Press, Alexandria, VA, 2002, pp. 17-21.
Bailey et al., "Interlaboratory testing of methods for assay of xylanase activity," Journal of Biotechnology, 23 (1992) 257-270.
Barany, F., 1991, PNAS. USA, 88: 189-193.
Bergquist et al., "Molecular diversity of thermophilic cellulolytic and hemicellulolytic bacteria," FEMS Microbiology Ecology 28 (1999) 99-110.
Bertoldo et al., 2004, Eng. Life Sci., 4, No. 6.
Bhatia et al., "Microbial beta-Glucosidases: Cloning, Properties, and Applications," Critical Reviews in Biotechnology, 22(4):375-407, Jan. 1, 2002.
BLAST Search of Seq. ID. 36, accessed Apr. 22, 2009, 54 pages.

(56) References Cited

OTHER PUBLICATIONS

BLAST Search of Seq. ID. 456, accessed Apr. 22, 2009, 48 pages.
BLAST Search of Seq. ID. 458, accessed Apr. 22, 2009, 59 pages.
BLAST Search of Seq. ID. 460, accessed Apr. 22, 2009, 37 pages.
BLAST Search of Seq. ID. 462, accessed Apr. 22, 2009, 35 pages.
BLAST Search of Seq. ID. 464, accessed Apr. 22, 2009, 45 pages.
Bork, Peer, "Powers and Pitfalls in Sequence Analysis: The 70% Hurdle," Genome Research, 2000, 10:398-400.
Borman, S., 2006, Glycosylation Engineering. Chem. Eng. News, 84(36): 13-22.
Bowie et al., "Deciphering the Message in Protein Sequences: Tolerance to Amino Acid Substitutions," Science, 1990, 247:1306-1310.
Breves et al., "Genes Encoding Two Different beta-Glucosidases of *Thermoanaerobacter brockii* Are Clustered in a Common Operon," Applied and Environmental Microbiology, vol. 63, No. 10, Oct. 1997, pp. 3902-3910.
Broun et al. "Catalytic Plasticity of Fatty Acid Modification Enzymes Underlying Chemical Diversity of Plant Lipids" Science vol. 282 Nov. 13, 1998 pp. 1315-1317 (4 pages).
Buckholz, R. G., 1993, Yeast systems for the expression of heterologous gene products. Curr. Op. Biotechnology 4: 538-542.
Burg, J. L. et al., 1996, Mol. and Cell. Probes, 10: 257-271.
Chu, B. C. F. et al., 1986, NAR, 14: 5591-5603.
Collins et al., "Xylanaes, Xylanase Families and Extremophilic Xylanses," FEMS Microbiology Review, 2005, pp. 3-23.
Cowling, Ellis B., "Physical and Chemical Constrains in the Hydrolysis of Cellulose and Lignocellulosic Materials," Biotechnol. & Bioeng. Symposium No. 5, 163-181 (1975).
Crout et al., "Glycosidases and glycosyl transferases in glycoside and oligosaccharide synthesis," Current Opinion in Chemical Biology, Current Biology LTD, London, GB, vol. 2, No. 1, Feb. 1, 1998, pp. 98-111.
Dale, M. Clark, "Enzymatic simultaneous saccharification and fermentation (SSF) of biomass to ethanol in a pilot 130 liter multistage continuous reactor separator," Bio-Process Innovation, Inc., W. Lafayette, IN, 2005, 10 pages.
Database EMBL [Online]. Mar. 16, 2007. XP-002627757. Database accession No. ER073884, 1 page.
Database Geneseq [Online]. May 21, 1998. XP-002627734. Database accession No. AAW35004, 1 page.
Database SCORE [Online]. Feb. 10, 2009. Database accession No. B7DQJ6, 2 pages.
Database SCORE [Online]. Nov. 3, 2009. Database accession No. C8WYA8, 2 pages.
Database UniProt [Online]. May 1, 1997. XP-002630045. Database accession No. P96090, 1 page.
Database UniProt [Online]. Oct. 1, 2001. XP-002627736. Database accession No. Q97UI4, 1 page.
Database UniProt [Online]. Feb. 10, 2009. XP-000002659383. Database accession No. B7DT70, 1 page.
Database UniProt [Online]. Jun. 26, 2007. XP-002627735. Database accession No. A5IKZ4, 1 page.
Database UniProt [Online]. Nov. 3, 2009. XP-002627733. Database accession No. C8WTP2, 1 page.
Database UniProt [Online]. Feb. 10, 2009. XP-002674095. Database accession No. B7DM51, 1 page.
Devos et al. "Practical Limits of Functiona Prediction" Proteins: Structure, Function, and Genetics 41 (2000) pp. 98-107 (10 pages).
Duck, P. et al., 1990, Biotechniques, 9: 142-147.
Eckert et al., "A Thermoacidophilic Endoglucanase (CelB), etc.," Eur. J. Biochem. 270, 2003, pp. 3593-3602.
Eckert et al., "Gene cloning, sequencing, and characterization of a family 9 endoglucanase (CeIA) with an unusual pattern of activity from the thermoacidophile Alicyclobacillus acidocaldarius ATCC27009," Applied Microbiology and Biotechnology, vol. 60, pp. 428-436 (2002).
Eckert, Kelvin, "Dissertation, Cloning and Characterization of two glycosidases from the acidothermophile Alicyclobacillus acidocaldarius ATCC27009," Berlin, Dec. 18, 1971, 113 pages.
Edwards, C. P., and Aruffo, A., 1993, Current applications of COS cell based transient expression systems. Curr. Op. Biotechnology 4: 558-563.
Ehrman, Tina, "Standard Method for Determination of Total Solids in Biomass," Chemical Analysis and Testing Task, Laboratory Analytical Procedure, Oct. 28, 1994, 242 total pages.
EMBL Submission CP001728, Sep. 2009. [Retrieved from the internet: URL:http://www.ebi.ac.uk/Tools/dbfetch/embifetch?style=html&id=CP001728&Submit=Go], 51 pages.
Erlich, H.A., J Clin. Immunol., Nov. 1989; 9(6):437-47.
Extended Supplementary European Search Report for EP 09 70 3173, dated Apr. 20, 2011, 7 pages.
Extended Supplementary European Search Report for EP 09 82 3952, dated Sep. 20, 2011, 7 pages.
Extended Supplementary European Search Report for EP 09 70 9191, dated Mar. 29, 2012, 6 pages.
Extended Supplementary European Search Report for EP 09 75 5307, dated Apr. 18, 2012, 4 pages.
Extended Supplementary European Search Report for EP 10 74 6882, dated Aug. 27, 2012, 9 pages.
Thompson et al., "In Vitro Degradation of Natural Insoluble Lignin in Aqueous Media by the Extracellular Peroxidases of *Phanerochaete chrysosporium*," 1998 John Wiley & Sons, Inc. pp. 704-717.
Thompson et al., "Measurement of fumonsins in corn with a fiber-optic fluoroimmunosensor," SPIE vol. 2980, (2010) pp. 532-538.
Thompson et al., "Preliminary Investigation of Fungal Bioprocessing of Wheat Straw for Production of Straw-Thermoplastic Composites," Applied Biochemistry and Biotechnology, vol. 105-108, 2003, pp. 423-436.
Thompson et al., "Purification and Characterization of a Novel Thermo-Alkali-Stable Catalase from Thermus brockianus," Biotechnol. Prog. 2003, 19, 1292-1299.
Thompson et al., "Thermoacidophilic Cellulases and Hemicellulases from Alicyclobacillus acidocaldarius," Idaho National Laboratory, 2006, 1 page.
Thompson, et al., "Chapter 31: Changes in the Rate of Enzymatic Hydrolysis and Surface Area Available to Cellulase with Pretreatment Methods," Biotechnology in Pulp and Paper Manufacture: Applications and Fundamental Investigations. Proceedings of the Fourth International Conference on Biotechnology in the Pulp and Paper Industry (ICBPPI), May 16-19, 1989,Raleigh, NC and Myrtle Beach, SC, USA. Kirk, T.K. and Chang, H.M. (eds.). Butterworth-Heinemann, Boston, 1990, pp. 329-338.
Tsao, G.T., "Bacterial Hydrolysis: A Review," Anaerobic Digestion and Carbohydrate Hydrolysis of Waste, Ferrero et al. (eds.), Elsevier Applied Science Publishers, London, 1984, pp. 83-99.
Tsao, GT, MR Ladisch, and HR Bungay, 1987. Biomass Refining, In Advanced Biochemical Engineering, Wiley Interscience, N. Y., 79-101.
Turner et al., "Potential and utilization of thermophiles and thermostable enzymes in biorefining," Microbial Cell Factories, Biomed Central, London, NL, vol. 6, No. 1, Mar. 15, 2007, p. 9.
Uhl et al., "The first description of an archaeal hemicellulase: the xylanase from *Thermococcus zilligii* strain AN1," Extremophiles (1999) 3:263-267.
Uniprot Direct submission Q9RHZ5_ALIAC, "Putative maltose transport membrane protein malF," Nov. 13, 2007. [Retrieved from the Internet Jan. 22, 2010: <http://www.uniprot.org/uniprot/Q9RHZ5.txt?version=30?].
UniProtKB/TrEMBL Q9JRQ1 [online]. Oct. 1, 2000. Available on the internet at <<URL://http://www.uniprot.org/uniprot/Q9JRQ1>>.
Upreti et al., 2003, Bacterial glycoproteins: Functions, biosynthesis and applications. Proteomics, 3: 363-379.
Urdea, M. S., 1988, Nucleic Acids Research, II: 4937-4957.
Vieille and Zeikus, 2001, Micro. and Mol. Biol. Rev., vol. 65, No. 1, p. 1-43.
Viikari et al., "Xylanases in bleaching: From an idea to the industry," FEMS Microbiology Reviews 13 (1994) 335-350.
Walker, G. T. et al., 1992, NAR 20: 1691-1696.
Walker, G.T. et al., 1992, PNAS. USA, 89:392-396.
Walseth, Curtis S., Occurrence of Cellulases in Enzyme Preparations from Microorganisms, TAPPI vol. 35, No. 5, May 1952, pp. 228-233.

(56) References Cited

OTHER PUBLICATIONS

Ward et al., "Characterization of a new bacteriophage which infects bacteria of the genus Acidiphilium," Journal of General Virology (1993) 74: 2419-2425.
Ward et al., "Electrotransformation of Acidophilic, Heterotrophic, Gram-negative Bacteria," Electrotransformation of Bacteria, Natalie Eynard, Justin Teissie (eds.), Springer (2000) pp. 94-103.
Whisstock et al. "Prediction of Protein Function from Protein Sequence and Structure" Quarlty Reviews of Biophysics 36, 3 (2003) pp. 307-340 (35 pages).
Witkowski et al. "Conversion of a β-Ketoacyl Synthase to a Malonyl Decarboxylase by Replacement of the Active-Site Cysteine with Glutamine" American Chemical Society, Biochemistry, vol. 38, No. 36, 1999 pp. 11643-11650 (8 pages).
Wright et al., "Ethanol from Biomass by Enzymatic Hydrolysis," Chemical Engineering Progress, Aug. 1988, pp. 62-74.
Yuan et al., Expression of acidophilic alpha-amylase from *Alicyclobacillus acidocaldarius*, Sheng Wu Gong Cheng Xue Bao, Jan. 2005, 21(1):78-83. Abstract only.
Fan et al., "The Nature of Lignocellulosics and Their Pretreatments for Enzymatic Hydrolysis," Advances in Biochemical Engineering/ Biotechnology, 1982, vol. 23/1982, 157-187.
Flanagan, et al., "Development of gas phase bioreactors for the removal of nitrogen oxides from synthetic flue gas streams," Fuel 81 (2002) 1953-1961.
Fushinobu et al., "Crystallographic and mutational analyses of an extremely acidophilic and acid-stable xylanase: biased distribution of acidic residues and importance of Asp37 for catalysis at low pH," Protein Engineering vol. 11, No. 12, pp. 1121-1128, 1998.
Garrote, G, H Dominguez, and JC Parajo, 2001, Manufacture of xylose-based fermentation media from corncobs by posthydrolysis of autohydrolysis liquors, Appl. Biochem. Biotechnol., 95:195-207.
GenBank: E17054.1 Direct Submission *Alicyclobacillus acidocaldarius* genomic DNA clone pOP3 containing acyl carrier protein gene. Nov. 5, 2005 [Retrieved from the Internet Jan. 23, 2010: http://www.ncbi.nlm.nih.gov/nuccore/E17054.1?ordinalpos=2 &tool=Entr.
GenBank: AJ252161.1 *Alicyclobacillus acidocaldarius* maltose/ maltodextrine transport gene region(malEFGR genese, cdaA gene and glcA gene), NCBI, Hulsmann, A. http://www.ncbi.nlm.nih.gov/nuccore/AJ252161 (Jan. 6, 2000).
Gessesse, Amare, "Purification and Properties of Two Thermostable Alkaline Xylanases from an Alkaliphilic *Bacillus sp.*," Applied and Environmental Microbiology, Sep. 1998, pp. 3533-3535.
Glenn et al., "Transformation of Acidiphilium by electroporation and conjugation," Can J Microbiol. May 1992;38 (5):387-93.
Goldstein et al., "The Hydrolysis of Cellulose with Superconcentrated Hydrochloric Acid," Biotechnology and Bioengineering Symp. No. 13, pp. 17-25 (1983).
Grassin et al., "Chapter 2.13, Fruit Juices," (T. Godfrey and S. West, eds.), Industrial Enzymology, 2nd Ed., pp. 227-264 (1996).
Grethlein, H. E., "Pretreatment for enhanced hydrolysis of cellulosic biomass," Biotechnol. Adv. 1984. 2:43-62.
Grethlein, Hans E., "Comparison of the Economics of Acid and Enzymatic Hydrolysis of Newsprint," Biotechnology and Bioengineering, vol. XX, pp. 503-525 (1978).
Guateli, J. C. et al., 1990, PNAS. USA, 87: 1874-1878.
Hamelinck, CN, G van Hooijdonk, and APC Faaij, 2005, Ethanol from lignocellulosic biomass: techno-economic performance in short-, middle-, and long-term, Biomass Bioenergy, 28:384-410.
Hanselmann, K.W., "Lignochemicals," Experientia 38 (1982) pp. 176-189.
Houghton et al., "Fungal Upgrading of Wheat Straw for Straw-Thermoplastics Production," Applied Biochemistry and Biotechnology, vol. 113-116, 2004, pp. 71-93.
Hulsmann et al., "Maltose and maltodextrin transport in the thermoacidophilic gram-positive bacterium *Alicyclobacillus acidocaldarius* is mediated by a high-affinity transport system that includes a maltose binding protein tolerant to low pH," J. Bacteriology, Nov. 2000, p. 6292-6301.

Huygen, K. et al., 1996, Nature Medicine, 2(8): 893-898.
International Preliminary Report on Patentability and Written Opinion of the International Searching Authority for PCT/US06/42566 dated Apr. 23, 2009 (7 pages).
International Search Report and Written Opinion of the International Search Authority for PCT/US09/32333, mailed Jun. 19, 2009, 9 pages.
International Search Report of the International Searching Authority for PCT/US06/42566, dated Jul. 25, 2008.
Ito et al., "Purification and properties of acid stable xylanases from *Aspergillus kawachii*," Bioscience Biotechnology and Biochemistry 56 (4):547-550, Apr. 1992.
Jeffries, 1996, Curr. Op. in Biotech., 7:337-342.
Jones et al., "Cloning and transcriptional analysis of the *Thermoanaerobacter ethanolicus* strain 39E maltose ABC transport system," Extremophiles 2002, 6:291-299.
Keller et al., "Microbial Pretreatment of Biomass: Potential for Reducing the Severity of Thermochemical Biomass Pretreatment," Applied Biochemistry and Biotechnology, vol. 105-108, 2003.
Kenealy et al., "Rapid 2,2'-bicinchoninic-based xylanase assay compatible with high throughput screening," Biotechnology Letters 25: 1619-1623, 2003.
Kievitis, T. et al., 1991, J. Virol. Methods, 35: 273-286.
Knappert et al., "Partial Acid Hydrolysis of Cellulosic Materials as a Pretreatment for Enzymatic Hydrolysis," Biotechnology and Bioengineering, vol. XXII, pp. 1449-1463 (1980).
Kohler, G. et al., 1975, Nature, 256(5517): 495497.
Kulkarni et al., "Molecular and biotechnological aspects of xylanases," FEMS Microbiology Reviews 23 (1999) 411-456.
Kwoh, D. Y. et al., 1989, PNAS. USA, 86: 1173-1177.
Lau et al., "PCR ligation mutagenesis in transformable streptococci: application and efficiency," Journal of Microbiological Methods 49 (2002) 193-205.
Lauro et al., "Characterization of a β-glycosidase from the thermoacidophilic bacterium *Alicyclobacillus acidocaldarius*," Extremophiles (2006) 10:301-310.
Lauro et al., "Isolation and characterization of a new family 42 beta-galactosidase from the thermoacidophilic bacterium *Alicyclobacillus acidocaldarius*: Identification of the active site residues," Biochimica et Biophysica Acta 1784 (2008) 292-301.
Lavarack et al., "The acid hydrolysis of sugarcane begasse hemicellulose to produce xylose, arabinose, glucose and other products," Biomass and Bioenergy 23 (2002) 367-380.
Lee et al., "Oxygen Effects on Thermophilic Microbial Populations in Biofilters Treating Nitric Oxide Containing Off-Gas Streams," Environmental Progress, vol. 20, No. 3, Oct. 2001.
Lin et al., "Purification, Characterization, and Gene Cloning of Thermopsin, a Thermostable Acid Protease from *Sulfolobus acidocaldarius*," The Journal of Biological Chemistry, 1990, vol. 265, No. 3, pp. 1490-1495.
Liu C, and Ce Wyman, 2003, The effect of flow rate of compressed hot water on xylan, lignin, and total mass removal from corn stover, Ind. Eng. Chem. Res., 42:5409-5416.
Lucas et al., C4-Dicarboxylate Transporter/Malic Acid Transport Protein [*Alicyclobacillus acidocaldarius* LAA1], GenBank Direct Submission, Accession Number: EED06059, Dec. 17, 2008 (Retrieved from the Internet Dec. 15, 2009: <URL:http://www.ncbi.nlm.nlh.gov/.
Luckow, V. A., 1993, Baculovirus systems for the expression of human gene products. Curr. Op. Biotechnology 4: 564-572.
Lynd et al., 2002, Micro. and Mol. Biol. Rev., vol. 66, No. 3, P. 506-577.
Lynd, Lee R., "Overview and Evaluation of Fuel Ethanol from Cellulosic Biomass: Technology, Economics, the Environment, and Policy," Annu. Rev. Energy Environ. 1996, 21:403-65.
Mackenzie et al., "Multiple Chromosomes in Bacteria: The Yin and Yang of trp Gene Localization in *Rhodobacter sphaeroides* 2.4.1," Genetics 153: 525-538 (Oct. 1999).
Malherbe and Cloete, 2002, Re/View in Environmental Science and Bio/Technology, 1: 105-114.
Manchenko, Gennady P., "Handbook of Detection of Enzymes on Electrophoretic Gels," CRC Press, Inc. 1994, pp. 220-240.

(56) References Cited

OTHER PUBLICATIONS

Matthews, J. A. et al., 1988, Anal. Biochem., 169: 1-25.
Mccoy, Michael, "Chemical Makers Try Biotech Paths," Chemical Engineering News, Jun. 22, 1998, pp. 13-19.
Merrifield, R. D., 1966, J. Am. Chem. Soc., 88(21): 5051-5052.
Michel et al., "Specificity of the protein secretory apparatus: secretion of the heat-labile enterotoxin B subunit pentamers by different species of Gram bacteria," Gene 152 (1995) pp. 41-45.
Database UniProt [Online]. Feb. 10, 2009. XP-002698982. Database accession No. B7DRM6, 1 page.
Extended Supplementary European Search Report for EP 09 75 5308, dated Jun. 18, 2013, 3 pages.

* cited by examiner

FIG. 1

```
gb|AAY21825.1|         ------------------------------------------SVSTTVSSTSS----PST
ref|XP_001743680.1|    ----------------------------------------TTSTTSTTSTTSTNSTNSTT
ref|XP_001525241.1|    ------------------------------------------------------------
RAAC03697              MLGCVKVGLETGKEAIQRVLNWSCTHFIQREREMMRKTIAAIVTLGTVSSMLAGTVYAAT
ref|YP_308280.1|       ----------------------------------------TGSSFIEGNVYADDGIDLG
ref|ZP_01916690.1|     ---------------------------------------SGPLQGSGEQGQNTVTA gb|AAY21825.1|         TLTSTSTTNQTTNTTTASSTPANTTLTSTSPTNQTTTTNNSSG---TQTSNTSSTQPPTS
ref|XP_001743680.1|    STTSTTSTTSTTSTTSTTSTTSTTSTTSTTSTTSTSSTGNTSS---SAISNTTANSTDTS
ref|XP_001525241.1|    --TSTTSTTSTTNTNVPANSTASTTTNST--ANSTTSTANNSN---QLAQDKAAKYE---
RAAC03697              NTTNATSTCNTANTTASATSNATSNTTGSAPTNPNVLTQKSAVYQLIEVFNTIPSWPTGL
ref|YP_308280.1|       WSTPITGDAVTPADINRPGNISGTVTTGAAPQLPNVLTDAEIA---AIVTDIQNETAFAA
ref|ZP_01916690.1|     PNSSESGALTNSAPQNRTSTSTSSNSPGSAPANPGIATQKSAPSEPVRPSRPTPPAPSGS
                         :  :       ..       . . : :      .:         * gb|AAY21825.1|         QSLDTST-----------------------------------------------------
ref|XP_001743680.1|    TSMSPSRT-NGSDTPSSPAPPA--------------------------------------
ref|XP_001525241.1|    ------------------------------------------------------------
RAAC03697              QSIDPATQNAQWDWKYKPIPPSQWVGLACVFPGDPESKYAADLGIQMTDPNGPVTAGQLA
ref|YP_308280.1|       FSPGAITRSSDWNIKYYPVPAS--------------------------------------
ref|ZP_01916690.1|     SGPQPAAPVSQ------------------------------------------------- gb|AAY21825.1|         -----------
ref|XP_001743680.1|    -----------
ref|XP_001525241.1|    -----------
RAAC03697              QWIVDWEVKAR
ref|YP_308280.1|       -----------
ref|ZP_01916690.1|     -----------
```

FIG. 2

```
gb|EAZ41188.1|        ----------ARVVHHREHAMRAQAG---------------LDRVEQQQAAMGTGQFTGH
RAAC02297             -MVPFDPSCHARFVHHRNHVLQAETGHLKGGDNGMGYVILALGLVPSVLLVMGAGQGEYA
ref|YP_429214.1|      -----------LLRPAVERCIASWSG---------------GALR-AIEQLGND----I
gb|AAR38445.1|        ----------NGLLVGSYYTLLALGLS-----------IIFSLGGVVNLAHGAFYAVGAYL
ref|ZP_01774730.1|    ----------------IARVAAVDRD------------------QLLLVDET-----
ref|ZP_01171092.1|    KRNSELFSLYDMLLSEIEMMQQTRINAYSLIRTLKPYFKELDGTITRLLANWTNDKGPEY gb|EAZ41188.1|        GIERRRERAAGVAFAHHRLQEHRFDEPLVT-------------------------------
RAAC02297             GTRTRARTAAGWYGAKMRVRKRLEDEQLVSLLRKSGLTLKAYQYHYLRIGLTLVFLLMCV
ref|YP_429214.1|      NLKEADVLIA--------VLMQIVEGGVAK------------------------------
gb|AAR38445.1|        TVLFTDILGFG--------LAFLITPAVVG------------------------------
ref|ZP_01774730.1|    -HAFRGRVAGG----------YLHRHHLSQ------------------------------
ref|ZP_01171092.1|    ALDIFAKEIGTNEAKSLANVLKKFDENKRD------------------------------ gb|EAZ41188.1|        --------------------------CGILEHLAQAGL----------------------
RAAC02297             VGLLHGRLLPMLFPLVVWFGLEYRRPFPMYYGFLALQKQAALERDKALYLLYRLLLQEAV
ref|YP_429214.1|      ---------------------------LAGVMEEEAL-----------------------
gb|AAR38445.1|        ---------------------------LIGIAIEALFLR---------------------
ref|ZP_01774730.1|    ---------------------------ELPCVGDWVCLEK--------------------
ref|ZP_01171092.1|    ---------------------------TIILSLKGMEDMFIN------------------ gb|EAZ41188.1|        -----------------------------------VVRRHGDH----------------
RAAC02297             AFRGRPLGVYDMLRRQLHRVPVLSPFLERCLHDWVDDPAVALRRFGDEVGTSQAKALAHM
ref|YP_429214.1|      -----------------------------------------RLDEL-------------
gb|AAR38445.1|        -----------------------------------------RLYNKDPILTLLFTFGLA
ref|ZP_01774730.1|    -----------------------------------------APGDDVGVVRALLERRT
ref|ZP_01171092.1|    -----------------------------------------SQIENYRRKRKLYVDLAKL gb|EAZ41188.1|        ------------------------------------------------------------
RAAC02297             LIEIEEAGVAVALDVLQTNLERFRADRIAAFRAHLNTRSILATALTMLGLGATSFDLMVV
ref|YP_429214.1|      ------------------------------------------------------------
gb|AAR38445.1|        MSGEQALRLIFGASGIPFSIPEFLSGQLH-------------------------------
ref|ZP_01774730.1|    LLRRKSAGDAIEYQMIASNLD
ref|ZP_01171092.1|    PIKATHGLIILNFVVVIIFMVSYLMKDS-------------------------------- gb|EAZ41188.1|        ----------------
RAAC02297             IQVYAGALMRASAGG
ref|YP_429214.1|      ----------------
gb|AAR38445.1|        ----------------
ref|ZP_01774730.1|    ----------------
ref|ZP_01171092.1|    ----------------
```

FIG. 3

```
ref|ZP_01900573.1|   ------------------------------------------------------------
RAAC02298            MGGDIVANALNTLAQIVLYGVACAGLLWLFEQVWRDGWAWAKRTYYGIGHRQLLRVSECF
ref|ZP_01301851.1|   ------------------------------------------------------------
ref|ZP_01171091.1|   ------------------------------------------------------------
ref|ZP_02598168.1|   ------------------------------------------------------------
ref|ZP_01575699.1|   ------------------------------------------------------------ ref|ZP_01900573.1|   ------------------------------------------------------------
RAAC02298            RGRQTTQLPWWMGWHDHLETLLQATLKRPHRDAVSRFIVGSVTAAVIVGVLTSVVTHNPF
ref|ZP_01301851.1|   ------------------------------------------------------------
ref|ZP_01171091.1|   -----------------------------VSTFIVLSLLIGFLTFSLILVKYQDAF
ref|ZP_02598168.1|   ---------------HLELLLSSISKNSKKINVFNFLFASMLVFVITVSVLYFLIHDLV
ref|ZP_01575699.1|   ---------------NHIYKVLTASLSKEISDLGTYSFMIGSISLFIFS-FLTALKLFNFI ref|ZP_01900573.1|   ------------------------------------------------------------
RAAC02298            YALVMFALTVVAPYCVLQIRRYHMSIRNSYDIGTLLSVIVPEYRKQHGSMLHALQ-STVE
ref|ZP_01301851.1|   ------------------------------------------------------------
ref|ZP_01171091.1|   LGLIIGTVVSIIPYIILHVQLRNTRNAVGNQLTEIVELIIHAYGSSSSDMYQALK-VTQS
ref|ZP_02598168.1|   FALGIGITFGILPYVAIRYRLTMLRLKTQYAFLIEYHVLFQNYQSTSKDIYYTML-NAVK
ref|ZP_01575699.1|   ISLGIAIIIAASPYVLLRLKLRSVQIEGSYDANVLVPSITNEYKQHYFNMINAIENCAVR ref|ZP_01900573.1|   ----------IETISYRLSDHTTADDASR---YRSEDNVGEAWQKEPMTRLRTLLMDELII
RAAC02298            HLPPSPIRRAVARLTDRLTDYTTPDDARRALHRFVKELGTSWAAQLASDIEHALLDGVNV
ref|ZP_01301851.1|   -------------LGSRIAKKTLQAMEHH--LVYGAALAGAFA-------LLMLAWAWFYF
ref|ZP_01171091.1|   HIAEKELRSILVRLISDLQTARTESEMRLSIDLFIFTCGNSWSMRLGNIILKSYLHQENV
ref|ZP_02598168.1|   ETKNKELKHIYMKLLSSLQKDRGNLEFERAVNVFSYSINSTFAKRFAKLLKKAHIDRGDI
ref|ZP_01575699.1|   EDIGSYSRKNLFRLSLALKAYYSEEDLDKAIERFVFAYNTEWAMLLGLNIKMAIHKGIVV
                           :           :                          :      :     .

ref|ZP_01900573.1|   DNAAIELLEKECSEEIDAAVTRYLA-----------------------------------
RAAC02298            E-ASLALLHKEFQEIEDARKSQNLARIDTLIISCVPFLMWPVMMV---LFYLFVSRNIFQ
ref|ZP_01301851.1|   TRTGRGLGSNQFLRGARFGTARQLRR----------LIW--------------------
ref|ZP_01171091.1|   MSALIQLQN-QMVNNQKMLEQEKASSYDAFVDATLTVILFPISLIG--AKFMTKPQSWMA
ref|ZP_02598168.1|   TMSLMDLNA-DIKKRKQDIQTDKTRKLETVILGYSPMVLFP-LMIF--LAYRISGVVDFW
ref|ZP_01575699.1|   SSGLEDILK-KLKDSSEQVEVSKRYNTDAFAIKFLLIPLYIGGILFSISTFDFTLRKYFE
                          :  .

ref|ZP_01900573.1|   ------------------------------------
RAAC02298            YQFANPTGFTWFLLTLLATLGSFIIGITFYKPKQDI
ref|ZP_01301851.1|   ------------------------------------
ref|ZP_01171091.1|   LQFGEKATLMLFILTTIMVVISLLVGLIIRKPKNDL
ref|ZP_02598168.1|   YVFQQKTPIILFTISLVMSIFSVLTAIVMSKPRADI
ref|ZP_01575699.1|   YQFLNPIGLRTGIISFMGIIVSFISLRMIRKPKYDI
```

FIG. 4

```
ref|ZP_01171090.1|    --------------------------------------------------NSEWLERQ
ref|ZP_02598167.1|    ------------------EKAKSVKQTHEFSEVLEIVKKSIENIYEDRGISSDEKIKRQ
RAAC02299             MSVHELLPSEPFRADRYVLETQRERAKDYGEVPFDRVIEAFQQYLGEEVGGKDDVDSQYL
ref|ZP_01575700.1|    -----------------------------------------------------------L
ref|ZP_02849387.1|    ----------SARLRLDQSAVTDPLDRGEAAGRGADFGRLAEEIRSYLAAPRGLTEEERRQYS
ref|NP_627754.1|      ----------------------------------------------------------- ref|ZP_01171090.1|    ----HQAIIGDKVAIEYFLAEIEKVLRTK-NITSKDFPSFFNSLSEAIFHEIWGLSVLAKW
ref|ZP_02598167.1|    EIEHNAILGDHEAEKILTKEIEKCLREQ-NLLDVKYPDFFDSLAQALFHEIYGFGAFYKW
RAAC02299             HRKYRALIGDEAAKQYFIHRIHDFLRERPEFQNTRYPRYYPDLPEAIFQHALGFGPMSVW
ref|ZP_01575700.1|    ERHRNAILGKPTEVNYLKDKIREYLKAK-RLENERYPTWYKNLIDAIFHENWGIAGIAEW
ref|ZP_02849387.1|    ETLNRAVLGFASEREQVLAIIADRLIRLRTHQLDGYKHPYATIAEALFAEVTGLNVLELV
ref|NP_627754.1|      ------------------------------------RQLRSELVGSGPLEPL
                                                          :  . *  :

ref|ZP_01171090.1|    ERYPE-SEACCIRGTQLWIDIDG--QFVKQEEEFESLTVVERIKRAFVIRRPDSVINRES
ref|ZP_02598167.1|    KKYPE-SVSASTIGKEIWFKTNG--KFVKQEEELRDEEHIYEIFRALEVGHKGLKINHEN
RAAC02299             FANP--TESATVNGTQILFGVKGSNTKVLQPFAFDSIDQVKRLVRTLTLRDPANQVNQTN
ref|ZP_01575700.1|    MDMPE-SSSAKIIGDRIYFFING--KQVLKEQRISK-KRFEQLRQAFMLSDETKRANEN-
ref|ZP_02849387.1|    LARKDGLEEIQVVGSQIYEVRDG--QTMLSSYRFDHERDVERIQQNLVLYNND-RINPRK
ref|NP_627754.1|      LADPSVTDVLVSAPDRVWVDRGG--GLELAPVSFPDAAAVRRLAQRLAT-VAGRRLDDAR
                       .:         *           :          .. :   :         :

ref|ZP_01171090.1|    PELEIEREDGSRITMIQ--PPRSRENYIMIRRFIVNKYSLHDQASR--GTIPQEDIPIFQ
ref|ZP_02598167.1|    PRAEIEMKDGTRVNIIR--PPANLFPVIVFRRFIIKNFSFEEQARR--KTISSEDVELME
RAAC02299             HWTQVDMLNGTRVTIFA--PPLSETYVLVFRQYTFHRYTFEHEAEM--RTIPADSVEWWK
ref|ZP_01575700.1|    -YSELYMYSGERVTVYTGRKVIDGQSVMVFRKYVVKVLTFEEQARR--GTIPVELVPALE
ref|ZP_02849387.1|    RWAEVMLRDGSRVTMTG--FGFTSKPTLTIRFFTVRSFSLEALCSAPYHTLSLAMRNMLL
ref|NP_627754.1|      PWVDARLPDGTRLHAVLP-PVAVDCTCLALRVVRPRAFTLRELAAA--GTVPPGGDRVLR
                           : .* *:             : :*    .  ::.     *:.

ref|ZP_01171090.1|    ALARTMANMIVAGRVRSAKSTFMTTLIGERDDSFVGAVLEK-HFEVALSKHFPNRL--FF
ref|ZP_02598167.1|    IISQLYLNMIIAGHVESGKSTMLKTIFASRSPEKIAICIET-SPESFLKKDFPDRL--VY
RAAC02299             LLSRLMLTMVTTGIRRSGKTTFLKVIFGARDPNLEVVTVERGTFEAHLKRDFPERAGRII
ref|ZP_01575700.1|    ALVNCGVKVAFIGPVRSGKSTMLLTWQLYEDPELEGVLIQT-DPEIRIHEVMPKAP--IM
ref|ZP_02849387.1|    DVLEARFNLVIIGPTNSGKTHLMKALIAELPDEERIVTIEG-RFEMMLGRDFPMKN-TV
ref|NP_627754.1|      ALLRARLSFLVSGGTGSGKTTLLSALLGLVGPDERIVLAED---SAELRPDHPHVVRLET
                       :  ..  *  *.* :: .            .  .  .   .        * ref|ZP_01171090.1|    EIQAKEGD  LHKAIPRLLRMEHDFVVVGEIRS-LEIEAYLQSTERGERGSLSTFHLT
ref|ZP_02598167.1|    DMYTINGN----IEDVIYSALRTDHDYIIFQEVRG-IEADGAMKGAERGTTGMMMTYHIT
RAAC02299             ALKSPLDE----MASLFPAFLRSDAHYMMVPEIRS-SEVDLLILSRERGN-GCLASYHSP
ref|ZP_01575700.1|    PLIAGGKE----LFELSSEILKSDADYLVVQEVRDGYTAYIAVEAANKGTNRLKITAHLS
ref|ZP_02849387.1|    EYEADEDDPQHRAEQAFKLALRQSPQRIVHAEIRD-MDANIYVRACTRCHSGSMTTVHAN
ref|NP_627754.1|      RPANQEGAGLVTLEDLVRQALRMRPDRLVVGERVG-PEVVHLLAALNTGHEGCCCCTVHAN
                              *:      ::  ::*. *:*.    .   .     .  * ref|ZP_01171090.1|    DVEQVVEQLARLELDEFPTRRFEVEVERIARNID-IIITMDTER-DRSKKRVVGVTEVIW
ref|ZP_02598167.1|    DPSRTPEQLAQHIVDAYANRKLENEIRRVAKNLD-LGIIMKNDE-PKNEKRLMSIYEICY
RAAC02299             YVTNIPRELADLALENNPSRDYRATYIRTAQSLD-VAITMWED--PTGRKIVTGVYAYEF
ref|ZP_01575700.1|    NPEDFCYDIANKIQGVFGG-NIDYQMVRVANSFN-FLFEMVQLPGNRSQKRLKSIYEIRY
ref|ZP_02849387.1|    TLEDVPEAITDMCMLDGRGMNPERLTKRIAEYVTQVGTEMRYLG---GRRVIARIGELSW
ref|NP_627754.1|      AAADVPARLEALGTT--AGLNRAALHSQLAAALS-VVLHLVRDR--AGRRRIAEVHVLER
                                :              : *   .  .  :   .       ..:  :  :

ref|ZP_01171090.1|    DNQQRRHYTQDLIRYSKLKDKYYYSSNI--------------------------------
ref|ZP_02598167.1|    DYKGDKAWINYLMKYNELDERWEYNSEVSEALIKKMK-----------------------
RAAC02299             DHETESYTVTTWMKYHRATDTWTFHAEIPPSMRARLEDTYPDVLAAFEAEFQRLASAYPF
ref|ZP_01575700.1|    DTEANVISYHKICEYNKDTDSWCFSYSVGNKVTELGEFENPKALEVYKNTLKFLSEKYP-
ref|ZP_02849387.1|    AN--NEVNVRDWARFDETSEQWIYPEKPSPKARTRLSE----------------------
ref|NP_627754.1|      D----------------------------------------------------------- ref|ZP_01171090.1|    -------------
ref|ZP_02598167.1|    -------------
RAAC02299             QGEAKRRVKIGG
ref|ZP_01575700.1|    -------------
ref|ZP_02849387.1|    -------------
ref|NP_627754.1|      -------------
```

FIG. 5

```
ref|ZP_02598166.1|  ------------------------------------LLISDRVLPYSELSTI--EFENKKVF
ref|ZP_01171089.1|  --------------------------------AIVIDGKCFPQSELKELRKLYPEIPVF
ref|YP_159112.1|    ------------------GHATSSEPLCAVNGTVPDVVVLDA--FRPANLGALEQLTLRYPQI
ref|ZP_02007550.1|  -------------------------GQGNDLLILEASRFSSDDLQQLRRLSSEHPET
ref|ZP_02849386.1|  ------------------------------------------------------------
RAAC02300           MIAVGLRESLQRELTGRVEIAEDWHALEGRKVDALLLDAKRVPETELYEIREWFSETPIT ref|ZP_02598166.1|  YMLENQYKPQLESTVKAICNSKDIYLIPPRLVVEQIVDFIDQNLN-LAMVQK-TNIITFF
ref|ZP_01171089.1|  YQFYQVTNEQQMKNLQMICAAHRIVLLSEFLSEKQIEEEVEKHLFAKESVYK-NRIISFF
ref|YP_159112.1|    EPIVITADTSSDFLLQAFRAGVREVLPISPSPEALHAALARITRKRGGSATN-GKILALT
ref|ZP_02007550.1|  LCMLLLTEAPSADLLMRAMRAGVQCVLPWPPEAQEFRDEVQRCTSHALSSSINDGQVVSFL
ref|ZP_02849386.1|  ------------------------------------------AAPLITFV
RAAC02300           YIVDEFTS-----ALTAFAAAHNIRLVHVSRVQSYLDEAIGQGQS--------TPILAFW
                                                                            :::

ref|ZP_02598166.1|  SSVSNIGTTSTCLSVGKALSQYTNAKVGVLLLNAWDSGTDQLNFKGN---YMDQVKSKLA
ref|ZP_01171089.1|  GTHSGAGVSTTVLNVADLLAQQVNEKVLVLSLNPWDPADYFLPEYGK---YLSDIKIELK
ref|YP_159112.1|    SCKGGSGATFIATNLAWVLAAAHGKRVALIDLNLQFGDAAMYVTDQK---PASNLALVCQ
ref|ZP_02007550.1|  SCRGGSGTTFIAANFAHVLSARHGKRVLLIDLCQQYGDAAFLLTDQS---PPATLANVCN
ref|ZP_02849386.1|  GTTPNIGTTSAAFAAAFRMAEASGRQIGYLCLHLKSAKLERYLGIAEPAVTLDKLRPELK
RAAC02300           GVYPRLGTTTIALAVAHVLAAQHGKSVGVLGLNAYDPGTVMVPGAEH---HLDDILSYLA
                          . *.:    . ::  . : *                        :

ref|ZP_02598166.1|  SKTISSEQEFLSQFHMVNP-NLYILGGNRDTKMERLFTKEEINYLIEHSKQTFDVVLVDA
ref|ZP_01171089.1|  TGGITEEKLQKAVHHYPN--SFYHLAGNRDIKLQRYYRTEEISTLLDTAKKVFDVILIDA
ref|YP_159112.1|    QIHRLDAAFLQSAMIEVAP-GFHLLAAPDDPAHSTDVRPEHVEAILKVARTNYDFVIVDV
ref|ZP_02007550.1|  QIDRLDAALLDACLTHVSQ-DFDVLAGAGDPIKSGEIKATHLERILALAASMYDVVVFDV
ref|ZP_02849386.1|  SGSLTPGKLQRAVQPVRGMPNLHVLFGNMLRDQAEFYSPEEMKHLLQIAGQTFAMVIIDV
RAAC02300           QQKLDPETLQAAMEFVLR---VKYLPGLQNQTRALAVMPEHVRHLLRVAQSQFEVLVLDV
                          :       . * .    .:  :: :   :.::.*.

ref|ZP_02598166.1|  GSHFDNANMVQALNESNLRFLIMNQQTKAIR-KFNQFHRDILYPLGYEKEDLLMIINQFE
ref|ZP_01171089.1|  GTIHFDNAAFAQAYKQSDLKFLVTTQEPKGFRGYWPHIFHQLLEPIGGKADEYLLI-----
ref|YP_159112.1|    GRSLD-AVSLKPFDMADMIFPVVQLTLPFIR--EAKRLVEVFVSLGYPMSKVGLVVNRQH
ref|ZP_02007550.1|  GQDIN-PASIVVLDHSNVIYPVLHLSLPYLR--AGRKLMEICHSLGYRAERLRLVINQYD
ref|ZP_02849386.1|  GAYWDNAATICALREADTRIIVTTDALS--------------------------
RAAC02300           GSALNTALALEGLQAATHRYVIANDLVATQR-QLLRQMDYILRPLGVEPSDLMLVGSQVH
                    * :  .            :       :

ref|ZP_02598166.1|  DLSHLPTTKDIHKDIDIPLLTTIEKSENGMLS--EIERTVLYDYEDIGYKQSINAVAKSI
ref|ZP_01171089.1|  ------------------------------------------------------------
ref|YP_159112.1|    KNSDIS-LQDVERTVKAKLFKTVPNSYDTVAASVNQGEPIARLAKNSPVTKALREIAESL
ref|ZP_02007550.1|  KHMPIS-QNMMES------------------AFGMPVAHILPYDP------------
ref|ZP_02849386.1|  ------------------------------------------------------------
RAAC02300           GKGSLAKSVGLMQVTSIPYYPSIDLFAEQSPEPMKVFLAEKTFRKAVETLAQSAMTTPVT ref|ZP_02598166.1|  ASSV-----
ref|ZP_01171089.1|  ---------
ref|YP_159112.1|    VDDP-----
ref|ZP_02007550.1|  ---------
ref|ZP_02849386.1|  ---------
RAAC02300           PEVAASVRA
```

FIG. 6

```
emb|CAE47778.1|   ---------------------------------------VVVAK--EDIAEMQTIYDTMVETK
ref|NP_967133.1|  ---------------------------------------VVVAK--EDIAEMQTIYDTMVETK
emb|CAE47790.1|   ---------------------------------------VVVAK--EDTARMQTVYDTMVETK
RAAC02301         MKSWVRYTLATTLFVVGVGGSIAYNQFVSPMLTSEWVYVAR--TQLPADTPIQASDVERI
ref|ZP_02756760.1| IKNKANILLQFSLFILFAGG---VFLFTQSQVKPVAVYQYS--RNIPENTVIQKGDYIKT
ref|ZP_01171088.1| MKPWLKTTLGVLLSVFVIAFIIVWDTVIKDKIDSVEVAIVRPGVVIEKNQVISKDLLMME
                                                          *       :     :

emb|CAE47778.1|   ELPADFIQPDAITIPDEIIGNVAAVPIRKGQMVVKNNLLTPGPDTGISLQVAPSKRAVTI
ref|NP_967133.1|  ELPADFIQPDAITIPDEIIGNVAAVPIRKGQMVVKNNLLTPGPDTGISLQVAPSKRAVTI
emb|CAE47790.1|   ELPADFIQPDAITVPDEIIGNVAAVPIRKGQMIVKNNLLTPGPDTGISLQVAPSKRAVTI
RAAC02301         RVPKSEVSPDAITNAEGLMGTYTAQPVDQNQVLTA---LPTEPDP---FTITPGTEDVPT
ref|ZP_02756760.1| FKPKDILTKSMITNEKDINGKILTTNVYRSEYAIKNNLEDPAKLDEFAKIDLSNLRKVSI
ref|ZP_01171088.1| QRNRATLVEGTVYDMDDVVGYEAKQKLYGNSILSERDVEFIPFTP----DPEKGEAIRPI
                   :  . :   . : *    :  : .. .             .  . * emb|CAE47778.1|   PVDEVRGVAKLIRPGDRIDIYAAVDSGKGVN-----------------------------
ref|NP_967133.1|  PVDEVRGVAKLIRPGDRIDIYAAVDSGKGVN-----------------------------
emb|CAE47790.1|   PVDEVRGVAKLIRPGDRIDIYAAVDSGKGVN-----------------------------
RAAC02301         PSTWIASVSETLRQGDYVDLIPIAEPQAGSNNVGMLTTTSEASEFKHLLVLSVHTDNNAE
ref|ZP_02756760.1| PVEMKDAVGGNLKKGDRVDLTFVKQGDSKNNDTS--DSFTYAKTFMQDVLVYNVVDDGGK
ref|ZP_01171088.1| PASWIYASPSTIRRKDEID-----------------------------------------
                  *         ::   * :* emb|CAE47778.1|   ------------------------------------------------------------
ref|NP_967133.1|  ------------------------------------------------------------
emb|CAE47790.1|   ------------------------------------------------------------
RAAC02301         VTSQQTGAPQSVGARGNGSGVPASVDVKMTSAEAQALASLIQQKYQLLIVGVSDDNRTGG
ref|ZP_02756760.1| KYVDQTEGTQSLANEKGEVVESGSLSIVTVAVTAQQAEEI--------------------
ref|ZP_01171088.1| ------------------------------------------------------------ emb|CAE47778.1|   ---
ref|NP_967133.1|  ---
emb|CAE47790.1|   ---
RAAC02301         GAK
ref|ZP_02756760.1| ---
ref|ZP_01171088.1| ---
```

FIG. 7

```
emb|CAJ49597.1|      ------------------------------------------------------------
ref|YP_158155.1|     ------------------------------------------------------------
RAAC02302            MLYLAFPADLRERYAESTWLVYDKQVLETSFAPGDILLLSSWVVPHRAEQLQVIHRARQE
ref|YP_061819.1|     ------------------------------------------------------------
ref|NP_779769.1|     ------------------------------------------------------------
ref|ZP_01171087.1|   -EILRMIEQWRFQYNDSLRIVYICERERTDPLLGSLVARN----------VLDIFYTRSI emb|CAJ49597.1|      ------------------------------------------------------------
ref|YP_158155.1|     ------------------------------------------------------------
RAAC02302            GARVIFVGSKEDETDEWKRQLCALGVYDFAFFGDEVVLSVLDDLIEHPRTPLDVRAYVDE
ref|YP_061819.1|     ------------------------------------------------------------
ref|NP_779769.1|     ------------------------------------------------------------
ref|ZP_01171087.1|   PTKLLINQILEPPK---FSNVAKIGVTDIDLAN-----------LEYLEEQAEKSGIEDE emb|CAJ49597.1|      ------------------------------------------------------------
ref|YP_158155.1|     ------------------------------------------------------------
RAAC02302            TVWHLAREDPVVVEVETPKADVDEPTQDEAPFRPRWRRPRWGKPSPPAPERLQVVQPRLV
ref|YP_061819.1|     ------------------------------------------------------------
ref|NP_779769.1|     ------------------------------------------------------------
ref|ZP_01171087.1|   LTEEHANQPAKPIDIPTSKSKKKVELPSLKLPKPEFHIHVHKPSKIRTEKIAKAIDRKEV emb|CAJ49597.1|      ------------------------------------------------------VPAEQASE
ref|YP_158155.1|     ----------------------------------------------------------VL
RAAC02302            VVLGLWPRAGVTTITYLLAQLFAKQLPTRSVACIEHPRPWPRMWDYFQLDARMPAENYRH
ref|YP_061819.1|     -------------------------LDETRPRIIVRPKTVDDSGFVVKVEGGSEGPVYRV
ref|NP_779769.1|     --------------------------------P-DWRVAWA-------MRYGAPAL
ref|ZP_01171087.1|   VVISPFERSGSTFVS----HQLAYQIAERKIGITYFENPFKRPYTYDRFGGHLLVPNFKS emb|CAJ49597.1|      ALAQGRADVVLADRVDTAPMGPYWVGSGYSGQ-----------  PKAVIRS--DTPLRQW
ref|YP_158155.1|     NIANGNPTICETNTLQAEIEGPHYR------------------PAPVFR-----SVDRW
RAAC02302            WTADGVGQEIEVDGVDLVPLPPGWIGSADYGQPMVQYIPRHMRKPVTLVDVGAQAPSEML
ref|YP_061819.1|     LGAKPERWVAQTDFQNDEAIGYLAARLAKLG-----------VEDQLVRVCAVAGSTVV
ref|NP_779769.1|     TKALDALQAQQVRRIVILPLYPQYSTTT----------------TASVQDV-----VEAW
ref|ZP_01171087.1|   LYTSQPNANIDIDRKWTVEGVQIQALNPILEM-----------PYEEKDISIEKFLRLF emb|CAJ49597.1|      SEVAGKRVCMAQSN----------NRAEALARRYGATVQT-----------  -------
ref|YP_158155.1|     LTVAPGKSVPVSPF----------TAAAVRERLLGVL-----------------------
RAAC02302            LGVADRIVCVLDCDPTFLSIAELGNQYRALSAKYGESMVTVLNKWTRYAHYEDLFEDAVK
ref|YP_061819.1|     IGRENGVVFDWEPT--------LTSAAELISSPRGTDARIGVNARPTRAQRREDYFD---
ref|NP_779769.1|     CKRTPQVQVECIQD---------YAEDPAWVAAVAASIRR---HWQAHGRSEKL------
ref|ZP_01171087.1|   LSACDTPILIVDIG---------ADRQRPIYDELLSIASEVLVVMDCD------------ emb|CAJ49597.1|      ------------------------------------------------
ref|YP_158155.1|     ------------------------------------------------
RAAC02302            VPYLAPEMMQQALWAGQFPDVATLTSELHELTERVVTPLLPARVG
ref|YP_061819.1|     ------------------------------------------------
ref|NP_779769.1|     ------------------------------------------------
ref|ZP_01171087.1|   ------------------------------------------------
```

FIG. 8

```
ref|YP_001371728.1|    ------------------------------------------------------------
ref|ZP_00630666.1|     ------------------------------------------------------------
ref|YP_674884.1|       ------------------------------------------------------------
ref|YP_001235767.1|    ------------------------------------------------------------
RAAC02303              MKRIGLFRIPTEPKDVFPWLVKRLVLSLGLGGVLGYLALLVVALSLLGFLVGDYQANGRG
ref|NP_046584.1|       ------------------------------------------------------------ ref|YP_001371728.1|    ------------------------------------------------------------
ref|ZP_00630666.1|     ------------------------------------------------------------
ref|YP_674884.1|       ------------------------------------------------------------
ref|YP_001235767.1|    ------------------------------------------------------------
RAAC02303              TVENGNIVLSNATQARETALKNTYQQVADEWQQGLSASQIAQVEQQQVDLPAAVLMGIGX
ref|NP_046584.1|       ------------------------------------------------------------ ref|YP_001371728.1|    ------------------------------------------------------------
ref|ZP_00630666.1|     ------------------------------------------------------------
ref|YP_674884.1|       ------------------------------------------------------------
ref|YP_001235767.1|    ------------------------------------------------------------
RAAC02303              MINNLNPPNAQEYYDYLAPVYTWHTYIDVTITYQTVCSKNGCHVVTHEVDTPVTMLQCAN
ref|NP_046584.1|       ------------------------------------------------------------ ref|YP_001371728.1|    ------------------------------------------------------------
ref|ZP_00630666.1|     ------------------------------------------------------------
ref|YP_674884.1|       ------------------------------------------------------------
ref|YP_001235767.1|    ------------------------------------------------------------
RAAC02303              TWDGTLVDTYKWVTSMSGTTQNGVYTKKIELASSKRTYDWSRVWNLFAHIPTAQHTHIKE
ref|NP_046584.1|       ------------------------------------------------------------ ref|YP_001371728.1|    -----------------------------------IAPLPGLAQIAVMGRAVA-VHP
ref|ZP_00630666.1|     ------------------------------------------------------------
ref|YP_674884.1|       ------------------------------------------------------------
ref|YP_001235767.1|    ------------------------------------------------------------
RAAC02303              SQEDEDILAGFIGAIDYTISDPEVQKMVTSVLFPDGVVVTDLPHVSTALPSGNAIQNILH
ref|NP_046584.1|       -------------------------------GIVTSPTSSGGTPSSTGGSYSGK ref|YP_001371728.1|    HGAHIEEASQRFGIPAAWIIAVMQVESAGNMHA------ISSAGAMGLMQVMPSTWAELR
ref|ZP_00630666.1|     YAAQVTEASQRFGIPTTWIMAVMRTESAGDLRA------VSSAGAMGLMQVMPDTWAGLR
ref|YP_674884.1|       YAANIHQASRRFGIPAAWIRAVLRTESAGDVHA------ISSEGAMGLMQVMPDTWAELR
ref|YP_001235767.1|    ----IEQASARFDVPAKWIRAVMHVESGGHEYMNG-HLTVSSAGAMGLMQLEPETYQEMA
RAAC02303              YKAEIEAAARMFNIPAVLIAGVMYQESGGNQLDPTGHVLTSSAGAMGLMQVEPSTAAGLT
ref|NP_046584.1|       YSSYINSAASKYNVDPALIAAVIQQESGFNAKAR     SGVGAMGLMQLMPATAKSLG
                           *:  ::.    * .*:  **.          *  *******: * *      :

ref|YP_001371728.1|    IR-HALGR----DPFEPRDNILAGTAYLREMWDRYGN-VAAMLAAYNAGPGRYDEYRATA
ref|ZP_00630666.1|     IR-HGLGH----DPFEPRDNILAGAAYLREMWDRYGN-VAAMLAAYNAGPARYDGYRLAD
ref|YP_674884.1|       VR-YRLGL----DPFDPRDNIIAGTAYLRFMFDRYGN-VGAMLAAYNAGPDRYDEYLSKG
ref|YP_001235767.1|    AR-YGLGP----DPFNPLDNIMAGTAYIHQMYEIYG--SPGFLAAYNAGPGRLDDYLDYR
RAAC02303              TNGVPVGSNWYADLSNPTTNILLGAELLSELYHEFNENVDETLSAYNAGPGAFFFALSQG
ref|NP_046584.1|       VN---------NAYDPYQNVMGGTKYLAQQLEKFGGNVEKALAAYNAGPG---------
                          .  :*   *:: *:  :  . :.           *:****** ref|YP_001371728.1|    RPLF--AETRAYVAALT--------
ref|ZP_00630666.1|     RPLF--AETRAYVAAL---------
ref|YP_674884.1|       RALF--AETRAYVAALT--------
ref|YP_001235767.1|    QPLF--AQTRHYVAMIAPQ------
RAAC02303              YDVAQNSQTLEYVAAITQQWIPALEPYFGSL
ref|NP_046584.1|       -------------------------
```

FIG. 9

```
ref|YP_793245.1|    ------------------------------------------------------------
ref|NP_253469.1|    ULATRPSEUDMNASAERUGINSAPACGBEAZHYPTHETICALPRTEINPACGPSEUDMNAS
ref|YP_386759.1|    ------------------------------------------------------------
ref|ZP_01591801.1|  ------------------------------------------------------------
ref|YP_868126.1|    ------------------------------------------------------------
RAAC02304           ------------------------------------------------------------ ref|YP_793245.1|    ------------------------------------------------------------
ref|NP_253469.1|    AERUGINSACGBEAZHYPTHETICALPRTEINPAGPSEUDMNASAERUGINSASCRESIG
ref|YP_386759.1|    ------------------------------------------------------------
ref|ZP_01591801.1|  ------------------------------------------------------------
ref|YP_868126.1|    ------------------------------------------------------------
RAAC02304           ------------------------------------------------------------ ref|YP_793245.1|    ---------------------------------AVIEALATLGDLRDNPRSRHLPRIERY
ref|NP_253469.1|    NIFICANCEE-IDENTITIESPSITIVESGAPSAVIEALATLGDLRDNPRSRHLPRIERY
ref|YP_386759.1|    -----------------------------------SLASLAFTRDNETGAHIMRTQAY
ref|ZP_01591801.1|  -----------------------------------AMAKLAEFRDEDTGGHLERVKEY
ref|YP_868126.1|    -----------------------------------IIQKLGLAAEYRDNETGLHITRMSHY
RAAC02304           -----------------------------------MIIVHSLTSLFESIAFVAEYGEPDADRHVKRVATY
                                                       :.  .:  :  .  *:  *    * ref|YP_793245.1|    VRLLAEHLAAQRAFADELTPEAVDLLSKSALLHDIGKVAVPDRVLLNPGQLDAADTALLQ
ref|NP_253469.1|    VRLLAEHLAAQRAFADELTPEAVDLLSKSALLHDIGKVAVPDRVLLNPGQLDAADTALLQ
ref|YP_386759.1|    VRVLARQLRTHVRFRSVLTPEGIEQLCKSAPLHDIGKVGVPDAILRKQGPLTPQEMDQIK
ref|ZP_01591801.1|  CRLLAEDLNRHSPYSDLITAEFIDCIQHAAPLHDIGKVAIPDHILQKPFKLTPEFFDRMK
ref|YP_868126.1|    GRILAQYVCDSQAWC--------EMYFTALFMHDIGKIGIPDSILSKPGKLTDDERRQMQ
RAAC02304           ARFVGFHVLRWSPAA--------CERLALAALVHDVGKVVIPREILRKPGPLMPAERQYVQ
                    *.:..  :           :    :  :**:**: :*  :*  :   *    *    : ::

ref|YP_793245.1|    GHTRAGRDALASAERRLGQP-SGFLRFARQIAYSHHERWDGRGFPEGLAGERIPLAARIV
ref|NP_253469.1|    GHTRAGRDALASAERRLGQP-SGFLRFARQIAYSHHERWDGRGFPEGLAGERIPLAARIV
ref|YP_386759.1|    LHTVYGRDALRHASMRLGG--SSFLQMAEELVHTHHECWDGTGYPQQLTGEQIPVAGRLM
ref|ZP_01591801.1|  THTVIGADNLQLVYNNYPG--NLFVGMGIEIALYHHEQWDGSGYPDGLVGKNIPLPARIM
ref|YP_868126.1|    QHASFGAQILGDDD-------DPLLSLAKEIALYHHERWDGTGYPIIRLAGEQIPLSARIA
RAAC02304           CHTVYGRDMLVELARRYSGLDGGLFELAQQVALYHHERWDGDGYPEGLCREEIPLAARVV
                    *:  *   :  *             . :. :.  :!.   ***  *** *:* . *  :.**:..*:

ref|YP_793245.1|    ALADRYDELTSRHAYRPPLAHAEAVLLIQAGADSEFDPRLVEAFVAVADAFAEVAQ----
ref|NP_253469.1|    ALADRYDELTSRHAYRPPLAHAEAVLLIQAGAGSEFDPRLVEAFVAVADAFAEVAR----
ref|YP_386759.1|    ALADVYDALISRRCYKKPVPHHQARELILKGRGTRFDPAVVDAFLRAEHDFLAIAAA---
ref|ZP_01591801.1|  ALADVYDALRSDRCYRKAMSHEQARTIILEGDGRHFDPEVVMAFLRVETIFAKTAE----
ref|YP_868126.1|    AIADVFDALTSDRPYKVAWSTQKAFDYIEENAGTQFDPKLTRAFIECKAQVLEVQQ----
RAAC02304           HLVDVIDARLSPRPYKPGQSWHQVKQALVEGMFLDFDGMLVTGLLEVESAFLELVQAQTY
                    :.*  *   *  : *:   .   :.   :   .    **   :. .::       .

ref|YP_793245.1|    ------
ref|NP_253469.1|    ------
ref|YP_386759.1|    ------
ref|ZP_01591801.1|  ------
ref|YP_868126.1|    ------
RAAC02304           RQLVTI
```

FIG. 10

```
ref|YP_645800.1|      ----GHGGMMGGWQGPGGMMGSGPGAWAFLWMLVP VLFWTGLLVLLVWAVLRLVPPSCG
ref|YP_950098.1|      ----GTPWMMNDY----GMGGMG-LAWIFWLLLIAGVILLAVVLVKAFTRNAGGNAPTDG
RAAC02305             MSVFGVSRMMGGYG--FGMMG--------LYWFLS-VLMLLAAIVLVIWAILRMKP----
ref|ZP_01697403.1|    ----------MYGGY----GMMG--------VFSLIG-MIAQLVIFVLVIFLIVAGIKK---
ref|NP_111721.1|      IGIYGVG YRGPY -- FGMMGLP---YYGMYFFMP-IMAATSILVIILFIYLIACAF---
dbj|BAB60367.1|       IGIYGVG-YRGPY---FGMMGLP---YYGMYFFMP-IMAATSILVIILFIYLIAGAF---
                        . :           ** *            ::   ::         :*  .

ref|YP_645800.1|      NGG-RE-APEEKAEEILRRRFARGEIDAEEYEERRRLLEEHHQ-
ref|YP_950098.1|      QGPPRPGAGPARAREILEERYARGEISTEEYQERRRTLEEDSR-
RAAC02305             FGSLAQHEPYDRAVETLRERYARGEISREEYLERLEDLQDHRRS
ref|ZP_01697403.1|    VSEFRPHQREDKSLDILRERYAKGEITEEEFKKMKKDLMD----
ref|NP_111721.1|      HDGSIMSDENSRATEILKERYAKGEISEEEYRKKLDELK-----
dbj|BAB60367.1|       HDGSIMSDENSRATEILKERYAKGEISEEEYRKKLDELK-----
                         ::  :  *..*:*:***  **: :       *
```

FIG. 11

```
ref|ZP_01500882.1|    ------------------------------------------------------------
RAAC02306             MRGIWHFIHHWYLKIPYSPAEAHLFRHVWHMIPFWMPGFIALSIVPAG---YILMILLSV
gb|EAU91762.1|        -----HFVHHR---SPREDAVPLIFAHGWPGNFTERPGFSIARIARVY---HKLMVTLG-
ref|ZP_01076306.1|    --------------------------IWSMVPFLYVIMILVSIIQPS----FFLFVLINV
ref|YF_173223.1|      ------------------------FWG--FQTRAENVGLTLFWAG    WWPITILA-
ref|ZP_01035289.1|    --HLAHHREEYLTDPYDDPEANYLDPTVWARLPLWVRAVLRINNTLAGRMLIGPMVAQAI ref|ZP_01500882.1|    --------------------------------------AARFGFTFEGIFRQAVT
RAAC02306             LFSGFEWFKYEKALEVIKERGRKYSYYGLWLAYAIWAPLPWPRAATFGWTVVGWLTIRHF
gb|EAU91762.1|        -------YKHYVAQG-----------GDWGSFILRS------VAIQYPEAVVGLHIN---
ref|ZP_01076306.1|    MFG-WMGITWYMRTLTYKEKAREYVQAARAQGACLWR-----IILKHILPNTMVMIVTLA
ref|ZP_01076306.1|    --------FPFVGRLW-----------CAYCPFMIYG-------ELVQWVSLKLWPRSLL
ref|ZP_01035289.1|    FLRADWQAIKQGNRAVLHAWLWHIPAVALVLIWLSFASMPVWAYLLAVWLGLAVLKIRTF ref|ZP_01500882.1|    YKGRNRDTAWFSIVDSEWPA-LRAGFAE-WLD----------------------------
RAAC02306             WKKRRRRIAWMSTLDKADLA-LMPGWAE-WLERQQRIEAVLDRTLPWRRAKAKKASSK
gb|EAU91762.1|        FPAAPIPSPLKNPITLFWLA-IGWLTPE-EKKRINRIKW---------------------
ref|ZP_01076306.1|    PFGVVANISALTALDYLGLG-LMPPTPS-WGDLLQQGKSNMD------------------
ref|YF_173223.1|      PWPRAAAERWGGWFLFGLFA-LILLWEELWH--LEDVAWLS-------------------
ref|ZP_01035289.1|    LEHRAHERASGRTVVIEDRGPLAWIFLNNNLHVVHMIIPEVP----WYRLPALYAARR
                                       .    . :    .
```

FIG. 12

```
ref|YP_503850.1|        -KISKKNYDLVFKEAFSIFDNKSLAFLGID-LPPIISFLVTEIPEVETTDDMMDLNFRLE
ref|YP_517477.1|        --ISYHNNDILMKVLAEQFKNKTLDVFGIK-TAKIKDLIPSVHPAVEANETRNDIIFLLE
ref|YP_001568284.1|     ---------------------------IISVKPIDIPVINVSNQNPDFVFELE
ref|NP_783815.1|        -----------------------------DTKIIAPANTELKTIDIKTNFTDYTFYTE
ref|YP_149134.1|        --ISHHAKDILFKSLSALYQNQALDVYGLHGLFPRIKALLPNEFPSVRADERRADTVFLLE
RAAC02289               MRIARSGNDIVAKIILTNALPGEVLSVIGIII--DAHVVRALPTELFPTVEVRQEFTDIMLELA
                                                   :            :        *    :

ref|YP_503850.1|        DGSILHLEEEMNLSKRD-LIRFAHYDLRLFRYYD------APVETVVLTPADSSSGTKVL
ref|YP_517477.1|        DDTLLHLEFQTTAGEQD-LKRFLYYDARLVRRQE------RKVETIVIYSCRIEQARERL
ref|YP_001568284.1|     DNSLLHLEFQTTWKKAD-LLRFAQYDIALYQKER------RRINTVVMYSGKYESAESEL
ref|NP_783815.1|        NDDYLHFEFQTTNKEED-INRFLFYDASLFYKYG------KKVNTLVVYSSDIKKSKTKV
ref|YP_149134.1|        DDSILLLEYESNERFLDNHLKYLDYACRILHTYYQQEKRIRPIRIVVIYTSDVTTARERL
RAAC02289               DGRLLHLEFQTT-REPN-LYRFGTYDWAMAERYK------RPIRTVILYTRDVTEAPSEL
                        :.  *  *:*    :   : ::    *    :          :. ::  .  -  :

ref|YP_503850.1|        DIGSLQYNVLQIVLSDRDGDALLSQMRAALEKGEPVNE---LELIFLPLMKSKLTKIELI
ref|YP_517477.1|        ECGSILYQVENIYMKHYNGDQEYNRLKHKIDNHQLLSETDTLKLIFLPLMKSEQKEEELA
ref|YP_001568284.1|     DMGSNKYKVQQIFMIKYDGIKRYEEIKEKIEKEEELTDKDLMDLVFLPLMRNEKSEEEVT
ref|NP_783815.1|        DAGSLKYEIKAFYMSSLNGDEEYNNLKTKIDKGEDLTKEEILSLTFIPLMDSKEDKSTRT
ref|YP_149134.1|        DAGDVFLSSKAVLLGEFNGDAIFHAIEEKVHNGEPLTPEETMKLILVPLMHTRFDRQTMI
RAAC02289               DAGSMRYAVENVYLGHMDGDGALETVKRHLAAHEWTEEDRVRLAFAFHMRFERRTREEAF
                        : *.    .  :  :*     :.     :               . .   . :

ref|YP_503850.1|        RRTIDLEKELPEKDLRNKVRELTLILADKIVDQKILDELWEELRMFKVVKYAEEKGMEKG
ref|YP_517477.1|        IQAAELAKAAPDEKTKLFAIAALIVITDKIMSESNKRKLLEVLKMTQIEQWIREEGRQE-
ref|YP_001568284.1|     KDVFELAIKIPDEDKKEAVIGSLLGFSDNYVRDEYINELKEVIRMTKIGTSLFEEGVE--
ref|NP_783815.1|        IKSIELAEKMEENNTKLQCITLLYAFLEKFGDAKSKKKFKEVFSMTEIGRMIVEESIEKG
ref|YP_149134.1|        EKTIELAKAIGDEPKQLHIIAGVLTATDKFIDRSYAEKVKEWIKMNKVFRLLVEELEQEK
RAAC02289               GEIVEVVQRVPDVHEQNYLAALILGFSGRVMADEQKEQLRRVLEMTDLLRELERREFEEKG
                        ::    :      :                 .  :. .  : * .:      .: :

ref|YP_503850.1|        --------LEKGLEKGIKKGMEKGKKQERETVAKNMLSLGIEDELIIKATGLDQSIIDKL
ref|YP_517477.1|        -------------------GELKGRRDEKRETAQTMLNLGMSPELIAKATKLPLEEILEM
ref|YP_001568284.1|     --------------------ECEKELTIKILNKRFGRRLTEEIKDRIREADKKTIDYI
ref|NP_783815.1|        RAEGIKKGIEEGTKKGRFEGKTEGKSEILIKQLIKKF-KKVPEEYIQKIKTLSIDTIDII
ref|YP_149134.1|        --------------------EEMLKKVMQEKEQAVQRAIQEKEQAVQRVIQEKEQAVQRA
RAAC02289               ---------------IQKGLQQGLQQGELQKAREIAHRLLRKGASVQEVVEITCLSSKDVEEI
                                                    .                    :   .   .  :

ref|YP_503850.1|        KKSL-------
ref|YP_517477.1|        -----------
ref|YP_001568284.1|     GDNL-------
ref|NP_783815.1|        ALEIFDMEDIK
ref|YP_149134.1|        IQ---------
RAAC02289               RQNLH------
```

FIG. 13

```
ref|XP_001191064.1|     ................------------------------------------------
RAAC02307               MLGYEVIHMHPGVFFMHLRHMLPWWSPAIIAWYGTLFMWAREYPQRYYEDIPASDGSVEV
ref|YP_303751.1|        ---------------------------------EPGQFDEWK---------DLTQLDWMLLD
ref|ZP_01697132.1|      -----VVDMHGNEVMLPMIQVLDMWYPNNLSFLGKLTHWGHQVVKFLTEDPREANTEGGV
ref|ZP_01222568.1|      ---------------------------------YYN-----------HYYEEYIEDHKSGFE
ref|XP_001317319.1| ref|XP_001191064.1|     ----------------------------------------------------------GN
RAAC02307               FSRWFGMFFWALVMFYAMWFALPYPGVEILVDLCCIPVMLIVFGMLAIGWVVHLIDEFGS
ref|YP_303751.1|        -SFWIGMVFF----------------------------LLMF--------------VAY
ref|ZP_01697132.1|      FETHRTFFQFT----------------------------KALNAF----------YQN
ref|ZP_01222568.1|      FPAIFGTVFMVLLMS-----------------IIVTPLGVMAAIY-----------LHE
ref|XP_001317319.1|     VNFRWQFGSWG----------------------------KFSSY-----------PPL ref|XP_001191064.1|     YQ-RDSSVTQMQTCLEWESLERRRE----KSRLVMLYK-----------IYKGKVGLKQ
RAAC02307               YQ-ADEHLEKGLTCAEWEQFKRRREFRDFQLRVNAMYEAIEPERRKQRFIVFEGKRGKKR
ref|YP_303751.1|        YA-SGYGLSEIMIYPSIFSFG---------LVAFGMLG-----------MGPVTIAV
ref|ZP_01697132.1|      TR-SLWRLDHDPEGFEWIDPNNRRQ------SIIIFMR-----------RGKRK
ref|ZP_01222568.1|      YA-GKNGFTKLIR-VAVINLAGVPS------IVYGVFG-----------LGFFV
ref|XP_001317319.1|     FALVGAGTTTLIDMCVLSDLR---------ILFTIAN-----------FAYIL ref|XP_001191064.1|     ED--
RAAC02307               GDRA
ref|YP_303751.1|        DSYG
ref|ZP_01697132.1|      GD--
ref|ZP_01222568.1|      YMV-
ref|XP_001317319.1|     ----
```

FIG. 14

```
ref|YP_001662357.1|     -----LKLKKNKEEA-------------VKEE----PELFEK-VPTVVEVIS-SDGYLIE
ref|YP_001666189.1|     -----LKLKKNKEEA-------------VKEE----PELFEK-VPTVVEVIS-PDGYLIE
ref|NP_623664.1|        ------KKKKQKTEK-------------QKENNF-HDPFNH-VSDIKQIIA-SDGIYVD
ref|ZP_02755290.1|      ------KKKKKEKSTAKIIDF--------NKDDILNETNLLDKGIPSLKELIS-PSSFEVD
RAAC02309               MTLFARKKKKEKKRKRWSWLRAHLRRQKEKRVLAQDPSVIGEHAPTLHDLMTLADGIEMR
ref|YP_001181426.1|     -------------------------------------------EFAPDIYELIL-PDTFHEE
                                                                    .  . :::   ..

ref|YP_001662357.1|     KDYIRVG-KKFYRLYVLT-DFPQAVYVGWLEDIKLLG-NVDVSVHLTPVDARDAVNQLTR
ref|YP_001666189.1|     KDYIRVG-KKFYRLYVLT-DFPQAVYVGWLEDIKLLG-NVDVSVHLTPVDARDAVNQLTR
ref|NP_623664.1|        RNYMQIN-DKYVRIYYFT-DYPASVNIGWLEDLKLFS-NANISIHVYPETNANAVKRLTT
ref|ZP_02755290.1|      ADYIKIG-KKYVRSFIMQ-GFPAQVYVGWLDSIFNYEGETDTTIHIDPTDDKIALEEYTR
RAAC02309               ASEIYVSPSGYTKTYYVT-GLPSTVHFGYFQRFFRVGADVHISLHVEPADSAVAMAKRTK
ref|YP_001181426.1|     ADYIYLGAENYCRVYVLDIDYPSEMYVGFFDSLLDKG-EIAISVFIEPRDTGQAIRDITR
                         . :.. . : :.  . .  *  :.*::: :     :  ::.: *    *:    * ref|YP_001662357.1|     KITQYQSQYMLDDQRGNIYELGILRKAVEDLERLRESIQMNRDKLYYVTAVVSVSADSVE
ref|YP_001666189.1|     KITQYQSQYMLDDQRGNIYELGILRKAVEDLERLRESIQMNRDKLYYVTAVVSVSADSVE
ref|NP_623664.1|        KITQLQSQLMLDEEEGNIAELGILQRASESLEALRENIQMNRDKLFYVTIVIAVYGDSLA
ref|ZP_02755290.1|      KITQFEAQLMSEQEKGNIRNITRLRDKIQELYMERSKLERNTDKLFQVQIACNLYSDSLD
RAAC02309               LMTKIEAEILAEQKAGTNKQIAFLQQEYQLLEKEREELRLGRERIFYATIILAVSSPNRQ
ref|YP_001181426.1|     RINEMKSNAMLQRGE----PDYKLLAQIEWYDALRASLQRGIEKILMAQVFIVVYSKSLE
                         :.: :::  : :        *    :    * .:. .  ::   .    :  . .

ref|YP_001662357.1|     ELERSSKILEEVLAGKSIRARRMFLRQSEAFKSFVPILEN--HCEDLSRNFNSGAAASLF
ref|YP_001666189.1|     ELERSSKILEEVLAGKSIRARRMFLRQSEAFKSFVPILEN--HCEDLSRNFNSGAAASLF
ref|NP_623664.1|        ELEHNSKTLEEVLASKSIKARSAIFRQEQGFKSLVPTAEN--YLADSSRNFNVGAAISLF
ref|ZP_02755290.1|      ELNKETQKIDNKLRGRKMYMMPTYLRQDDTYKTVSPYGKS--YVEDMFRNFNSGALTSCF
RAAC02309               EFEAACERIEREGFEG-FLLREAFKEHDLGFRSVAPIGEN--ALRHP-IEMTASALANSF
ref|YP_001181426.1|     QLRENCIRITKFAESLGLNMRCLSFEQAKGYISCLPLGARNLKYIEKFRLMTTSATACLF
                         ::.        :  .     :    .:   ::    *         :  . *     * ref|YP_001662357.1|     PFASPEFSHKKGIPLGINLFTGSPVIFDNFIGPPFMTNYNLGIFATSGAGKSFLIKLLSM
ref|YP_001666189.1|     PFASPEFSHKKGIPLGINLFTGSPVIFDNFIGPPFMTNYNLGIFATSGAGKSFLIKLLSM
ref|NP_623664.1|        PFASPEYSHRQGIPVGINLFTGSPVIFDPFIGPPVLPNANIAVFAQAGAGKSFMMKLLAL
ref|ZP_02755290.1|      PFYNSDIRHEKGVFCGINLSTCSPILID-FYDRSKLKNSNITVIGQPGTGKTFFVSLLTM
RAAC02309               PFTNARFSHEYGVPIGVDWSSGHLNRYDAWHPK--LVNANGVIIGKAGAGKSFLVKGLVA
ref|YP_001181426.1|     PVGNTDITYEEGFYIGYNAITNSPVFYNQFDRS--LPNPHMAIFGTTGAGKSTTMKTMLG
                         *  . . .   :.  *. * :   :    :        :  *  :  .*:**:  :. .

ref|YP_001662357.1|     RGALLGIKTVFVDPDGEYSRMVQKMGGSVVKISTETENIINPFDVEEEEDENE----IRY
ref|YP_001666189.1|     RGALLGIKTVFVDPDGEYNRMVQKMGGSVVKISTETENIINPFDVEEEEDENE----IRY
ref|NP_623664.1|        RSALLGVRTVFIDPEGEYKPVVDRVGGVHIKLEPNCKHIINPFDIEVDVDDEG----IEF
ref|ZP_02755290.1|      RSALRGIRTVIIDPESEYGRLTEALGGSRIYLATDSKECINPFDIE-EEDELD----ENF
RAAC02309               RSAAMGIRHVIVDYEGEYTPMVQALGGVVIRLDEHSPYKFNPPFELEEEEEKQADGTIRRF
ref|YP_001181426.1|     RMAAYGYNICVLDPEREYEKIINKLGGKYIRIRPGEKLGINPFDVEIEEEEGK-----RF
                         *  *  *  .  :* :*   *:     : :  :**      :****::*   :.    .:

ref|YP_001662357.1|     VDIVQKIAEIKALVG--MIVEGVMKDKISAEELAAVEEAVRDEYE-ARGINKSPESLYEK
ref|YP_001666189.1|     VDIVQKIAEIKALVG--MIVEGVMKDKISAEELAAVEEAVRDEYE-ARGINKSPESLYEK
ref|NP_623664.1|        IDLLQKANEIKGLVS--MIIEKISKTPLTAYELSLIEETILEEYR-ARGITRNPESLYEQ
ref|ZP_02755290.1|      LPTGIKLVDVKGKIADLLNLIAVMAGGLSGAQTSTVAQLLQELYE-SFGITKNPKSLYVT
RAAC02309               VDVKEKISDMERLIVS-MAHLHAGHDLLDSYTRNAINDMLQELYERDFGFTSDPESLYER
ref|YP_001181426.1|     IDLNSKVADIRFILN--IISEYYVGRRLDGVQMAIIERIVRKLYY-DKGITSDPESLYTS
                         :   *   ::. :     :            :.       :  .  * *:..*:*** ref|YP_001662357.1|     N---IADSEEFYFK--KKKEMPTLSSFVERLKKNPRGER------IAAVMKPFLKGGTLG
ref|YP_001666189.1|     N---IADSEEFYFK--KKKEMPTLSSFVERLKKNPRGER------IAAVMKPFLKGGTLG
ref|NP_623664.1|        S---TQEIDGKYYIGTRQKQMPTLSSFTKRLSEKPGGEK------LAQILKPYLKGGTMG
ref|ZP_02755290.1|      EP-YFDKNTKEFIHEGRKKTMPIFSDFYNSLSEYAEKNSDIEVMDLVRVLKMFKKGGVYD
RAAC02309               HETWQRDAKGDRLVRRVKRPQPRFSDFYVKLEERAASDS--RLEELAMRLRRFREGGTEG
ref|YP_001181426.1|     AR---TDEKGRLIVGKIKKELPTLSELREELFKESETQA------LAKAMEVFVGEGSLS
                         .         ::      ::  * :*.:      *  .         :. .:   *  .
``` continued →

FIG. 14 continued

```
ref|YP_001662357.1|    IFDGQT--NVS-LEDSYLVNFDVSEIRDR-FLRTYAMYVITNWIWEKFVKKDVK-QKKRV
ref|YP_001666189.1|    IFDGQT--NVS-LEDSYLVNFDVSEIRDR-FLRTYAMYVITNWIWEKFVKKDVK-QKKRV
ref|NP_623664.1|       LFDGQS--NVD-LKDALLISFDVSGIMDE-FLKTYALYVVTNWVWEKFVKKNIK-QKKFV
ref|ZP_02755290.1|     LFDCYTSSNISNFKNSPIVTFDVSKLEEN-ILRPIGMYVALSWTWEKFGKKDPY-INKRI
RAAC02309              MFDCYS---NVELQDVPVVSFDLSHLPEKSMARLLGMQVVLEWIMEKFIKKNVH-LKKRV
ref|YP_001181426.1|    LFDCQT----TIDADDKIIAFDLKEFERDNFLKFFASVNILSWIWNKFSNAKLKGQKKVV
                       :**  :         : ::**:. :     : :       .* :** : .    :* :

ref|YP_001662357.1|    VVDEAWMFMKY-----KDTAYFLENLSRRARKRNTSLTVASQSFIEFSNSQEGKAVLTNS
ref|YP_001666189.1|    VVDEAWMFMKY-----KDTAYFLENLSRRARKRNTSLTVASQSFIEFSNSQEGKAVLTNS
ref|NP_623664.1|       IVDEAWMFMKY-----EHTANFLENLARRARKRNTSLTIASQSFMEFANSQQGRAVLTNA
ref|ZP_02755290.1|     VCDEAWMLVSKNMAGSEYSAKFLETASRRIRKRMGGLLVASQKFTEFVESTQGQAVLTSA
RAAC02309              VIDEAQKMLEH-----LYHAIFMEDVFRRIRKRSGSAVAASQDFRKFAESEQGRAILQNS
ref|YP_001181426.1|    IFDEAWMFTRY-----QASAEYLEFISRKGRKYKISLMIASQTLLEFLQNDTGRAIINMC
                       : ***            *  ::*   *: **    .  *** : :* :.  *:*::  .

ref|YP_001662357.1|    AAVFLMKQAATDIDSVQEVFHLSQGERDFLTSCGVGEALFLVG-----------------
ref|YP_001666189.1|    AAVFLMKQAATDIDSVQEVFHLSQGERDFLTSCGVGEALFLVG-----------------
ref|NP_623664.1|       ATVFLLRQSPTDIDAVQEVFHLSKGEREFLLSSGIGEA----------------------
ref|ZP_02755290.1|     ETKIFLGQDTTDIDSIQNMFKLSEGEKLFLLRADKGEMLVRIQGESTVVKVLAFDFEKKL
RAAC02309              DTKILLRQDKLDKEAVIENFGLEEHEFEELIAFRDGQARWWVGGEVFYNQLIPFADEFEL
ref|YP_001181426.1|    ASKILMRQESDMAAQIAEFFRLSERTVEIITSAAQGQGIIINPREKIFIQVTPFDFEWEY
                       :  ::: *       :  : * *.:      :      *:

ref|YP_001662357.1|    --------------------
ref|YP_001666189.1|    --------------------
ref|NP_623664.1|       --------------------
ref|ZP_02755290.1|     IEKR----------------
RAAC02309              FTTRFVQSDAELAMQRRWLA
ref|YP_001181426.1|    VTT-----------------
```

FIG. 15

```
ref|ZP_00874806.1|              ----------------------------------KAQKQEIKPSTVNTLAY
gb|ABV55445.1|                  ----------------------------------KTQKQEISPSTVNTLAY
ref|NP_735797.1|                ------------------LNLMKPKTSSKQKKEKTKKREVLPTTLNTLAY
gb|AAG38042.1|AF295925_7        -----------------------------------KEEVLPSTANTLSY
RAAC02310                       MGSAVKFIVLGAALAVMLVTLTLRDQRKQQGQGRRSKRKVTPSLQEFLPI
ref|XP_001247966.1|             -------------------------------------------------- ref|ZP_00874806.1|              QGLFQNGLMQVSPSYFSQTYLLGDVNYQTVGLDDKGAIVEKYSDLINSLD
gb|ABV55445.1|                  QGLFQNGLMQVSPSYFSQTYLLGDVNYQTVGLDDKGAIVEKYSDLINSLD
ref|NP_735797.1|                QGLFPNGLMQVSPDYFSQSYLLGDVNYQTVGLEEKEAIVEKYSNLINSLD
gb|AAG38042.1|AF295925_7        QALYQNGLMQVKEDYFSQSYLLGDVNYQTVGLEDKGAIIEKYSDLIKSLD
RAAC02310                       EGFHESGAVIVN-GRFRRLIRVGDLNLYAMSMDEIVAVRERFKAMLMRLD
ref|XP_001247966.1|             --------------QVRRAVVTAFMKHAQRQLEEGVSAGEAIKQLLT---
                                              .  :  .::    :::   :   *    .  ::

ref|ZP_00874806.1|              DKTNFQLTIFNQKVNLEKFRKSILYPLQE-------DGFDAYRDELNRMM
gb|ABV55445.1|                  DKTNFQLTIFNQKVNLEKFRKSILYPLQE-------DGFDTYRDELNRMM
ref|NP_735797.1|                DKTNFQLTIFNKKVNLEQFRKSVLYPLQE-------DGFDSYREELNRMM
gb|AAG38042.1|AF295925_7        DQTNFQLTIFNKRLNLEKFRHSVLYEEKE-------DGYDSYRKELNRMM
RAAC02310                       NP--FQISVQARRANYTDFVAYAESTIDESVKVYDNPAFTAYAEDLKTYL
ref|XP_001247966.1|             ------------------------------------------KYKEMLARIV
                                                                           *  .  *   :

ref|ZP_00874806.1|              DANLEAGENNFSAVKFLSFGKSD--CTPKLAFRSLSQIGEYFKSGFSEID
gb|ABV55445.1|                  DANLEAGENNFSAVKFLSFGKSD--CTPKLAFRSLSQIGEYFKSGFSEID
ref|NP_735797.1|                DSNLEAGENNFSAVKLISFGKSD--CAPKLAYRSLSQIGEYFKSGLSEIE
gb|AAG38042.1|AF295925_7        NQNLDSGENNFSAVKLISFGRKD--SNPKQAYRSLSQIGEYFKSGFSEID
RAAC02310                       REEAMKPRTDRENLIVIGVLPKVGGEDEKLQLERLAREQSFVESGLSAMG
ref|XP_001247966.1|             FDRETDEKPDQVDLLLL-------FCQDLVERSKGGTILLFVAKELYDLE
                                       . :     : .:    .      .      :. . :   :

ref|ZP_00874806.1|              VSLGLLGGEERVNVLADMLRGENHLPFSYKD--------------------
gb|ABV55445.1|                  VSLGLLGGEERVNVLADMLRGENHLPFSYKD--------------------
ref|NP_735797.1|                ASFTLLTGEERVNNLADMLRGENHLPFTYKDLV------------------
gb|AAG38042.1|AF295925_7        ARFESLAGEERVNLLADMLRGEHHLPFSYRDLTR-----------------
RAAC02310                       LPYEVLEPVQVVEAVQNFWNRERAVSQRYRDAVRRRTHAPRVDGLDVEVS
ref|XP_001247966.1|             IVED--------EAFEQWWDNERSTATEALKKVRQQT-QPFIDWMMTEES
                                  :  .:       *.      .

ref|ZP_00874806.1|              ----------------
gb|ABV55445.1|                  ----------------
ref|NP_735797.1|                -------------
gb|AAG38042.1|AF295925_7        -------------
RAAC02310                       DLVRTQEEEGKEA
ref|XP_001247966.1|             DEEESDEESGEE-
```

FIG. 16

```
ref|YP_001205829.1|    --------LPIVEGVTTVFGVRTPRNEYFTAVICKVA--IGLLWFLVNRTRRGKAVMAAS
ref|YP_001240062.1|    --------LPIVEGVTTVFGVRTPRNEYFTAVICKVA--TGLLWFLVNRTRRGKSVMAAS
RAAC02311              -MLEVHSPIPMTEGETLVFGIRTKHIAHFSIGVCLTAPMAALAWFLLPLLHEPKLLVLFL
ref|YP_359336.1|       -VLPFYVSIPVLESLRLLFGGIGALAGFLFPVISGGL--ISAP-VSVPLWHTPLLPVLFL
ref|YP_001451893.1|    ---------------ILIGVLAGYALSFAMGVVDTAPIAEAHWFALPTFYTPR----FE
ref|YP_466026.1|       APILFSGGRPLAADLSDAVGRFG--LAPLVAAAGAAA--LRARWRAAPE-RRPEVLLLAT
                                         . *                   :

ref|YP_001205829.1|    MNPRGVTLLGIELSS------IYLTVW---------------------------------
ref|YP_001240062.1|    MNPRGVTLLGIELSS------IYLTVW---------------------------------
RAAC02311              WGGAGVVFAKVPVAN------RPLAEWLWLSFRYARRPKLILYDREFRIRVHRKRAAERWG
ref|YP_359336.1|       INSFGVAFAAIPALF------APGSEILAFIFNLA-------------------------
ref|YP_001451893.1|    WFA---ILTILPAAL------VVIAE----------------------------------
ref|YP_466026.1|       WGGLAFALALARNRFDVYAAAPLAVWCWLGLRHVQASRL---------------------
                                :                  :

ref|YP_001205829.1|    --
ref|YP_001240062.1|    --
RAAC02311              AR
ref|YP_359336.1|       --
ref|YP_001451893.1|    --
ref|YP_466026.1|       --
```

FIG. 17

```
ref|ZP_02850831.1|     --------------------------------LSGFLADVSYS--LSFVLNG------
RAAC02312              MSMKRWITQVGKSLYAGSVVLASTAMSAEASTSGITNPLSSSSSS--VSSVLNQAL----
ref|NP_279998.1|       ---------------------------ATIGGIATTLGFSSQT--MAAILGGVFSLQ-
ref|XP_001637270.1|    ------------------------------------------VGVLLGTALN---
ref|YP_001506532.1|    ---------QLGSSLLLNTIVLVLVTAPAGAASTPLAVARRALARESLIALVLALALRPVG
ref|ZP_02248080.1|     ----------GKLETIGSAMVAQNAAAAAPTTTGVIPAAADEISV--LQAPLFTAYG---
                                                                         :    * ref|ZP_02850831.1|     -----VTSGVFAL---FFLFY-LQR--VGTGSGDIISAELMRKKQAAGGASLWLLVTDVRLY
RAAC02312              --GWLDDAIFAVAGALFLFH-LYKAIIGLMAGSHHAQ---RREEAKSHLVWVAISGVMLG
ref|NP_279998.1|       -SAWLTYGIFAAIGAVFLVD-VWL---GLRSG--------IRNAARATMLLIGVAMAVL-
ref|XP_001637270.1|    ----LTDWIFAVSGGMFLFVSIAETMPELFASAAH-----QREESRGKVLLAQNAGLLAG
ref|YP_001506532.1|    FPAWLDEALASIGATLTPLA-LFS--VGLQLRLPAVR-RWRRELALGLVVKLAVAPVVVL
ref|ZP_02248080.1|     ---TLYQQVSAEAAAVYDLT-VKT--LGVSAGTYA-----ATEAANSSAAALPLSGI---
                               :    :      .   .  :                      : :   .       :

ref|ZP_02850831.1|     LFMALGGMLINLGNS-
RAAC02312              GGAILAGALYNLGKSF
ref|NP_279998.1|       ----VVVG--------
ref|XP_001637270.1|    -----FGTMLTLAAF-
ref|YP_001506532.1|    GCYALAGAL-------
ref|ZP_02248080.1|     ----------------
```

FIG. 18

```
ref|YP_245669.1|    ------------------------------------------------------------
RAAC02313           MRQSSNAPDSVRGESWPKVGAICSFPSCTLVPSRPVQARGGEGMAGSTASNVTQTITQLG
ref|ZP_02369868.1|  --RGALAARIGAAFDLPTLGRTLVVCAPAIALYG-ATGDARWLLASIATIAIAIAVERVG
ref|YP_438666.1|    --RGALAARIGAAFDLPTLGRTLVVCAPTIALYG-ATGDARWLLASIATIAIAIAVERVG
ref|NP_695275.1|    ---------------------------------------------------------VSVLG
emb|CAB06069.2|     ------------------------------------------------------------ ref|YP_245669.1|    ----------AVLVLFFGGFGTAIDVDGADQIIILGWGAVFSSILGIIGSVVVKSKSG--
RAAC02313           FAP---VNPWALLNRVTSGFGHLIEVVFAWVYFLSEIGVLAGALVWLVGSIGSHARIK--
ref|ZP_02369868.1|  IAP---LGALAQGAAIIAGFLSLSCALNAWPAFVAGCAALAAAAVALSRFGARLRSLGNF
ref|YP_438666.1|    IAP---LGALAQGAAIIAGFLSLSCALNAWPAFVAGCAALAAAAVALSRFGARLRSLGNF
ref|NP_695275.1|    FVPHMFANPWGSLMAVLVALFLSVPAAFIYRKIRTRKGAAIGILVGAVLAIVVALVSN--
emb|CAB06069.2|     SLP----STWR-IPSTCSEHSEGSDCSTNSNVTMSLLKLLDCFFRPFLPREGLKKIPS-- ref|YP_245669.1|    --IGGAFMLIAAIIGFLCI------FAIYILPGALLAI------
RAAC02313           --RTGAHITLYAIVGFL---------AAVILPGVILAIDSTFQR
ref|ZP_02369868.1|  VFIPSLYLTCEAAAAHLSAPRLVPYLCAAMLPPIALSCIATLR-
ref|YP_438666.1|    VFIPSLYLTCEAAAAHLSAPRLVPYLCAAMLPPIALSCIATLR-
ref|NP_695275.1|    ----LIVTPIYAHMTYQAV-------AAMILP-ILLP-------
emb|CAB06069.2|     -------EKLSHIPELI---------EPWFIFSLVWSVGATGDH
                                          ::      .
```

FIG. 19

```
ref|ZP_01058859.1|    ------------------------IGEDILPENVDFEVIDGFTKVTDKDAAIYTRRL
RAAC02314             MERVEYVDRVKHVWSEYRTNDEELAFALGIDEEAESVDVSTKDGITNVT-----VFTTEA
ref|YP_754274.1|      ---------------------LSPNRWQHSLQVAET-ALQMAG---QYELELEQ
ref|XP_503244.1|      ---------------------NLTANVEIDGKQYNTFTEPPKALAGER--AKVKFPIKD
ref|NP_218466.1|      ----------------------DLIVRLAKLKHVNPQVLQVMS----DSLHKKF
ref|NP_126488.1|      ---------------ARKILEVLIDSDVNVYINDVVASEVIFIYLKLTTGKSYLTLKK
                                             .        :           .

ref|ZP_01058859.1|    AKEEGFFLGNSAGAAIKGLLQLKQHFK---------------------------
RAAC02314             VYHFGTFRADYVGHASRALVQLLQHFRVNLPIDFIVAHQTFHVYLKGGKVVAGEKEYPIA
ref|YP_754274.1|      VYLTALLHDYAKGLSGQELLRLAEENNL----IEDEVDREVPDLLH--------------
ref|XP_503244.1|      MTEFLHGGEENVTMIERLMTELERDPVLNVSGDYDMPKEQLRETAVARIAALSGHWKKDT
ref|NP_218466.1|      AALHLSQRRDLDGHA--VLAAILKKMER------ATEHSILHALAEKN-----------
ref|NP_126488.1|      NPVIVRSVDKTSVYELLGMFKFLETNEFVFSIAKRLIDK-YGLLPNDALILATAIFY---
                             :  :  .

ref|ZP_01058859.1|    --------------------------------------------------
RAAC02314             ERSEGYELVEFVEWMIASSVLDVVLRLAEEYEVTPEQIVESAVGTFYALLSVAEENDVEP
ref|YP_754274.1|      --------------------------------------------------
ref|XP_503244.1|      EKEALL------------------------------------------------------
ref|NP_218466.1|      --------------------------------------------------
ref|NP_126488.1|      -------------------------------------------------- ref|ZP_01058859.1|    ---------------------------
RAAC02314             ETVISMLTELMHRHAEHTNEHELSTLNR
ref|YP_754274.1|      ---------------------------
ref|XP_503244.1|      ---------------------------
ref|NP_218466.1|      ---------------------------
ref|NP_126488.1|      ---------------------------
```

FIG. 20

```
ref|ZP_02854145.1|    ---MGTTISFGIQKGGVGKTTTTAITSYILSKE-HKTLAVDFDSQGNLTRFLTQQNIYNF
RAAC02315             MERVGCTISVGLQKGGVGKSTTTALTSYILAEQGHRVLAVDFDSQGNLTQLLTQRSPYDF
ref|YP_145847.1|      ------TITMGIQKGGCCKSTTTGVLAYLLSRDGYRVLAVDMDSQGNLTELLSRKPSNEF
ref|YP_799230.1|      -MGKIVSISNQKGGVCKTTTSINLAANLASIGKKVLIIDMDPQGNSGSGLGIEINTLV
ref|NP_714527.1|      --QMGKIVSISNQKGGVGKTTTSINLAANLASIEKKVLIIDMDPQGNSGSGLGLEIHKEN
ref|YP_536482.1|      ---MGTVIAIANQKGGVKTTTSVNLGACLARAGQKVLLIDTDAQGNATSGIGVRKHNIE
                         ::.. ****  **:**:     .  *:  ::.* :* *.***      :  .

ref|ZP_02854145.1|    TEKTVLEAVKAKDPRPYIYKISDNLHILPAEDFLATFSRFLYQ---------EYQG-NKA
RAAC02315             VHRTSLEACKERDPRPYIHAISDNLHLLPAEDFLSQFDKWTYT---------EVHVSQQM
ref|YP_145847.1|      TEKSVLEAMQERDPEPYIVKVNDRLDLLPANNFLATFPRWIYTGETYLGKYIRYKG-KPT
ref|YP_799230.1|      KTSYELLLGESSTNECIQRTNVSNLHIIPSNINLSGAEADLLVED-----------QRE
ref|NP_714527.1|      KTSYELLLGEASVNECIQRTNVSNLHIIPSNINLSGAEADLLAED-----------QRE
ref|YP_536482.1|      NDVYDVIVSELPIREAIMPTYIDNLDVVPATIQLAGAEIELTAQM-----------ARE
                         :       :     .    ..*.::*:   *:        :

ref|ZP_02854145.1|    LLLKETLDVVREQYNYITIDLPPHLGDQTINGLSASDYAVVLLQSEPFALDALDRYLEVL
RAAC02315             VILKNTLDVVKSDYDYILIDLPPNLGGLTLNGVCASDYCVVVCQSEPFAYDALDRYMEIL
ref|YP_145847.1|      LILDDTLDKIRHRYDFIVIDTPPSLSEQTTNALCASQYVTMMFECSNWCYSAVPNFMESV
ref|YP_799230.1|      YRLKNAVSELRSEYDYILIDCPPSLGILTINALCAADSVMITLQTEYFALEGLTQLMKII
ref|NP_714527.1|      YRLKNAISDLRTEYDYTLIDCPPSLGILTINALCAADSVMITLQTEYFALEGLTQLMKII
ref|YP_536482.1|      KKLYDAVQDVKEEYDFILIDCPPSLGLLTINAFTASDSILIPVQSEYYALEGLSQIMNTI
                       *  :::.  ::   *::*  ** **  *.   * *..  *::   ::    :  :.  ..:  .::  :

ref|ZP_02854145.1|    MGVQKKANSNMKLIGILSTMLDSRAAIDSFIINKARKDYEDVVFETIIRRRNRIKEFSLF
RAAC02315             QAAQQRVNPNLRIAGILISLLDARTAIGNYITERIREEYQDFVFDTVIRRKSRIIEFSVE
ref|YP_145847.1|      EGARVHGRHNTRLLGILRTMNDVRRNDAKAFNEMIEEDYPNEVFKTIITRKAPIGRLSLY
ref|YP_799230.1|      SLVQNQLNPSLELEGVLLTMFDKRTNLANQVAEDVKSYFKDKVYTTIIPRNVKLSE----
ref|NP_714527.1|      SLVQNQLNPSLELEGVLLTMFDKRTNLANQVAEDVKSYFKDKVYTTIIPRNVKLSE----
ref|YP_536482.1|      QLVQKHFNPDLQIEGVLMTMLDARTNLGNQVVEEVKKFFKEKVYKTVIPRNVRLSEAPSH
                       .:  :   .  .:  *:* ::  * * .      . :  ..  :  *: *.  :  .

ref|ZP_02854145.1|    GIEERT-KVDREALKYYKNFTKELISRVQK
RAAC02315             GIKIQT-KADREAIAMYESFVEELKARVSK
ref|YP_145847.1|      GFEENN-ELN-QALFQYENFYKEMMYERV--
ref|YP_799230.1|      ------------------------------
ref|NP_714527.1|      ------------------------------
ref|YP_536482.1|      GMSIIDYDPRSRGAEEYEALAKEV------
```

FIG. 21

```
ref|XP_624126.2|        --------------------------------LSQPHTTIP------------------A
RAAC02316               -------------------MSAADKKKRFESLMPSRTETPPHKSEVIDTLMGQTYDADD
ref|ZP_01893908.1|      -------------------------------PFMEEDTTP-------------------
ref|XP_001444409.1|     -------------------------------LGISKTATE-------------------
ref|ZP_02180762.1|      -------------------------------TYDQEGAVY-------------------
ref|ZP_02077766.1|      LGSTQKEQKYEMEDYTESVQKQAEAADELAKSLNDAEEAAKNSYADKIGDIGTVEKYLQK ref|XP_624126.2|        LHPPNVPLVSS-----SHTTSPAVASLGVTPAAPSNGATTTSYP-PSIPMAAYP-----Q
RAAC02316               IGTPKTRMESLHKESVSHTSEVVYPPMSNTTTTDDNGTTDNSFD-IAARIRAFEE--QRR
ref|ZP_01893908.1|      -DTSSTSDDSS------DDDDDDDDSEEETESGPDPEETRLRFELLKEKLDAAD-----A
ref|XP_001444409.1|     ---EQIKEAYA------QKAQKLYPNVTTSVAIND-VQAQQGFQDVAEAFAVLS---QIQ
ref|ZP_02180762.1|      -----THVAKD------HQKKAMKFIQDQLFTTPTWMLDEDIFN----KIESAG-----S
ref|ZP_02077766.1|      LREMSGETGYVDN---VNLAKMYVEEINSLLPETVQLTADGRVEWLKNTDAIYQEIAALK ref|XP_624126.2|        TQPSYPPLYTPYTAL---------------------------------------------
RAAC02316               SRPSYDELYTKHTFLIRKDLMERLERASARHSRGFKTRFINELLEAGLTQLEIED
ref|ZP_01893908.1|      SLAKHGRGHKKTQEALN-EL----------------------------------------
ref|XP_001444409.1|     SRNAYDLLNKEQPELLYGEEMERYKQSFQRNDDG--------------------------
ref|ZP_02180762.1|      IERVRGMQTRTLNNMLDFGRMQRMLEN---------------------------------
ref|ZP_02077766.1|      EEARVKAYQELYTQAVRDEIKARTDLTMTTEELNKKVQRLNELKADGISEDEIEE
```

FIG. 22

```
emb|CAJ50746.1|        ------------------------------------AADLAQDTFVRVLRHRRELPGV
gb|AAM28266.1|         ------------------------------------AADLAQDTFVRVLRHRRELPGV
RAAC02290              MTSGMRRFTNSSRTAEEVTGMEGHYTYALMGPTSEHTVACDLAPDTFVEVLRGAMEAIGV
ref|XP_816394.1|       --RGAN-LSNEERTNETIVR----------------QYETALENIIGTLQDRLTILRE
ref|XP_001585185.1     -YIEMSAFGRESHPRVQALR----------------HDRDRSPFDPNATDPEVIEHLKT
gb|EAU92316.1|         ---THSAFGPTVSFEE--------------------AQRIERETAEHLLKSRKLSLIV emb|CAJ50746.1|        RE----PRAYLVTIAGRLLLNHYRRRS---LERAYEEALAVMPLESAPSPEQRLL-----
gb|AAM28266.1|         RE----PRAYLVTIAGRLLLNHYRRRS---LERAYEEALAVMPLESAPSPEQRLL-----
RAAC02290              RLDELVLRIYVQEGAGGWQLVHGRVKD---AREAQQTCLLPMPPE-PPSGDPEVLDDATY
ref|XP_816394.1|       EYAS-FLKVSEEETANEKEVLNEHEQDSQRVRQTFRTAALTLQRVFWSTREKEVPEVISE
ref|XP_001585185.1|    QLKDADDLMDLIVARYRVLENENGEPNTERVEVAERRLEECMDLVDGPLGQKEAFDN---
gb|EAU92316.1|         DLDQTIVHATVDPTVGEWIAEGEAWEAR--QERRNKVKTTTPDSCDSDSSDDSDDEDDE
                                                   .   .              :

emb|CAJ50746.1|        ------------------------------------------------------------
gb|AAM28266.1|         ------------------------------------------------------------
RAAC02290              QDICYAALNLYRVLWQSRQRIKASSLKTKVRVRQSLRALDERMRLVEQAVEGTEWWDLFR
ref|XP_816394.1|       LDN----------------AAAAAEKSRAAVKVTLALLDSRLQSFSEQKE-------WM
ref|XP_001585185.1|    -------------------LKALLSESREALKVKMNEWNEKDKERDWAVES------LE
gb|EAU92316.1|         CNPNWEALKDVKKFTLGPESFNAPSVKGRSKGKHRMVEQEGCMYYIKPRPG--------W emb|CAJ50746.1|        ------------------------------------------------------------
gb|AAM28266.1|         ------------------------------------------------------------
RAAC02290              LRYQQGKKLVACAMELHMSSRTLNRQISDMAGHVGRMLSTVLKERELAELMQAAKRVPMM
ref|XP_816394.1|       ETHQQSLEDLLVSLR-QLNKRAFERQLSLMNERVARPSST-------------------
ref|XP_001585185.1|    KLLKESEEREAALAGLLHATQEDMRREGKRAAKVAEIEEK-------------------
gb|EAU92316.1|         KEFLENAAKKYEMHVYTMGTRAYAQEVCAAIDPDGKLFGSRLLSRDESGSLTQKSLQRLF emb|CAJ50746.1|        ------------------
gb|AAM28266.1|         ------------------
RAAC02290              PGKATARVIRLEQRELWS
ref|XP_816394.1|       ------------------
ref|XP_001585185.1|    ------------------
gb|EAU92316.1|         PCDTSMVVIDDRADVW-
```

FIG. 23

```
ref|YP_001210712.1|   ------------------------------------------------------
ref|ZP_01593342.1|    ------------------------------------------------------
RAAC02317             MWFKYTQKQQTTQPCAGFSSLRTMGRFPSRRKVFFRPPLQGGTKMAYTPAKVRKGWSENW
ref|ZP_02727046.1|    ---------------------------------------------------------KEW
ref|ZP_02758954.1|    -----------------------------------------------------------W
ref|ZP_00235902.1|    -----------------------------------------------------------F ref|YP_001210712.1|   ----DAIFERHDLTTLQKLVYIYFCRRANNNG-QSTPSYDDIAKDCGCHRSSAIEAVNTL
ref|ZP_01593342.1|    ----PNATSRSTELSSTAKLVFGKLCQYAGQNG-QAYPSYKTLACDVGVERRQAIRAVKEL
RAAC02317             FRCPNSIYDIDYISGYAKAVYIFLCRCADGEG-QSFPGYNAIAKAIGFGRTRTIEAIKEL
ref|ZP_02727046.1|    FWLENDLVDREDLGIYEKMIYIVLARYSDNES-CCFPSYKTIALKCGCSERQAKSVVKIL
ref|ZP_02758954.1|    FWLENDLVDREDLGIYEKMIYIVLARYSDNES-CCFPSYKTIALKCGCSERQAKSVVKIL
ref|ZP_00235902.1|    FMIDNEVIDNGELDVYAFKTYAVIVRYANKKTKSAFPSLNTLAKRVGCGKKKVIECIKIL
                       :  :       :    : ::  :  .  *. . :*   *  .  .     :: * ref|YP_001210712.1|   GKMG-LVVKHRRKRHNGSDTSNMYVVFPP-------------------------------
ref|ZP_01593342.1|    VDYG-LIKPVGRKKGDGGFTSNIYAFLWHQTFSDDGLTDPG----DKNDTRGGVTNVTTP
RAAC02317             EQAGLLVKEHRRNEETGEYYSNLYTVIHPDDVAFRGGMSPHGIPMSRDDTPLSPDDIPMS
ref|ZP_02727046.1|    ENKGLIKKENRIKSNSNEKESNIYFVL---------------------------------
ref|ZP_02758954.1|    ENKGLIKKENRIKSNSNEKESNIYFVL---------------------------------
ref|ZP_00235902.1|    VEKGYVSKTLR-KDNKGDHLSNLYHLLPTSNISKKQG-----------------------
                       . * :       :   . **:* .:

ref|YP_001210712.1|   ------------------------------------------------------------
ref|ZP_01593342.1|    QCHKREHLVS------DMSP---KENHTRESNSETTTTEEIRLLLSGTPLSKISEKEVRI
RAAC02317             PHDRRVSPGGREVRSIDQDPPTKIYIHTRSQAAATLATSNNEHLTSNTALEEVCETVNEA
ref|ZP_02727046.1|    ------------------------------------------------------------
ref|ZP_02758954.1|    ------------------------------------------------------------
ref|ZP_00235902.1|    ------------------------------------------------------------ ref|YP_001210712.1|   ------------------------------------------------------------
ref|ZP_01593342.1|    LIKR---------HGNERVMQAADIAAEKWRRERKEIKNPGGYLQTFCVNLVV-------
RAAC02317             LVQLGIRAQKKTLLHWLQIATPEEIIEAASLATREGVKSPAGYIGTVLRNGLVRVEKSTA
ref|ZP_02727046.1|    ------------------------------------------------------------
ref|ZP_02758954.1|    ------------------------------------------------------------
ref|ZP_00235902.1|    ------------------------------------------------------------ ref|YP_001210712.1|   -----------------
ref|ZP_01593342.1|    -----------------
RAAC02317             KHKDPRYNEFYKLFP
ref|ZP_02727046.1|    -----------------
ref|ZP_02758954.1|    -----------------
ref|ZP_00235902.1|    -----------------
```

FIG. 24

```
ref|ZP_02171383.1|        -----------VYLARGSTDLRKSIDGLAAIVQEGFELDPFSSSLFVFCNRYRDKIKILY
RAAC02319                 MLAFDWTSDHRVYLACGATDMRKSIDGLAALVQASFQLDPFSPCLFVFCNRQRDKLKILH
ref|YP_431168.1|          -----------RVYLACGATDLRKSIDGLAVLVKEGFELDPFSSCLFVFCNRNRDKLKILH
ref|YP_001212944.1        -----------RVYLALGATDLRKSIDGLAVLVKEGFELDPFSSCLFVFCNRKCDKLKILH
ref|YP_754944.1|          -------SNRQVYLACGSTDLRKSIDGLAVLVKEAFELNPFSPCLFVFCNRQRNKLKILQ
ref|YP_754864.1|          -------SNRLVYLACGSTDLRKSIDGLAVLVKESFHLDPFSPCLFVFCNRKRDKLKILQ
                                      ****  *::******..:*:   .*.*:*..*****   :*:*** ref|ZP_02171383.1|        WDHNGFWLYYRRLEKGRFPWPTSGSDEPMIITERQLRWLLDGLPLDQKGAHR--------
RAAC02319                 WSHNGFWLYYRRLERGRFDWPETGDAKTMVITRRELNWLLDGLPLEQPRAHRAVYVRSAI
ref|YP_431168.1|          WEHNGFWLYYRRLEKGKFVWPQDTTSSTITITRRELRWLLDGLPLKQPQAHPEVKARTIL
ref|YP_001212944.1|       WDHNGFWLHYRRLEKGKFHWPADAGSPTLVISRRELRWLLDGLSLKQPKAHPEVKARTIL
ref|YP_754944.1|          WDHNGFWLYYRRLERGKFEWPA-ADSQVVSISYREFRWLLDGLSLKQKQAHKAVKERTII
ref|YP_754864.1|          WEHNGFWLHYRRLERGKFDWPT-AHTDVVSISYREFRWLLDGLSLKQNQAHKAVKQR---
                          *.******:*****:*:* **       : *: *::.******.*.*    **
```

FIG. 25

```
ref|ZP_01287154.1|    ---------------------------RSKRRFWAAHVAAWEKSGLTQTAYCREHG-LSR
ref|ZP_01287577.1|    ---------------------------RSKRRFWAAHVAAWEKSGLTQTAYCREHG-LSR
ref|YP_754945.1|      --------------------------MSSNERKAWWEERLAEHEASGQRVTAWCEENS-ITP
ref|YP_754863.1|      --------------------------MVNNDLRSLWEQRLADYETSGKSIATWCREHS-TRN
ref|YP_431169.1|      ----------------------MTKAELQELWASRIAEYKMSGQSVKEWCATHEGVSP
RAAC02320             MAFILPSVENVVIKPREGSCMREHMSHQERRELWRERTAAFYDSGQSASQFCAEHG-LKP
                                                 . : *  ::*    **      :*   :  :

ref|ZP_01287154.1|    HAFGWWRRKFRDQPASEQPLLVQVPTVARFTAAT-AAADFSGLRLLLPRG-LQLEINQGF
ref|ZP_01287577.1|    HAFGWWRRKFRDQPASEQPLLVQVPTVTRFTAAT-AAADFSGLRLLLPRG-LQLEINQGF
ref|YP_754945.1|      RQFYYWRRKLR-----TEHVEKEQPVKWLSLKYESRQLGIAGDAIAVHVGQATVEIRKGF
ref|YP_754863.1|      NQFYYWRKKLR-----MDQVENNQPVKWLPLEVE--QANLAPGSIGVHVGQATVEIKPGF
ref|YP_431169.1|      RQLWYWLRKYKN----QNGVLSAQSTRWLPVEIS-EQTSNVSNSLLVRIGPAIIEVSPSF
RAAC02320             HQFWYWLRRLRN-----ETAPGTQATSFVSVVTTSSPSDASRSPLTLRVGSVEIDVHPGY
                      . : :* ::  :          :     ..   .            : :  *   :::   .:

ref|ZP_01287154.1|    DAATLGRVI-------
ref|ZP_01287577.1|    DAATLGRVI-------
ref|YP_754945.1|      DRELFCEIIQVLQTT-
ref|YP_754863.1|      DPHLLRQIVKVLQTI-
ref|YP_431169.1|      DPVLLSQVVKVLVALC
RAAC02320             DASTLAELIRLVMHVC
                      *    :  .::
```

FIG. 26

```
ref|NP_982177.1|       TEINBACILLUSCEREUSSCRESIGNIFICANCEE-IDENTITIESPSITIVESGAPSQY
ref|ZP_02595431.1|     ------------------------------------------------------------QY
RAAC02321              ------------------------------------------------------MNEKPQA
ref|YP_001108426.1|    ------------------------------------------------------------
emb|CAN89659.1|        ------------------------------------------------------------
ref|NP_927486.1|       ---------------------------------------------------KKPSGS ref|NP_982177.1|       VLVISPRDNE--VDLVKELGYGVILIRKNISFDEMFSVEVPVEIDLNDEEIVVGKCKELS
ref|ZP_02595431.1|     VLVISPRDNE--VDLVKELGYGVILIRKNISFDEMFSVEVPVEIDLNDEETVVGKCKELS
RAAC02321              VVVIGTREHEGEVELVRALGYRVLLLNTKINIEDALVADVPVELDLNDETLVISKVIDLT
ref|YP_001108426.1|    -------------------------------------------ETNDVAALAEHVARLQ
emb|CAN89659.1|        -------------------------------------IRCDTNSDAALRAALQDRF
ref|NP_927486.1|       IELKKAKELGAYIIFIGSR-----KYYNKVSDNDLLYIDEFFEADTNDDELVINMVEYIN
                                                              :  *.        :

ref|NP_982177.1|       EKYNVVGVYTLNEYRIPLAAKVGEILEINSFLSYETAITCRNKKLARKKLNNSNVSSVKF
ref|ZP_02595431.1|     EKYNIVGVYTLNEYRIPLAAKVGEILEINSFLSYETAIICRNKKLARKKLNDSNVSSVKF
RAAC02321              NHYYIKAVFTLNEYRVPLSARIAETLGLQRTISYEAAQNCRNKKLTRRTLMRNGIQAMKF
ref|YP_001108426.1|    PVLGFDGVLTSCDYYLPAVAHIAARLGLPGAP-PEAVERACSKDLTRRALREAGVPGPAF
emb|CAN89659.1|        RREEIAGVTTTSDFYVPAAARLARWLCLPGNP-PEAVTACRDKSALRALLRRAGVHQPRY
ref|NP_927486.1|       AKKKIQGVITFMEFYVPLVAKVAETLGLKGIT-YENALRARNKHLMRESFRQKNVPIPKY
                            .  *  *    ::  :*    *::.     *  :        *   * :    .:     :

ref|NP_982177.1|       ILIRKLDNLNEKLEGFSFPVIVKPSNDSGSKNVYLCKDYNEVKQAVDVISNSKLNLVGQT
ref|ZP_02595431.1|     VLIRELDNLNEKLEDFSFPVIVKPSNDSGSKNVYLCKDYNEVKQAVDVISHSKLNLVGQT
RAAC02321              ATVKTPAEALDVIADMDLPVVVKPANDAGSHLVYRCDTLQEVWEAVEAIAQTPYNWVGQN
ref|YP_001108426.1|    ALAESAAGLEEAAAALGYPLVLKPVDLCAGMFVRKVTDDVELRDAAALRQFPVNARGQR
emb|CAN89659.1|        AVVREPGEVAAAVARTGLPCVVKPADSGSVNVLLCTDEAQARAQAERILAVTTNVRGMP
ref|NP_927486.1|       ALISNIDSAKIEAAKIGYPNIIKPINMAGSRGVLRNDNVIELERNFREVCEITP-PFGVK
                           .  *  ::**   :  ...  *              :              :        * ref|NP_982177.1|       LDPEATVEEYLDGPEYSIESYTIDGKTTIVGVTEKVVTPFPLSVEVGHNFPAVLEEDIET
ref|ZP_02595431.1|     LDPEAIVEEYLDGPEYSIESYTIDGKTTIVGVTEKVVTPFPLSVEVGHNFPAVLEEDIET
RAAC02321              RDPEILIEEYLVGKEYSVEACTIQGETHILAITEKETTTNVSVEIGHTVPATLEEFQVS
ref|YP_001108426.1|    RNPLVLLEELLTGPEVSVETVTSRGRTSVIGVTDKSIAGAPWEVETGHMFPAALDLDTER
emb|CAN89659.1|        TARTVLVEEYLDGPEYSVEMFSQDGEAVCVGITAKSVTGDPHEVEHRHLFPAPLPAATAE
ref|NP_927486.1|       KSSLFLIEEYLEGQEYSIESISFNGVVNIVTETKKYVSSNGYFVELGHTLPANIPLQQKI
                        ::**  *   *  *:*      :    *   .   :  *    :        **   *  .** :

ref|NP_982177.1|       SIHETVINALDVIGVDFGVTHTEVKVTSDGPKVIEVNARPGGDRITDLVEYVTGIDLRRI
ref|ZP_02595431.1|     SIHETVINALDVIGVDFGVTHTEVKVTSDGPKVIEVNARPGGDRITDLVEYVTGIDLRRI
RAAC02321              SIHDLVKKALRALGVDNCVTHTEIKLDGNSLRIVEVNARPAGDKTPLLVRAVTGYDLREL
ref|YP_001108426.1|    AVVETAVAAVEALGLDNVVGHTELKLTFDGPRIVEVNPRPAGNQITELVRRVTGIDLAAA
emb|CAN89659.1|        RITETVMAALDAAGIRLGATHTEVKLTGSGPAVIEINPRPAGGMLPEVRLASGVDLLEQ
ref|NP_927486.1|       EIEKVVTQALFALCIYNGGGHTEVKVTSDGVKVIEVGARLGGDHIPELVEMATGIDMWKA
                        :  .       *: .  *:       ***:*:        ..  ::*::..*.  *.  **. ..:*  *:

ref|NP_982177.1|       ALRINLGLPIKNSCCNKELVPSSSIRFLIADKEGYISFNEN----FRAESIKEIHWYVNK
ref|ZP_02595431.1|     ALRINLGLPIKNSCCNKELVSSSSIRFLIADKEGYISFNEN----FRAESIKEIHWYVNK
RAAC02321              ALHIALGGQFENAPRHEVLAPVAATRFLTADKHGVVSYDSRGV--LEFEEMKYIEFFTKN
ref|YP_001108426.1|    YAQVALG-EEPALERAETGAGSAAIS FLIPPKEGIGEVVGVQDLEGADGVVDWKFKSS-
emb|CAN89659.1|        QLKAATG-QAPDLKPGHG--AHAGIQFLLADADGVLDAVDGVARARAVDGVEAVTVTVAP
ref|NP_927486.1|       VIQVSLN---ISPDLSKKFSKYAAISYITAPS-GIVKKVNYIKN-------GFIHFDVNV
                                                                :.*  ::     * :

ref|NP_982177.1|       GERVNKTTSNFDRIGYYIVDGNKKESSKKIADSLNECFELAISEL
ref|ZP_02595431.1|     GERVNKTTSNFDRIGYYIVDGNTKESSKKIADSLNGCFELAISEL
RAAC02321              GYVVKKTTSNYNRLGYFVVFCKNRDHVETVNRKILSKLNLRISDI
ref|YP_001108426.1|    GHRSGPATSNNNYLGHVMVTAPDPGRARAKAEALVGGLDVRYAE-
emb|CAN89659.1|        GAVVRRARSAGDRVGHVIACRPGPEQVTAALDEARDLLRLTVGE-
ref|NP_927486.1|       GEHIESLKNSSQRLEYAIACGVTAEQAEFESHHLKENIIIEIA--
                        *        .  :  :::.          ::  .
```

FIG. 27

```
ref|YP_504284.1|      -----SLYVAVFSTMLGIGIV1PLLPRFAETLGASGFGIGMIFSSFALSRAFAMPFFGRY
ref|ZP_02131576.1|    -KIFITLFFSIFTSVTGVGIVVPLLPVYANNLGASGFPMVGMIFGSFSLSRILFLPYFGKR
ref|YP_001046337.1|   -RIYNVLFISVFATMLGLGIVSPLLPIYAENLGATGIWLGIIFSAFALSRSVFMPVIGRI
ref|ZP_02132246.1|    --ILVLLSVSVGVSMIGLGIIWPLIPVYAVELGAGGFMVGLIIASFNLSKAAFGPFMGRF
ref|ZP_01288161.1|    -RLLLPLLFSVFIALLGIGIIVPVMPIFATSLGASGLALGFIIASFSITRGLCQPGVGML
RAAC02322             MKIVYTLSFAVFLLVTGTGIVAPLIGPYAHSLGAGGFW1GLLFSGFYIVRLLVGTPVGRL
                          *.::    : * **: *::   :*  *** *: :*::::..*  :  :   . .* ref|YP_504284.1|      SDICGRRQFIIIGLLLYAIFSLLYVPAGSVLELSGIRFLQGIASAMVFPIAMAYIGDIAP
ref|ZP_02131576.1|    SDMIGRKPFITIGLFAYSLVSIAFMFSHGVTQLVVTRFTQGTASAMTLPVCQAYIGEIAP
ref|YP_001046337.1|   SDRRGRKWIILIGMFAYAVLSLAYIIVDSVYSLTAVRFAHGLASAMVVPIAMAYVADLSE
ref|ZP_02132246.1|    SDSLGRKKFITVGLIAYTCMSVMYVLAGSAETLIAVRTFFGMASVMVVPTAMAIAADIAP
ref|ZP_01288161.1|    SDRWGRKGFLLGGLLIFGVVGLLIPQAVSVENLVLIRALHGVGSAMIVPVAMAYVSDLAP
RAAC02322             ADHQGPKRVLIYSLILYPLISIAYWSAHSVGVLFAARLLHGLASAMMLPMAMTYVGAITP
                      :*  *  : .:  .:: :  ..: .  ..  *    *  :*:.*.*:.*:  :  . ::

ref|YP_504284.1|      PGMEGRYLGTFTSSLFLGMGLGPFLGGIVTDIAGMDTAFICMGALTGVALLTCIFFLP--
ref|ZP_02131576.1|    QGREGFFMGLFNISMYSSLSLGPILGGVVNDHFGLQTAFACMGVLSLLAFFYAQHFLPPV
ref|YP_001046337.1|   KGREGSIMGNFSISMFLGMGMGPLLGGFLNDAFGLDSVFYVMAGLSAFATILVGISLP-E
ref|ZP_02132246.1|    KHELGLYMCTLNMAVMLGLGAGPVLGGALRDHFGMDSAFIAMGLLALITCILVVIVLPSD
ref|ZP_01288161.1|    VGEEGRYMGLLNTAIFAGIGSGPLLGGIFTDLWGMPSAFYAMSTLSFLALGLILLQMPAM
RAAC02322             PGQEGRYMGIYNTFLFIACGICPLLCCLLASELSPNAAFLSLSLLAIGSLLLVIPLPR--
                        .:*    .  :    . . **.***      :. * .   **  :

ref|YP_504284.1|      ----GYQGSRKEQSSILHLLIHPGLRIPLLYQMMNAFANGTFMVFLPVIAAHVGNLSAGE
ref|ZP_02131576.1|    KEE-PRQERGREPVTYRILAKNAGIMGAVLLRTTYTFCIGAIWGFLPVYADAHFNLSSSA
ref|YP_001046337.1|   AKRGTFTVQEGNPVPMRKILTLPVMRGVMVFAFISALCRGGMMVFIPVFG-PLIAISPTE
ref|ZP_02132246.1|    AETRSFKENQAR-SSVGQIVRHRIALGIIFMRFLAASGQGAVYTFLPLLG-LKMDMSSSQ
ref|ZP_01288161.1|    PAASRTGNADGLFTVMGKMLANRSTTGLLARMATMLIMVPTMAFLPLLMTQAFQASGMQ
RAAC02322             VSSASKEKNGMNHWGMGDLIISPGILALAVLNVENAVLDVFQVSFPVFA-QNRGLSLLA
                                             :                  *:*:           * ref|YP_504284.1|      TGLVISVSVLSTALLQRVCGRLADRFDKYLLIATGCLTVTVALALVPGFEGLWSYLFFAL
ref|ZP_02131576.1|    IGFLIMLGVLTSGVLTPMGWLADRVDKRLLCVIGSVMISVAVYSFTFADGFWHLFASNM
ref|YP_001046337.1|   VGTVISANTFLMALLQVPMGRITDTGNKVVLIVAGSAITALAIGAIPFSGSFGPLLAITS
ref|ZP_02132246.1|    VGILLSANIFLIAFLQRFSGRLADRVNPKYLVIFGTFLAGFAVLGMFMVKGFFLVLVLNI
ref|ZP_01288161.1|    IGTVIAVRTLINASLQGYCGRLADRYDKLRLLRYGCLVISGVMCLIPLAGHYWVLLLLFA
RAAC02322             IGFLIAINSIVIGASQVPCGWLVDRTNKYYLVLVSGIVTSVLLTMFPLCRKLWVITMLMI
                      * ::     :  .     * :.*  :   *     .  :   ..

ref|YP_504284.1|      LMGIGGGISVPAMYALVTIAG-RDVGQGAAMGTINMVMSMGMIISPVVCGLFMDQTGISS
ref|ZP_02131576.1|    AFGIGGGIMAPALTAICVIEGHKERAMCGSVMALLTIGHSLGMLAGSVATGVLMDMFSLSA
ref|YP_001046337.1|   LVGIGGAIQQPAIMALTVDAG-RTIGMGTSMGAYNTVFGIGMIIAPLMGGVFMDYIGIDA
ref|ZP_02132246.1|    VMGAANGLALPGGLVITAQLG-RTMGMASLMSITDAAWSLGMIVSPILSGIILDVYGLPY
ref|ZP_01288161.1|    VLGLGEAIIWPTLGALATEEG-RVYGQGTMMGVFNLAMSAGVLGGALGAGFATDLLGLTW
RAAC02322             LIGFSSAITIAASSALSTMLG-RTGGMGHVMGFLNSATSFGMIVGPIVSGIILDKLNVYF
                      .*  .  :  .   .:     *  :..   *.      . *::  ..:  *. *   .:

ref|YP_504284.1|      VFYLSAVIVLVVTPVF--------------------
ref|ZP_02131576.1|    AFTASAVLAILGTVVF--------------------
ref|YP_001046337.1|   VFYVGGAISLLGTGIFAVMMQRNARAADRKDIP----
ref|ZP_02132246.1|    VFLMGSALIL--------------------------
ref|ZP_01288161.1|    SFPVIGLLVLLLTFLAIGMIAADRLA-----------
RAAC02322             TFYFNSIVWLVSTMLFAMLWMVHNRRISKKQDVPISY
                       *       .  : :
```

FIG. 28

```
ref|ZP_01287831.1|    ------------------------------------------------------------
ref|YP_076198.1       ------------------------------------------------------------
ref|NP_634267.1       ------------------------------------------------------------
ref|YP_446560.1       ------------------------------------------------------------
ref|ZP_01106621.1|    --------------SSCCGATTPSNKVYNTMMDDYTETDGYVEDADLGLGCGLPTEFAKI
RAAC02323             MRKNVNANCCSAEPEPLTPAKRVIKDFYDTVAVGSGPYPASTDRFSPAAPTEKILEYVKR ref|ZP_01287831.1|    ------VLDLGSGGGFDCFLAARQVGETGRVIGVDMTPEMISQARANATKSGD---RNVEF
ref|YP_076198.1       ------VLDLGSGAGFDCFLAARQVGESSGRVIGVDMTPEMLARARENARKGGF---ANVEF
ref|NP_634267.1       ------VLDLGSGGGFDCFLAAQKIGSSGKVIGVDMTLEMVEKAQANARKYGY---SNVEF
ref|YP_446560.1       ----RVLDLGSGAGMDAFVARRTVGPDGHVHGVDFAEEMVAKAKANADTLDY---DNVTF
ref|ZP_01106621.1|    KKGDTVIDLGSGAGNDCFVARHETGSEGKVLGIDFTPIMIEKARINAEKLGY---NNVEF
RAAC02323             TNCRRILDVGCGMGTTLLRMAQEHVSGVQFIGVDFSEKMIERARTSSLSLHDDLRKKIGF
                        ::*:*.*  *    :   :    :. *:*:: *: :*: .:.       ::   * ref|ZP_01287831.1|    RLGEIENLPVADGAVDVIISNCVINLSPEKRRVFAEAYRILKAGGRLAISDVVATAELPE
ref|YP_076198.1       RLGEIEHLPVADESVDVIISNCVINLSPEKEQVFREAFRVLRPGGRIAVADMVSLAPLPP
ref|NP_634267.1       RHGDIESLPVKDSSVDVIISNCVINLAPDKEKVFREAFRVLKPEGRMYISDMVLLDELPE
ref|YP_446560.1       EVGDIEALPVESGAFDVILSNCVLNLVPDKEAAFAQMHRALRPGGRFSVSDVVHAGALPD
ref|ZP_01106621.1|    REGDIDAMPVSDEVADVIVSNCVLNLVPNKNKVIGEMFRVLKPGGHFSVSDIVLVGNLPE
RAAC02323             FVANAESLPYMEGQFDFVFSECVLNLTPEREKATAEVMRVLAPGGMFVYTDFVAFSPISN
                       .: : :*       *.:.*:**:**  *:::  .:  :  *   *  : :*.*  :.

ref|ZP_01287831.1|    AVRKDMALYTGCIAGASLVSDIEQMLTEVGF-TEIRVSTKDESKSF--------------
ref|YP_076198.1       EVREDLALYAGCVAGVATVGELRTMLTEAGF-VDI-------------------------
ref|NP_634267.1       ELKNDSELLAGCIAGAVLKEEYLGLLKKAGFSVEILNEDLDISKRQYRDLPVESLKLK--
ref|YP_446560.1       GLREAAELYVGCVAGAMERDMYLDRLREAGF----------------------------
ref|ZP_01106621.1|    ALKADAEMYACCVAGAIQKEDYLKIIEDKGFMNLK-------------------------
RAAC02323             SIRDNLNLVSGCRAGSKTLSENIRLLEETGFVKIECIDFTSDKNKRYADLMNESEQIRRE
                       ::    :   ** **         :  . **

ref|ZP_01287831.1|    ---------------------------------
ref|YP_076198.1       ---------------------------------
ref|NP_634267.1       ---------------------
ref|YP_446560.1       -----------------------
ref|ZP_01106621.1|    ------------------------
RAAC02323             FRRFRNLYPDAAAFLDERVGYYLILGCKPI
```

FIG. 29

```
ref|ZP_02595423.1|      MNILLVSNFEGGFQPNTIATAATPLVKAGFDVEILDTYVEG-LVEEKFKDKQLVAISVPL
ref|NP_982173.1|        MNILLVSNFEGGFQPNTIATAATPLVKAGFNVEILDTYVEG-LVEEKFKDKQLVAISVPL
ref|ZP_02367476.1|      ------------------------------------------------------------
RAAC02324               MKILLVSVFEGGFQPQTIATAAGALSEIGVEIDALDVYIED-LRFNKVSDANLVAISVPL
ref|YP_001616264.1|     MNVLLVSTYESGFQSLGTSVAAAHLLEADVRVNALDLSVTPTPDIDELCRHD_VGFHLPM
ref|YP_827637.1|        MRVLLVSTYEMGRQPFGLASPAAWLRAEGHEVTQADVSCTP-MPKDAVEAAGLIAFFLPM ref|ZP_02595423.1|      FDAVTAGIEVAKKVAEINPDAHITFFGQHATINANRLAGRYSDSCISGEWEHPLTLLAKH
ref|NP_982173.1|        FDAVTAGIEVAKKVAEINPDAHITFFGQHATINANRLAGRYSDSCISGEWEHPLTLLAKH
ref|ZP_02367476.1|      ------------------------------------------------------------
RAAC02324               FDSIQPAIALSKEIRKINPRTHVTFFGQHATIHAQKLASTYGDSCIRGDWEYPLINLARY
ref|YP_001616264.1|     FHSVPAAVRVAGRLRQQEKAPKIFFYGLYADLFREKLLGRHGDYVLGTDWEDQIVPLVK-
ref|YP_827637.1|        HTATKLFLRLVDRVRAVNPRAHLCAYGLYAPLNERLLRGAGVGTVLGGEFESGLRDLARR ref|ZP_02595423.1|      LSGETQESLPGVLSAEQAIKGESVHPYMARNHLDIPSRHLLPALHKYPQKQINRLLGSDQ
ref|NP_982173.1|        LSGETQESLPGVLSAEQAIKGESVHPYMARNHLDIPSRHLLPALHKYPQKQINRLLGSDQ
ref|ZP_02367476.1|      ------------------------------------------------------------
RAAC02324               LMGNNSE-LVGVLLADDAKKGKSTPVYIGRNDLRVPARSILPPLDKYPQPHVERIMGSKQ
ref|YP_001616264.1|     -----------RSPDPSVVQLQKRGFARQNRYRTPARQVLPHLGNYAKLVED---GAHM
ref|YP_827637.1|        LS-----------SGDPAPAAPPVTISIERQQFLVPDRKGLPPLGAYAQLVVG---NGTR ref|ZP_02595423.1|      VVGSTEIARGCHHKCLYCSVFAAYDGKVILVPEEIVLQDVRNLVEGGMTHLTFIDADFFN
ref|NP_982173.1|        VVGSTEIARGCHHKCLYCSVFAAYDGKVILVPEEIVLQDVRNLVEGGMTHLTFIDADFFN
ref|ZP_02367476.1|      ------------------MYAAYDGKVIMVTDDIVVEDVRNLVKQGMEHLTFTDAEFFN
RAAC02324               VVGATEIARGCHHKCLYCSVFAAYNGKVVLIPEDIVLEDAKNLVEQGMTHLSFIDADFFN
ref|YP_001616264.1|     LAGCVEATRGCAHHCTHCPIPPVYGGKVTIIPEEVVLADIDNLVLMGARHVSFVDPDFLN
ref|YP_827637.1|        RVGYTEASRGCKHLCRHCPVVPVYNGRFRIVQADIVLEDIRRQVAAGAAHITFGDPDFFN
                                          :  ..*.*:.  ::  ::*:  *   . *   *  *:* *.:*:* ref|ZP_02595423.1|      AKYHGIKILRKLHEEFPELTYDFTTRVDHILENKKTLAEMKELGVKFITSALEFPSEEVL
ref|NP_982173.1|        AKYHGIKILRKLHEEFPELTYDFTTRVDHILENKKTLAEMKELGVKFITSALEFPSEEVL
ref|ZP_02367476.1|      AKNHGVRIMRRLHEEFPHLTYDFTTRVDHILEHEDAIREMSGLGLRFITSALEFPTQKVL
RAAC02324               AKWHGIKIIRKLHEKYPFLTYDFTTRVDHILENRDTFREMVNLGVKFVTSALEFPSEELL
ref|YP_001616264.1|     VPREGLSIMKAVNDKYPFLTYDFVAKVSHFRRHEQYVRELAKLGLKFVLTAMEFNDNEVL
ref|YP_827637.1|        GPGHAVPIVEALHREWPWLSYDVTIKVEHLLKHRDLLFVLKETNCAFVTSATESLDDEVL
                         *.:  *:.  ::  ::*  *:**..  :*.*:  .:... . :  .    *: :*:*    :::* ref|ZP_02595423.1|      DAVAKDTSVADIEQGIAYLREIDIKLNPTFIMFNPWTTFEDLTTFRSFVEDNELGNIIDP
ref|NP_982173.1|        DAVAKDTSVADIEQGIAYLREIDIKLNPTFIMFNPWTTFEDLTTFRSFVEDNELGNIIDP
ref|ZP_02367476.1|      DIVAKEISVDDIEMAIRRLKAIGVKLNPTFIMYNPWVSKEDILSFKAFIERNDLEDVVDP
RAAC02324               DEVEKQITVNDIREAIKFLREIGMKLNPTFIMFNPWTRLEDLIEFRAFIEDNNLQDLIDP
ref|YP_001616264.1|     DILKKKHDIDDLDWSIGLFHELGVHLKPTFVMVNPWAEVGDIMDLLEFVETRGLIDAVDP
ref|YP_827637.1|        VKLAKGHTRAGFLEALVLMRAVDLPLSPTFIPFHPWTTLESYREFLRTLAENGLASQITP
                         : *      .:  .:  ::  :.: *.*:  :.  .  .  .   . *  .: * ref|ZP_02595423.1|      IQYETRLYLYKGSPLLHKQSIQDLE--LTEYEFHYDWKHPDSKIDELYFEMLTPPEEGIF
ref|NP_982173.1|        IQYETRLYLYKGSPLLRKQSIQDLE--LTEYEFHYDWKHPDSKIDELYFEMLTPPEEGIF
ref|ZP_02367476.1|      IQYETRLHLYKGSPLLNRASTAGLK   LTEREFHFDWSHPDPAVDEMYYANVTPPEPGVF
RAAC02324               VQYQTRLHLYKGSPLLIKKSVKNLE--LTELEFHYEWKHPDPRVDELYSQLHKPVENGVM
ref|YP_001616264.1|     IQYKIRLLLFNNSPLMDSVCLYASL--CEESDYYTEWRHRNPAVEELHREICRWVDEAV-
ref|YP_827637.1|        IQLAIRLLIPEGSLLMELPEVRALVGLFDARALSYPWRNPDPGLDRLCATIQATIKRGEK
                         :*    **  :  :.* *:             *  : :.  ::.:          . .

ref|ZP_02595423.1|      KRCCLKC
ref|NP_982173.1|        KRCCLKC
ref|ZP_02367476.1|      KRCCLKC
RAAC02324               KRCCLKC
ref|YP_001616264.1|     -------
ref|YP_827637.1|        HR-----
```

FIG. 30

```
ref|NP_982172.1|        MMVIFASATHGKATKSFAGVAIGSTVALEAMFGGPISGASMNPARSFGPALISGTFEYLW
RAAC02326               MTVILGSAVHGKAIKPFAGIAICATVALDALFGGPISGASMNPARSFGPAVVSGMFHFLW
ref|ZP_01872101.1|      MIVIYTSAIHGKAIKSFAGIAIGFTVGIEAMIGGAISGASMNPARSIGPAIVSGNLDSLW
ref|NP_922949.1|        MLVICGSALDARAPRGFAGLAIGLTVGLEAGFGGPISGASMNPARSFGPALVAGAWEAHW
emb|CAO48005.1|         MFVISGVATDNRAIGELAGLAVGATVLLNVMFAGPISGASMNPARSLGPAIVSNTYRGIW
sp|P08995|NO26_SOYBN    MFVICGVATDNRAVGEFAGIAIGSTLLLNVIIGGPVTGASMNPARSLGPAFVHGEYEGIW
                        * **     *  .  :*     :*^:*:^  *: ::.  :.*.::********:*.:  .       * ref|NP_982172.1|        IYLVATTLGALLAAIVYKFI--
RAAC02326               IYFVATVLGAVIASAIYRIIRF
ref|ZP_01872101.1|      LYIVASILGAIVAGVVF-----
ref|NP_922949.1|        VYWLAPTAGALLAGWVWHQMR-
emb|CAO48005.1|         IYLLAPTCGAISGAWVYNIIRF
sp|P08995|NO26_SOYBN    IYLLAPVVGAIAGAWVYKIVRY
                        :*  :*.    **:  ..  ::
```

FIG. 31

```
ref|ZP_01090358.1|   --------------------------------------------------IR
ref|ZP_01856486.1|   --------------------------------------------------IK
ref|ZP_02736297.1|   ------------------------------------------------MTVR
ref|ZP_01311632.1|   ------------------------------------------------MSCR
ref|NP_982171.1|     EINBACILLUSCEREUSSCRESIGNIFICANCEE-IDENTITIESPSITIVESGAPSTAR
RAAC02327            ------------------------------------------------MSVK ref|ZP_01090358.1|   FVMIGGFLGAGKTTTIGRLAQHYRDQGLNVGIVTNDQATDLVDTQMLRSQGFRVGEVAGA
ref|ZP_01856486.1|   FIMVGGFLGAGKTTTLGRLAKYYSDQGLNVGVVTNDQAADLVDTNALRSQGIHVGFVAGA
ref|ZP_02736297.1|   FVMVGGFLGAGKTTTLGRLARHYQQQGKRVGVVTNDQAHDLVDTNTLRAQGLSVEEVPGA
ref|ZP_01311632.1|   LILVGGFLGAGKTTLLAETAHKLSLQGLKVGLITNDQATNLVDTRMLVRSGAGVAEVSGS
ref|NP_982171.1|     LVLLGGFLGAGKTTTMIKSALKLEKEGYRVAIVTNDQGKELIDTELARANGLESKEVTGG
RAAC02327            LVLLGGFLGAGKTTTLIRAAHMFQSAGQNVAVITNDQGTELIDTELSRLNELNTEEVTGG
                     ::::*******  :  *      * .*.::****. :*:**.   .    **.*.

ref|ZP_01090358.1|   CFCCNFNELTGTVEKLAAEDRPDIVIAEPVGSCTDLVATVVQPLVRMFDAQFDVAPYGVI
ref|ZP_01856486.1|   CFCCHFNALMDTIEELGSEQKPDVILAEPVGSCTDLVATVIQPIKRLFDADFSILPYTVL
ref|ZP_02736297.1|   CFCCRFDDLVGRVGSLEAGERPDVILAEPVGSCTDLVATVIQPLKDLYSGRFEVAPYAVL
ref|ZP_01311632.1|   CFCCNFQGLLDAMDQLKKTFDADIVLAEPVGSCTDLSATIIQPLKDKLQSKLLISPLTVL
ref|NP_982171.1|     CFCCQFDDLYNNLNTLMKEKQPDVIIAEAVGSCTDLAATVIQPLKQYYADKFKTAPLTIV
RAAC02327            CFCCRFNELYDKLISLKSQFRPDVIIAEAVGSCTDLAATVIRPLKQYYGKEFDVAPLTVV
                     ****.*: *  .  :   *   .*::**.******* **::*:          :   * ::

ref|ZP_01090358.1|   LKPSHGLRILQGEDSGG--FSPKAAYIFKKQLEEADFVIINRIDELDAEKVDLLASLITE
ref|ZP_01856486.1|   MKPSHGLKILKNDKGSG--FSPKAAYILKKQLEEADLILINRIDELSAEEVDEITALVNE
ref|ZP_02736297.1|   FKPSHGLRILRNQAAGG--FSPKAAYIFKKQLEEADAIVINRVDELDPAQIDELSLLVTQ
ref|ZP_01311632.1|   ADPIKLGAILAG-GTAG--LHDDAAYIYRKQLEEADLILISKVDLLTPMVDDLLIRVRK
ref|NP_982171.1|     VEPARLLHELNLDENTKPFFSQSVSYIFEKQLAEADIIALNKVDRYSEEEIAKLKAYLQQ
RAAC02327            VDPGRILSEIGPKEKIN--FSRSVSYIFDKQLSEADIIAINKTDKYFRRCINDLEDYLQK
                     . *  :       :       ...:**  *** ***  :  ..:*       :      : :

ref|ZP_01090358.1|   AFPGTPILRTSAKTGAGFDALVELIDQRGEFGKKILDIDYDVYAEGEAELGWLNSSLKAT
ref|ZP_01856486.1|   QFPGTPVLRTSALTGEGFEPLLEFLEQDGDFGSKILDIDYDIYAEGEAELGWLNSSVHIS
ref|ZP_02736297.1|   QFPGTPVLRASATTGAGFDALTELLDQTGAFGRKILDIDYDIYAEGEAELGWLNATARLT
ref|ZP_01311632.1|   AFPSAIVQPLSAERNVGLDYWLDHVLHKTTAGNTLLDIDYDRYAEGEAVLGWLNARFELR
ref|NP_982171.1|     RYPQTIIQTFSAERGDNLEALTHTWLTTDLGGDKVLDIDYELYAQGEAKLAWMNILGDIK
RAAC02327            RYPTAVIHTFSAHRGDNMERLLDLWRTLNISGEKALDIDYDKYAGEAKLAWLNSLIDLS
                     :*  : :   **    . .::   .       *  .***: :***  *.*:* ref|ZP_01090358.1|   ASEAF--DLDAFLMAIMNAMQKTLAKSHAETAHLKTIGLWEG-FYGVANLVSSDTAPILS
ref|ZP_01856486.1|   AFNSF--SLDQLLLDVISQLQTSFKEKSVETAHLKTIGLWEG-FFGVANLVSNDSEPRLS
ref|ZP_02736297.1|   SDEPF--DLDALLTSVLGELAVVCRSLGGEVAHLKLIGMDDASAFAVGNVISSDTAPKLS
ref|ZP_01311632.1|   TTAG---TWRTFAEAIMTRLHHQFAERNLPIGHVKLIVESES-QVLFANLTGTEIEPKIR
ref|NP_982171.1|     AEQD--INPREWAEKLLDNLNKHFIREKMAIAHLKVHVGFEG-GYVKASMVQTGDAPTFT
RAAC02327            VEEANHFDAKLWMHMFLDKLHEHFLREKMATAHLKVYVGSDN-GFIKASIVETGDTPTYI
                           .:  :                       .*:*               ..:    . * ref|ZP_01090358.1|   LFSNCQAKEADVVVNARVGISPEELRQQVDDAIDAAAKKFGVRIERQQTQYFRPGRPVPT
ref|ZP_01856486.1|   LSSDCTVTEADLIVNARVACDPEALTAQVKQVLQNCAQATNAKLEFRQTQSFRPCRPVPT
ref|ZP_02736297.1|   LFSGLRPREADLIVNARVAIDPAVLEAEVKRVVALESAKVGVIAEFRTSQSLRPGRPVPT
ref|ZP_01311632.1|   GEMTSTP-HATMTINARVETSPEELRQIIWQALQQSSDGINVYQEQWN--CLKPGRPEPT
ref|NP_982171.1|     VENVKEGKEFRIVLNIRIEATPAILNLVVADSIGAINKELGSNWSETYNECFSPLPPKPV
RAAC02327            VKEPVNGQEFRVVINIRIETEPELLSLVVADALAIVNKEMKVKWKQTYHECFSPLPPNPT
                       .  : :*   *:    *    *           .         .        :* **.

ref|ZP_01090358.1|   HR------
ref|ZP_01856486.1|   HR------
ref|ZP_02736297.1|   HR------
ref|ZP_01311632.1|   YR------
ref|NP_982171.1|     HRL-----
RAAC02327            HRLRVAAK
                     :*
```

FIG. 32

```
ref|XP_955124.1|     --------------------------------------ELCDPVLEAN-GLKVAAKSTFGDM
ref|XP_763458.1|     --------------------------------------ELCDPVLEAN-GLKVAAKSTFGDM
ref|XP_666904.1|     ----------------------------------NTNLEEN-ELSDKTINLIQNL
RAAC02328            MIRGEEILLRKIVVEVLPKYSS-ENCCSVDGEETTIDCCNPLVEAN-ELKDKIKNVLGDL
ref|NP_982170.1|     --------LIEIFPSVVTNQTD-CCDSDNNSEEGCCEESNQFFEESLELKEQLKEHFDKL
ref|XP_845342.1|     ------------LAEALERYSDSEQLCSCTLRVFSVFPSSPYVDMN-AIASLFKNTESEA
                                   .  .:  .  :          .        .

ref|XP_955124.1|     IIVELYKAAYVLGLWDVAAYNCLKT-CKRRGY-----------------------------
ref|XP_763458.1|     IIVELYKAAYVLGLWDVAAYNCLKT-CKRRGY-----------------------------
ref|XP_666904.1|     VIIHFSD--LIINQLPLNSVNHTESLCKER-------------------------------
RAAC02328            VVIHVFD--YTLSVDWSLAVNRLRQLFKERGFRGLSEMDNILEVVTPVVIVNGNLVSFVC
ref|NP_982170.1|     VNVHLYN--YELSMDRVLAQKKLSQLIQERGFGNISE-DSVLRYVTPAVVVNGTLVSFAT
ref|XP_845342.1|     VAIEAIH--FLCSVA--MSVKTLKQLIHTTGC---VQRVLEVMRKYAGNASIQEYACSLLS
                     :  :.  .         .     : :   :

ref|XP_955124.1|     ------------------
ref|XP_763458.1|     ------------------
ref|XP_666904.1|     ------------------
RAAC02328            PFDFEKIVSRIMTMSYE
ref|NP_982170.1|     KPQMESVL---------
ref|XP_845342.1|     YLSFDSETITSFI----
```

FIG. 33

```
ref|YP_079109.1|      --INIRKAISADLPFILTIYNQGIEDRIATLEQDLKEMSDIEIWFQEHCGRYSVLVAE-S
RAAC02332             MMVTVRVATHRDLPSILAIYNQGIEDRVATLEQDLKDMDYITNWFNEHTNRYPVFVAE-Y
ref|ZP_01858609.1|    --IIIRKAEIRDIDRILTIYNQGIEDRVATLETEPKDRTYMAEWLKAHCGRYTGIVAE-L
gb|AAV70501.1|        ----IRKATEQDAQEIMTIYNEGIEDRIATLETEIKTDKYVMEWLFQREKRYSVIVME-E
ref|YP_001319533.1|   MAYTVRIAELQDLKSITEIYNEGIEDRIATLETKIKSEAEMIFWLQQRSEKHKVITIENE
ref|ZP_00539168.1.    ----IRPVKEDDLKDILAIYNEGIEDRIATLETDTKELSFMEDWYRERTPRYAGFVAY-E
                          :*.   *   *  ***:*****:****   . *    :   *    :  ::   :.

ref|YP_079109.1|      KGEIVGWASLNPYSHRCAYQGVADLSVYVDRACRGKGIGGLLLQALEKTAKENSFYKIVL
RAAC02332             QNNIIGWADLHPYSHRCAYGGVAELSVYVHRGWRAKGVGQALLSALEAFARKHDFHKLVL
ref|ZP_01858609.1|    EGEVIGWASLNPYSPRKAYAGVADISVYIERNSRGKGIGRKLLSSLEVKARENGFHKLVL
gb|AAV70501.1|        NSHIVGWASINPYSHRCAYRGVGELSIYIKREYRGKGLGQKLLLALEKTGQKNEFYKFVL
ref|YP_001319533.1|   RDEVLGWASLNPFNSRCCYDGVADFSIYIKRQMRGMGLGKLLLKALIEVAREQDIHKLVL
ref|ZP_00539168.1|    GTTILGFISLDPYNPRPVYQSVGELSVYITRTHRGQCIGRQLLHVIEEHAITQGFHKLIL
                      ::*: .:.*:. *   * .*.::*:*: *  *. *:*  **   :   .  : ::*::* ref|YP_079109.1|      FTFPFNELGQNLYNKMGYRQVGIFKNQGILDGRFIDVMAMEKLL-----
RAAC02332             ATFPFNSAGLALYRKMGFREVGVFMNHGRLDGKWVDVLWMEKLLELKVE
ref|ZP_01858609.1|    FTFPFNKLGQQLYQKCGYREVGTFKNQGILDGIYVDVMAMEKLL-----
gb|AAV70501.1|        FTFSFNNLGQGLYRKMGYREVGVFEKQGIMDGEHVDVMIMEKLLSVE--
ref|YP_001319533.1|   STFKSNEAGQRLYESFGFREVGTYKNQGILDGKFVDVTIMEKLL-----
ref|ZP_00539168.1|    FTFPFNKIGQKLYIRSGFRIVGTFKEQGMLNGYYVDVLAMEKLLPKTID
                      **  *. *  **    *:* **  : ::*  ::*   :**  *****
```

FIG. 34

```
ref|YP_001358015.1|    ---ILIDTNVVVRFLTRDNEKYFLKSVAIFQDIEDGKMEAMLMDFIVAEIVSVL-HRIYK
ref|ZP_02178354.1|     ----LIDANVILRYLLRDNKELYAKAEEVFNDMMEGKTKILILESVIAEVVYVL-QRIYN
ref|YP_001356736.1|    ----LVDTNVLVRLFTQDNEEMFREAFSFFEKVANFEIQAVISEGVLLESWFVL-QKVYE
ref|YP_001485227.1|    ----VVDTNVIVRFLTNDDEEQSKKAFEIFKRAVNQEITLFLTPIVIIECTWVLGMKRYG
RAAC02334              MKSVLLDTNVILRFLLDDHPHHSPAATNLFMKAEQGEIKLVIDPMIVAECCYVLEGKVYQ
ref|ZP_02013298.1|     MKTWLLDANGILRFLRNDDAVQSPQSKKLLERANAGEVRLLISVLTVAEVFYAL-RASYK
                           ::*:* ::*  :  *.       :  .:      :  .:    : *  .*    * ref|YP_001358015.1|    HSKKEIATTLKKLLLYDHLYTENKLITFEALEIYAEKNIDFADAVLYAKQRLEGFEIISF
ref|ZP_02178354.1|     VSRKEISEILRKLIELRGVKVHNKGQMLNALEIFSEKKLDFVDCILCAHR--EENEVITF
ref|YP_001356736.1|    MKKDEIIKRILCTVTLRNVILEDKLAFTEALHILKERNIDFIDAMLCVKSNIKGYKVFSF
ref|YP_001485227.1|    YSHEEIADNLTTIJTSPGVKTLESDVVLKALHEYKTNRIDFADAYLAAVSTKNGVPCLTW
RAAC02334              FSKELIASHLIPVLTHEGVQCFAIMTVLDGLDTYVEHRLDFADAYLIALARNHRFEVATF
ref|ZP_02013298.1|     MTRPAAAQVLMRFVLTGVAEVEREDVLLDALQRVVSANVDLGDAVLAVEAVRHGEGVASF
                        .:       * .:         :..*.     .:*: *. * .   .     ::

ref|YP_001358015.1|    DKDIEK---------
ref|ZP_02178354.1|     DKGLRR---------
ref|YP_001356736.1|    DNDIQR---------
ref|YP_001485227.1|    NSK------------
RAAC02334              DNKMARIENVVFQDL
ref|ZP_02013298.1|     DKDFSRFTDV-----
                       :.
```

FIG. 35

```
dbj|BAF91394.1|      ------------------------------KNMIPKISDFGMARIFARDETEANTKKVV
dbj|BAF91409.1|      ------------------------------KNMIPKISDFGMARIFARDETEANTKKVV
gb|AAL17690.1|       ---ARGLVYLHQDSRFRIIHRDMKAGNILLDKNMIPKISDFGLARIIARDQTEASTDNPI
ref|NP_001058416.1|  ------------------------------------------------------------
dbj|BAD45624.1|      ------------------------------------------------------------
RAAC02335            MIITSRGVGYMNPDEPVFETLALVWEA-----KRRLPKVSDYRRIARKRQTESPDHVIQRY dbj|BAF91394.1|      GTYG-----YMSPEYTMHGIFSEKTDVFSFGVIVLEIVSGKKNK----------------
dbj|BAF91409.1|      GTYG-----YMSPEYAMHGIFSEKSDVFSFGVIVLEIVSGKKNR----------------
gb|AAL17690.1|       GTYG-----YMSPEYAMYGILSEKTDVFSFGVIVLEIVTGKRNR----------------
ref|NP_001058416.1|  ------------------------------------------------------------
dbj|BAD45624.1|      ------------------------------------------------------------
RAAC02335            GTWSRVLEDFFQAYFTLHGYPTIPDYLFGALFSRAKVVRDKRGRWYLRFVSDDTTQIEIL dbj|BAF91394.1|      -----------------GLYNLSFENNLLSYVWSQWK---EGRALEIVDPVIVDSLSSLP
dbj|BAF91409.1|      -----------------GLYNLSFENNLLSYVWSQWK---EGRALEIVDPVIIDSLSSLP
gb|AAL17690.1|       -----------------GFYQSTPEDNLVCYAWTHWA---QGRALEIVDPVIVDSLS---
ref|NP_001058416.1|  -----------------TVIMRCTQVALLCAQE-----DPADRPTMTDVTAMLDSESIML
dbj|BAD45624.1|      -----------------TVIMRCTQVALLCAQE-----DPADRPTMTDVTAMLDSESIML
RAAC02335            RSFMRRSAATLVNRGKPSLYLRCYDVDLICAYEHACKTEPVFRPTVDFVRGYIDTHSHFR
                                      . : *:.       *.         :*: * dbj|BAF91394.1|      STFQPQEVLKCIQIGLLCVQEHA-------------------------------------
dbj|BAF91409.1|      STFQPQEVLKCIQIGLLCVQEHA-------------------------------------
gb|AAL17690.1|       STFQPKEVLKCIQIGLLCIQERAVHRPTMSSV----------------------------
ref|NP_001058416.1|  SDPKEPTELTHGGAPVLTGHRHILVTQAR-------------------------------
dbj|BAD45624.1|      SDPKEPTELTHGGAPVLTGHRHILVTQAR-------------------------------
RAAC02335            KDPSGRDRLTLTGPLVPECHDFLVALGARNTRVSRVKDSYRMNVHAGSLRRIREALYPPG
                     .   *.         :   :

dbj|BAF91394.1|      ----------------
dbj|BAF91409.1|      ----------------
gb|AAL17690.1|       ----------------
ref|NP_001058416.1|  ----------------
dbj|BAD45624.1|      ----------------
RAAC02335            CVCNPEIRARIFTV
```

FIG. 36

```
ref|YP_517489.1|        ------------------------------------------------------
ref|ZP_01370335.1|      ------------------------------------------------------
ref|YP_517477.1|        -----DILMKVLAEQFKNKTLDVFGIKTAKIKDLIPSVHPAVEANETRNDIIFLLEDDTL.
gb|ACA46983.1|          ---KDVLFKTLSEMFKDKALIMYGLDYPKIVEMLPNEFPEVKADERRADSIFLLEDGSIL
ref|YP_001568284.1|     --------------------------------------------DFVFELEDNSLL
RAAC02336               MPVQDTLMKALTRSLSGGALDVLGVHGVDLVEPFATELP---ANTLRMDRVWRTVDGNLF ref|YP_517489.1|        --------------------YDARLASRQE------RQIRTFVVYSGHIEQAKERLDCGSI
ref|ZP_01370335.1|      --------------------YDARLASRQE------RQIRTFVVYSGHIEQAKERLDCGSI
ref|YP_517477.1|        HLEFQTT-AGEQDLKRFLYYDARLVRRQE------RKVHTIVIYSGRIEQARERLECGSI
gb|ACA46983.1|          LLEYESNNRITENMYKYIDYVLRISRKYYEFNKSIKKINVAVIYASNIERAEDHFNIGSV
ref|YP_001568284.1|     HLEFQTTWKKAD-LLRFAQYDIALYQKER------RRINTVVMYSGKYESAESELDMGSN
RAAC02336               HLEFQTK--RESTLHRFLEYDARLANEHR------TRIRTVVLYHASVASAPDELDIGTA
                                                    *   :  .        ::.. *:*  .    *  ..::  *:

ref|YP_517489.1|        LYQVENIYMKDYNGDQEYNRLKAKIESGQLLNETDTLKLIFLPLMKSRQQEEDLAIQAAE
ref|ZP_01370335.1|      LYQVENTYMKDYNGDQEYNRLKAKIESGQLLNETDTLKLIFLPLMKSRQQEEDLAIQAAE
ref|YP_517477.1|        LYQVENIYMKHYNGDQEYNRLKHKIDNHQLLSETDTLKLIFLPLMKSEQKEEELAIQAAE
gb|ACA46983.1|          GIDVKSVFMKNYDGDTIYKEVEQKIKNGINLKDIDLMNLILLPLMKSIKDKHELIKDTIE
ref|YP_001568284.1|     KYKVQQIFMIKYDGIKRYEEIKEKIEKEEELTDKDLMDLVFLPLMRNEKSEEEVTKDVFE
RAAC02336               LYRVENVFLRHLDGDQALNEVEHHLRAG-QWEPGDRMRLGLALNMR-LENQAHAFERVRE
                        *:.::: . :*         :.::  ::           *  :  *  *:   :.: .    . * ref|YP_517489.1|        LAKAT-DEKTKVFAIAALIVITDKIISESNKRKLLEVLK-MTQIEQWIREEGREEGRQEG
ref|ZP_01370335.1|      LAKAT-DEKTKVFAIAALIVITDKIMSESNKRKLLEVLK-MTQIEQWIREEGREEGRQEG
ref|YP_517477.1|        LAKAAPDEKTKLFAIAALIVITDKIMSESNKRKLLEVLK-MTQIEQWIREES----RQEG
gb|ACA46983.1|          LAKEVKDEKNQYFIIAGVLTSTDKFIDEKYANTVRSWLR-MTKVEK-IFEKL----KEEA
ref|YP_001568284.1|     LAIKIPDEDKKEAVIGSLLGFSDNYVRDEYINELKEVIR-MTKIGTSLFEEG----VEEG
RAAC02336               LIPQVPDETERDLVVSAILVLGDQGLTEEQRALLRKELRNVSKLAEELYEEG----REEG
                        *       **  :      :..::    *: : :.         :  . :: :::    : *:      :*.

ref|YP_517489.1|        ELKCRQEEKRETARTMLSMGMSPEVIAKATKLSQEEILRIEKEMKN
ref|ZP_01370335.1|      ELKCRQEEKRETARTMLSMGMSPEVIAKATKLSQEEILRIEKEMKN
ref|YP_517477.1|        ELKGRRDEKRETACTMLNLGMSPELIAKATKLPLEEILEMAK----
gb|ACA46983.1|          MNQAEKSKAIEIAKNLMDI-LSVEMIAKKTGLSIEEVEKL------
ref|YP_001568284.1|     ----------------------------------------------
RAAC02336               RMVGRMEERMETAINMLRKGMSVEDISDTTGLTKQEIEELARKQSH
```

FIG. 37

```
gb|AAB91591.1|      MSPFGQQLRELRRARKLTVNQLAVYSGISSATISKIENGKRGTPKPATIKKLAAVLKVPY
ref|NP_391247.1|    MSPFGQQLRELRRARKLTVNQLAVYSGISSATISKIENGKRGTPKPATIKKLAAVLKVPY
ref|YP_001422657.1| MNTFGKQLRELRRARKLTVNQLAVYSGVSSATISRIENGHRGIPKPATIRKLADTLKIPY
ref|YP_093160.1|    MTNFGHHLRQLRERKKLTVNQLAMYSGVSSAGISRIENGKRGVPKPATTRKLADALKVPY
ref|NP_391246.1|    MESFGEQLRALREERKLTVNQLATYSGVSAAGISRIENGKRGVPKPATIKKLAEALKIPY
RAAC02292           MSQFGQYLRKLRKERNLTINQLALYSGVSSALISRIENGQRGRPKPDTLKKLASALKVPY
                    *  **. ** **. ::**:**** ***:*:* **:****:** *** *::**. .**:**

gb|AAB91591.1|      ENLMAAAGHIRAFPEEIREASES-------------------------------------
ref|NP_391247.1|    ENLMAAAGHIQAFPEEIREASE--------------------------------------
ref|YP_001422657.1| EELMARACHIKAFQEETRETSES-------------------------------------
ref|YP_093160.1|    EELMASAGYISAS--TVQEARS--------------------------------------
ref|NP_391246.1|    EGLMYKAGYIEE------------------------------------------------
RAAC02292           EDLLLHAGVLNEQISRTSESRDLKPVDPSWYKRQVPIPVLGSIRAGTPVEMLALNSSEFV
                    * *:   **  :

gb|AAB91591.1|      ------------------------------------------------------------
ref|NP_391247.1|    ------------------------------------------------------------
ref|YP_001422657.1| ------------------------------------------------------------
ref|YP_093160.1|    ------------------------------------------------------------
ref|NP_391246.1|    ------------------------------------------------------------
RAAC02292           LVDSDLLGNHEGFALEVVGDSMIGDYIFFGDLVIVKYTSNFSPQDICVVAINGEEATLKR gb|AAB91591.1|      -------------------------------------------
ref|NP_391247.1|    -------------------------------------------
ref|YP_001422657.1| -------------------------------------------
ref|YP_093160.1|    -------------------------------------------
ref|NP_391246.1|    -------------------------------------------
RAAC02292           VKCQGDICILTPSNPSMEPMVYNSVDVHVIGVVVEVRRRLRNK
```

FIG. 38

```
ref|YP_195796.1|     ------------------------------------------------------
ref|NP_817052.2|     ------------------------------------------------------
ref|NP_664934.1|     ------------------------------------------------------
ref|ZP_02626811.1|   MYEEYLKHFDLHVSDDIKNFVEETLKDKEYLFVRNEYEPEPISNLKVKVQYGYCSHCRKE
gb|ACA41259.1|       ----------AHFPAEVPEHVQFEADEKALLLSRYIFVSSGKN------RTGYCTHCRNT
RAAC02337            ----MSHDFFAHFPTEPSAALIEYARDVAFLRSRYLFVWRDGK-----VQMAYCTHCRET ref|YP_195796.1|     ------------------------------------------------------
ref|NP_817052.1|     ------------------------------------------------------
ref|NP_664934.1|     ------------------------------------------------------
ref|ZP_02626811.1|   FKTG---EYLKHNEVIICPNCGAEIMVKNIGRGKKCLMNDFCFYWFDKSVLDPEIVTCKG
gb|ACA41259.1|       FPIE---NPIKQNGKGECPACFSKCRYKKAWLGRKALIDTACILHCQKSVLNPSVVTVEW
RAAC02337            YPLGSDKDTYRHNEQATCRQCGSTCVVKHRGRGRRHLIDTAYIVWYEKSMVDAQTVVATW ref|YP_195796.1|     ------------------------------------------------------
ref|NP_817052.1|     ------------------------------------------------------
ref|NP_664934.1|     ------------------------------------------------------
ref|ZP_02626811.1|   YYFSKKYDEDYKNPKYFYNLNSLYVFNTKDNTSKMFKRNWYTVESWEERSSIFDFNINWL
gb|ACA41259.1|       LYASRDYRESFENVSTEYAAVARYVFDYDRKVCQKIE-GGSCCRWWTESCFSTPSFLQNR
RAAC02337            YYAWRDYSGDFHDVETQFCPRARYVFVPGR-GGSMMRLDWSGEWQPRRNVHPLPVGMMGW ref|YP_195796.1|     ------------------------------------------------------
ref|NP_817052.1|     ------------------------------------------------------
ref|NP_664934.1|     ------------------------------------------------------
ref|ZP_02626811.1|   GNKLCYCSFESLDEAVKDTIFQYSNYKRRCGYKS-IVRYLDAFNKYCWIEQLEKMGFDRL
gb|ACA41259.1|       SFMSRNIMHGTFEDGISGTPFQYSGWQR-YDYED-VLKYLPLVAKYPSVEILTKAGLDSF
RAAC02337            RTVDVWCSHESIQTAVAGTPLQYSGWETYCDQYNTLLTFFDLASRYPCVEYLTKLGFSRL ref|YP_195796.1|     ------------------------------------------------------
ref|NP_817052.1|     ------------------------------------------------------
ref|NP_664934.1|     ------------------------------------------------------
ref|ZP_02626811.1|   VETLENRWTTDYSINYRGKDIFKKLKLNRGEVKQLTNEQKRELDSFVLRIYQLNRDNGFN
gb|ACA41259.1|       VKAKIYGYKTYSAVNWSKSKLEHIFKMSKQDLQMLREKNFVSSVYYVGDFLFNAWVVQQW
RAAC02337            VMAKLDGLRTFGAIHWRGRTMEQVLRMPRADVHAFRKLADVIEP-LSLRSYQTWRRLGWK ref|YP_195796.1|     --------------------APMINEIEKYVHYSQIKQLPKEVNLT-----KFQKWFIRKGE
ref|NP_817052.1|     --------------------APMINEIEKYVHYSQIKQLPKEVNLT-----KFQKWFIRKGE
ref|NP_664934.1|     -PTCCCUSPYGENESMGASSCRFSTGNIFTCANCFE-IDENTIT-----IESPSITIVES
ref|ZP_02626811.1|   PSFVEAYEVYEMCRYSDSSGLNNLIKTVGTNKVTKYCEKQYNSF-----NESNSYYNKAS
gb|ACA41259.1|       RKEKSKMNIDELQKNMQIFSVKDDLKTFKFIRRFTSLHRLFNYANKQFEKDEKHFIRRHQ
RAAC02337            VSPEEAHLLRELLIPHHWREIQVRASLASEVEIAKYLLKQLRKG--------EYRSISY ref|YP_195796.1|     RFDYYMDYLHMLEELNTPLNNDSVLYPENLQVAHDNAMNTLNLLKSEIEEKQYQERKNQI
ref|NP_817052.1|     RFDYYMDYLHMLEELNTPLNNDSVLYPENLQVAHDNAMNTLNLLKSEIEEKQYQERKNQI
ref|NP_664934.1|     GAPSYIDYLSMLDELGIEIDTDNLIMPKDLVKAHDNVVKLVNQKKSEIEKRKFKNRLKSL
ref|ZP_02626811.1|   VISKWNDYLKNCEKLNWSIRDKSILLPKNLVKAHNHTTSLINAEKNKEADQKIKRRLPGL
gb|ACA41259.1|       VLITWSDYLNDCQKLKIHID-EAIIFPKNLRKAHEETIKRVKHYEDELMRKKAKERYEKI
RAAC02337            ALIEWIDYLRFCSELCIPLNTTRNVFPSKLREMHDEMMRRVRIKRDERLNAQIQARLAEL
                       : ***   .:*     :     *.:*   *:.   :.    ..:   : :  * ref|YP_195796.1|     KALEAEIDDLLFLTPHSLQE-IIQEGSILRHCVGSQHYIERHTQGKTTIVFIRRKEKPDM
ref|NP_817052.1|     KALEAEIDDLLFLTPHSLQE-IIQEGSILRHCVGSQHYIERHTQGKTTIVFIRRKEKPDM
ref|NP_664934.1|     SKYEQTIGDYCFRAPVDSGE-LIREGKTLSHCVGSARYTQAHASGKTTIIFIRRKSDSDK
ref|ZP_02626811.1|   KKKYFFKDKDFFIRPAESSEDLINEGGTLNHCV--AVHYMKPYANKETIDILMIRRIDNPTV
gb|ACA41259.1|       KHYEFELGQLKIVVPYTPKE-IIDEGNKLSHCV--GGYAERHADGQTTILFVRNIKEPDE
RAAC02337            EPFGYT-DEHFMIRPARSVQELFDEGGQALHHCVG--SYAAKYASGETNLFLMRRVSAPDT
                     .    ..  :    *     : :: **  *  ***     *   ::..:*  :..:*. . .

ref|YP_195796.1|     PYFTLEYRNQQVIQIQGKCNR----------------------------------
ref|NP_817052.1|     PYFTLEYRNQQVIQIQGKCNR----------------------------------
ref|NP_664934.1|     PFYTMEYKAGHIVQVRGKHNQSATEEVQKVVDQWLAIVNKNYKHA------
ref|ZP_02626811.1|   PLVTMEIKNGQVKQAYGKNDTIPKKDVEKFIEKFKTEILEKINSSKKNK--
gb|ACA41259.1|       SFYTVEVKNEKVLQVRGIKNKPATEDVQTFIDEFKKQKLTKKARK------
RAAC02337            PYCTVEMRDSALIQARGERNRLLREDEQTFVDQFVRHVARMHKRAQRRKAS
                     . *:*   :     :  * :
```

FIG. 39

```
RAAC02338              ------------------------------------------
gb|ACA41261.1|         ------------------------------------------
ref|ZP_02626812.1|     ------------------------------------------
ref|XP_001701427.1|    ------------------------------------------
sp|Q2M3V2|ANR43_HUMAN  ------------------------------------------
ref|NP_664935.1|       PRTEINSTREPTCCCUSPYGENESSSI-GBAATUNKNWNPHAGEPRTEIN RAAC02338              ------------------------------------------
gb|ACA41261.1|         ------------------------------------------
ref|ZP_02626812.1|     ------------------------------------------
ref|XP_001701427.1|    ------------------------------------------
sp|Q2M3V2|ANR43_HUMAN  ------------------------------------------
ref|NP_664935.1|       STREPTCCCUSPYGENESMGASGBABFPHAGEPRTEINSTREPTCCCUSP RAAC02338              ------------------MYEKAVEKITL-EMSANEHHPYVQVIG-----
gb|ACA41261.1|         ------------------MVEQAMAKLSA-ELRVERVNPYVAAVG-----
ref|ZP_02626812.1|     --------------------AVEKIKE-EMS-KESNPYIAYIG-----
ref|XP_001701427.1|    ------------------DMAARYLSTQE-ALLVATMSIHNGYGI-----
sp|Q2M3V2|ANR43_HUMAN  ----------------VLGFLQEHGGKVRN-SELLSRFKPLLDAGDP----
ref|NP_664935.1|       YGENESMGASSCRESIGNIFICANCEIDENTITIESPSITIVESGAPSEK RAAC02338              --RFLLVHLEQHPEHAKN----------------LLEEEKTILKSLDTM
gb|ACA41261.1|         --NFLMDFLEDNPSSAEK----------------FLAEGKTIIGSMKEV
ref|ZP_02626812.1|     --NYVLENIEVNKPAAEK----------------IAVGSKTISESFKKV
ref|XP_001701427.1|    --RLTWTQRPPRPQPPNR----------------LAPGAGTIGSSGASP
sp|Q2M3V2|ANR43_HUMAN  --RGRAARRDRFKQFVNN----------------VAVVKELDGVKFVVL
ref|NP_664935.1|       ALSKMLDEMNKKHSAAEDAIHNWLSDQDDEELFKGILDJKKSIKDAMKYC RAAC02338              RRYAETQRVGNVAVISDADGFGIVLQYFDCWDGKPFEIPPEPQPPARVAA
gb|ACA41261.1|         R-------------------------------------------------
ref|ZP_02626812.1|     CGEARKIAQNGIAMLAEREVISIVTKYFE---------------------
ref|XP_001701427.1|    QASPRAS--GTVPSAGTTAAASDAD-------------------------
sp|Q2M3V2|ANR43_HUMAN  RKKPRPPEPEPAPFGPPGAAAQPSKPTSTVLPRSAS--APGAPPLVRV--
ref|NP_664935.1|       INQAQKQKTGNCAMVDDKTVFGWVRVYFT---GKTKKIEPVQATVTVSQE RAAC02338              PTRVTSAKSAQASKKSTAPALTQLSLFDDAEGGEAL
gb|ACA41261.1|         ------------------------------------
ref|ZP_02626812.1|     ------------------------------------
ref|XP_001701427.1|    ------------------------------------
sp|Q2M3V2|ANR43_HUMAN  ------------------------------------
ref|NP_664935.1|       NTKVIPKK----NKKSKGVVEGQLDLF---------
```

FIG. 40

```
gb|AAU83457.1|      --IKGKVVLIPFPFDDLSAEKVRPAVCLTEPIGPEHHVILAFITSQIPQKLLETDLVLDA
emb|CAJ70907.1|     -----KVVLVNFPFDDLSTSKVRPAVCLTNPIGSHSHVILAFISSRIPSDLLETDLIIDT
RAAC02339           MKMKHKIVLIPFPFDDLQSHKVRPALCLTDPISAHDHVVVAFISSQVPTHLLPTDIVLRA
ref|YP_183482.1|    MNLKGKFVLVPFPFTNLKATKLRPALVLYE---GKEDVVVAFVSSRIDTFDPGTDVRIET
ref|ZP_00514953.1|  ---KGDIVLVPFPFTDLSTTKLRPAVVLWVDL-SGIDVTVCFISSQNVNHVTPEEFVIET
ref|YP_322920.1|    ---KGDIVLVPFPFTDLTGTKLRPGLILWVDN-SGNDITLCFISSQDVTNLTSGEFVLDP
                       ..**: *** :*   *:**.: *    .: :.*::*:       :. : .

gb|AAU83457.1|      GQPDFALVGLNVSSTLRLHRLMTVTTSLILRELGELPFDMKTEVDKRLRKLFGV-----
emb|CAJ70907.1|     SHEGFSGTGLKVASTLRLHRLMTVTTSLCQRELGELSPKFLSEVNNKLKKLF------
RAAC02339           GTDAFAPTGLKVSSVIRLHRMVSMTTRIIRYELGHIADETRDLVESKLIQLFKLQHRLR
ref|YP_183482.1|    SHPQFRGIGLKVPSTIKLTKTATLHKGLLIGVLGELPEDLVQEVNSKL----------
ref|ZP_00514953.1|  TNSEFSKTGLKVTSKVRVSRMVTIERNLITRRLGKLDISLLNKLNDCLKRVFQL-----
ref|YP_322920.1|    SDAEFAGTGLKLISKVRVTRLVTLERRLITRRIGKLCVNQIQQLNLLMIQAFQL-----
                         **:: * ::: :: ::     :    :*.:  .    :: :
```

FIG. 41

```
ref|ZP_02432977.1|   --EKLKEITDRLEQGIAELFDSERYREYLKVMSKFHNYSFRNTVLIAMQKPDASLVAGFS
ref|ZP_02085861.1|   --EKLKEITDRLEQGIAELFDSERYREYLKVMSKFHNYSFRNTVLIAMQKPDASLVAGFS
ref|ZP_02207628.1|   --EKLKEITDRLEQGIAELFDSERYKEYLKVMSKFHNYSFRNTVLIAMQKPDASLVAGFS
ref|ZP_02429891.1|   --EKLKEITDRLEQGITELFDSERYKEYLRVMSKFHNYSFNNTLLIAMQKPDASLIAGFN
ref|ZP_01731985.1|   ---KTALAFQQLEQGLAELLESGDWQRYLKVQSEFHNYSFNNVLLILSQFPEASRVAGYQ
RAAC02340            MNEKVKAAMERLEHGLETLLSTEEWRKFLQFQAAFHHYSFSNTLLIMCQKPDATYVAGYN
                           *        :*: :*:    *:.:   :  :*:.  : **:***  *.:** * *:*: **:.

ref|ZP_02432977.1|   AWKNNFERNVMKGQKGIKIIAPSPYKTKQFMQKIDPHTQKPVIGKDGKPVTEEKEVTIPA
ref|ZP_02085861.1|   AWKNNFERNVMKGQKGIKIIAPSPYKIKQEMQKIDPHTQKPVIGKDGKPVTEEKEVTIPA
ref|ZP_02207628.1|   AWKNNFERNVMKGQKGIKIIAPSPYKIKQEMQKIDPHTQKPIIGKDGKPVTEEKEVTIPA
ref|ZP_02429891.1|   AWKNNFGRNVMKGQKGIKILAPSPFKIKKEMEKIDPQTQKPVIGKDGKPVTEEKEITIPA
ref|ZP_01731985.1|   HWQ-ELGRQVKKGSKSIKILAP-------LKCK---------IEKENDNGELEAKTGIFG
RAAC02340            TWR-ELGRYVKKGEHGIEIFAP-------LLKKKSNKADIPREESEETSQEEENKRIIYG
                      *: ::  * *  **.:.:*:*:**       *                 .:       * :  * .

ref|ZP_02432977.1|   YKVVSVFDVSQTEGKELPDIAVDE-LTGDVDRYKDFFAALEKTSPVPIAFENIEGGSHG-
ref|ZP_02085861.1|   YKVVSVFDVSQTEGKELPDIAVDE-LTGDVDRYKDFFAALEKTSPVPIAFENIEGGSHG-
ref|ZP_02207628.1|   YKVVSVFDVSQTEGKELPDIAIDE LPGDVDRYKDFFAALEKTSPVPIAFFNIEGGSHG-
ref|ZP_02429891.1|   FKMVSVFDVSQTEGKEIPNIAVDS-LTGDVERYKDVFAALEKTSPVPVGFEKIEGGAHG-
ref|ZP_01731985.1|   FRTVNIFDISQTQGEDLPERTSP--LTGDDDGLIDRLMAFSLNNNVPVFFKGLLGNANGC
RAAC02340            YRIVYVFDVSQTDGKPLPTVESPQIISGDSD-LYEKLLQVCP---YPVSEVVSLGSARG-
                     ::  * ::*:*: :*    :.**   :   ::  .    *:   *.:.* ref|ZP_02432977.1|   --YYHLEDKRIAINEG--MSELQTLKTAIHEIAHAKLHDIDLNAPKDEQQPHVDRRTREV
ref|ZP_02085861.1|   --YYHLEDKRIAINEG--MSELQTLKTAIHEIAHAKLHDIDLNAPKDEQQPHVDRRTREV
ref|ZP_02207628.1|   --YYHLEDKRIAINEG--MSELQTLKTAIHEIAHAKLHDIDLNAPKDEQQPHIDRRTREV
ref|ZP_02429891.1|   --YYHLEDKRIALDEG--MSELQTLKTLIHEIAHAKLHDIDLNAPLEDLENRPDRRTREV
ref|ZP_01731985.1|   CRYDALSGHPIEIVVDPLLPKQHQAKTLCHEIGHSLLHSR------TQYNNHIFRSKAEL
RAAC02340            -EFD-LETNQIKIVQT--LPEAHKAKTLIHEWAHGLLHTN------GPLN-PAHKPLIEL
                        :    *. :        :.:   :    **  **  .*.  **        :     : *:

ref|ZP_02432977.1|   EAESVAYTVCQHYGLDTSDYSFGYVAGWSSGRELS-ELKSSLETIRSAAAEIINSIDENL
ref|ZP_02085861.1|   EAESVAYTVCQHYGLDTSDYSFGYVAGWSSGRELS-ELKSSLETIRSAAAEIINSIDENL
ref|ZP_02207628.1|   EAESVAYTVCQHYGLDTSDYSFGYVAGWSSGRELS-ELKSSLETIRSAAAEIINSIDENL
ref|ZP_02429891.1|   QAESIAYTVCQHYGLDTSDYSFGYVAGWSAGRELA-ELKSSLETIRSTAAEIINSIDEHI
ref|ZP_01731985.1|   EAESVAFIVLNYFGIDSRDYSFPYVAGWQQGEDALENLRQSGMRIQKAANKVI-------
RAAC02340            EAESTAFVVSHALGLDTTDYSFAYIAGWS-GKEAVNALKACGTRIQQAANSILLALEDQA
                     :*** *: * :  *:*: **** *:***. *.:     *: .    *:..:*  .::

ref|ZP_02432977.1|   AELQKA-
ref|ZP_02085861.1|   AELQKA-
ref|ZP_02207628.1|   AELQKA-
ref|ZP_02429891.1|   AELQKA-
ref|ZP_01731985.1|   -------
RAAC02340            QDFKTAM
```

FIG. 42

```
ref|ZP_00231288.1|      ----------LEVVRIEQIIREAEEG-VDYIIRSPEDGAKIASRFIGRDDREVFFVMCL
ref|YP_001113884.1|     ---------------------------IIRCPEDVCGLVMEDLRDLDREHFLALLL
ref|YP_001213007.1|     -----------------LKIVKEASVLY-AARRISSPDDAAGFVRDFIEDADREKFLIICL
RAAC02341               MEVGRKSNMSSITVVRVELVKERSLEYEGSRLIRCAEDAANILRGYIGNADREMFVVMVL
ref|ZP_02596024.1|      -----------VDIVKLKMIKESSLLY-KERRVKSPEDASLLFRQFLDGADREYFIVLCL
ref|NP_150014.1|        --------MKKIDVVKVYVKKEQSLQT-RKDTTKKPEQVFEVVKNFLGEVDREYLIVIVL
                                                    :  .::    :    ***  :.  : * ref|ZP_00231288.1|      NTKNNVVAVHRCHVGSLNSSIVHPREVFKSAILNNVASVILAHQHPSGDIKPSMEDINVT
ref|YP_001113884.1|     NTKNQVLARETISIGTLNSSVVHPRELFKVAIRRSAASMILVHNHPSGDPTPSREDIVLT
ref|YP_001213007.1|     NTRNEPTAVHTVAVGTLNSSQVHPREVFKVALLANSAGIILAHNHPSGDPAPSREDIEIT
RAAC02341               SAKHIVNAINTVSLGILDSSIVHPREVFKPAILSNAASVIVGHNHPSGDPEPSPEDVAVT
ref|ZP_02596024.1|      DIKNQPTTINVCHIGSLNSSIVHPREVLKPAIISNAASIIVAHNHPSNDPTPSSEDLEVT
ref|NP_150014.1|        DVKNKINSISVASVGTLNSSIVHPREVFKTAILANGASIILAHNHPSGDTSPSKDDINIT
                         . ::      :       :* *: **::* *:  . *.:*: *:***.*   ** :*: :* ref|ZP_00231288.1|      KRLVEAGKLLGIEVLDHLIVNSDNSFTSLKER---
ref|YP_001113884.1|     KRLIEAGEIIGIDVLDHIIIG-DNKFTSLKSKGLI
ref|YP_001213007.1|     RRLKECGDLLGISVLDHIVIGSGGQYTSLLQKLLI
RAAC02341               RRLVDAGKILGIDVLDHIVIGDEGRFVSLKARELL
ref|ZP_02596024.1|      KRLTEAGKVVGIEVLDHLIVC-EESFVSLKEK---
ref|NP_150014.1|        TRIKECGVLMGIELLDHVILG-DEKFISLK-----
                         *:  :.*  ::**.:***:::      : **
```

FIG. 43

```
ref|ZP_01273840.1|        ----------------LNNVLRAISSKTTIPILTGLKMVVN--EDNIVLTGSNSDITIESVIN
ref|YP_001270615.1|       ----------------LNNVLRAISSKTTIPILTGLKMVVN--EDNIVLTGSNSDITIESVIN
ref|NP_783868.1|          MKFTINRSAFIKELNKVQRAISSKTTIPILTGLKLDVN--TDAITLTGSDADISIETTIP
ref|YP_805310.1|          MKFTITRSTFLKTLNDVSRAISTKTIPILTGLKIVLN--DSGLILTGSDADISIESRIN
ref|YP_803555.1|          MKFTIARNTFIKKLNAVQRAISSKTTIPILTGLKIEAE--EDRLILTGSNTDISIETTIS
RAAC02342                 MKATFRHGDLEKILRQLLRVVPNSTNKAVLKHVLIEAKREEDRVJFYASSEDMSLRRTLC
                                       *. : *.:...*. .:*. : :    . : : .*. *::: . :

ref|ZP_01273840.1|        ANDADNDLTIEDTGAIVLPARFFSDIVKKLPDKKVTIEVTSGFQADITSGSAKFQINGQD
ref|YP_001270615.1|       ANDADNDLTIEETGAIVLPARFFSDIVKKLPDKKVTIEVTSGFQADITSGSAKFQINGQD
ref|NP_783868.1|          ASDDNNTLVVEDAGSIVLPARFFSEIVKKLPEDTMTVNVVDGFQTQITSGAASFTINGLD
ref|YP_805310.1|          ATDENNDLQIGSTGEIVLPARFFSEIVKRLPESTMTLEVKDNFQTVITSGASEFTINGLD
ref|YP_803555.1|          TNDEEAHLNTESTGAVVLTARFFGDIVKKLPDNTMLLEVKDGFQTTITSGASEFKINGLD
RAAC02342                 VEATDSSVEIARSGSCLLPAKELYEVIKRANGPITVETTTD--RTVITFGKTKFELVGLQ
                            .    :   :  :*    :*.*:  :  :::*:     ..   ::  ** * :.* : * :

ref|ZP_01273840.1|        AENFPHLPEIETNKS-VTLPNDILKEVIRQTVIAVSKQESRPILAGVHMTLKDCILTAVA
ref|YP_001270615.1|       AENFPHLPEIETNKS-VTLPNDILKEVIRQTVIAVSKQESRPILAGVHMMLKDGVLTAVA
ref|NP_783868.1|          PENYPHLPEIDTTNT-ITLAGDVLKELIGQTVIAVSNQESRPILTGVHFILANGEFLAVA
ref|YP_805310.1|          ANNYPRLPEITADAA-LSVSADVLRQLINQTVIAVSNQESRPILTGVHLTITGDQLVAVA
ref|YP_803555.1|          ANNFPHLPEVDSQTT-ITLKADVFSEMINETVIAVSNQESRPILTGIHFTIEGNKLSAVA
RAAC02342                 PRLFQPYGDADDEVTTATVLAPELYRLIRRTSYAACKSQTRPILTGVQLTLADGHLSAVA
                              .. :       :      :  ::      : ..*  .*   *...:: ****:*::: : .. :   *** ref|ZP_01273840.1|        TDSHRLAQRKVVLENIDNGIDFDVIIPGKSMEELSGMI--SDVHEDVQMQVTENQVLFIF
ref|YP_001270615.1|       TDSHRLAQRKVVLENIDNGIDFDVIIPGKSMEELSGMI--SDVHEDVQMQVTENQVLFIF
ref|NP_783868.1|          TDSHRLSQRRIKLPEANN-ANYDVIIPGKSLTELSRMI--GDNNPDVQMRLSENQVLFVL
ref|YP_805310.1|          TDSHRLAQRSLTLPTASA-SDYDIIIPGKSLTELSRML--SDDVEKIEIRIAENQVLFVF
ref|YP_803555.1|          TDSHRLSQRVINLPEPIK-MPEDIIIPGKSLLELSRML--DDEIDTITLQISENQALFTF
RAAC02342                 TDALRLAQYTVSCEDVNG-EDRQLVIPAVLLDTLATALPASDDDEEVTFTLGTSSCTVSW
                          **: **:*   :           :::*.  :    *:      .*    : : .. .

ref|ZP_01273840.1|        GNTHFYSRL--LEGNYPETSQLIPQTADTTVELEAGTFLSSIERASLLSHESRNDVVKLS
ref|YP_001270615.1|       GNTHFYSRL--LEGNYPETSQLIPQTADTTVELEAGTFLSSIERASLLSHESRNDVVKTS
ref|NP_783868.1|          GNTSFYSRL--LEGNYPDTSRLTPKESNTTVEISAPALSAAIERASLLSHESRNNVVRFS
ref|YP_805310.1|          GQTAFYSRL--LEGNYPDTSRLIPTSSNTQAEFDAPALLASIQRASLLSHESSNNVVRLV
ref|YP_803555.1|          DETLFYSRL--LEGLYPDTSRLIPKESSTEMEFEAPELLASIERASLLSHAGRNNVVKLT
RAAC02342                 GDDAFHMALRGLEGTYPDTAKLIPERTAHRVVVERQALLTACERVAILSEADHQ---RAE
                           .:  *:    * *** **:*:.:***   :    ..   : :: :*.::**. . :

ref|ZP_01273840.1|        LKPSENLVRISGDSPDIGTVEEEVVTSALDGNDLEISFNPNYMKDALRSFG-QATIKISF
ref|YP_001270615.1|       LKPSENLVRISGDSPDIGTVEEEVVTSALDGNDLEISFNPNYMKDALRSFG-QATIKISF
ref|NP_783868.1|          VNPTDKTITIFGNSPDVGEVTEQLQPTDLSGDELEISFNPDYMKEALRSFG-QAMIKISF
ref|YP_805310.1|          LNIADQKATIYGNSPDVGNVEEVLSFNKLSGEDLEISFNPDYMKDALQGFG-QTAIEVDF
ref|YP_803555.1|          INAANKQAIISGDSPEVGNVEEEVVTKDIVGEDLEISFNPDYLKDALRSFG-HTSIKMAF
RAAC02342                 FRFTMSGLTVSATSTQYGHAEETLETIQGTKDDVELLCNVHYWIAALKALDGIAQVEIGL
                           .. :    :       : ..*.:  * * :        :::*:   * .*  **:.:.    :  :::   :

ref|ZP_01273840.1|        TSPLRPFTLVPTEDQ----------------------
ref|YP_001270615.1|       TSPLRPFTLVPTEDQ----------------------
ref|NP_783868.1|          TMALRPFTLVPTEEGENFIQLI---------------
ref|YP_805310.1|          TAPLRPFTLVPTEDK----------------------
ref|YP_803555.1|          TSALRPFTLVPTEDQ----------------------
RAAC02342                 NGPLQPCLLRPVGEEGVGLIATVARSSAPTETKRQAS
                           . .*:*  * *.  :
```

FIG. 44

```
ref|YP_429218.1|        ------------------------------VQRALEMAVRAAAMQVTPDSQAAGHPR
ref|YP_001112194.1|     ------------------------------AAKSAVMQVTKESQADGRPR
ref|YP_001112320.1|     ------------------------------ALALAARSAAGQVVPVSNASNNPR
RAAC02293               MKWILMALSLVVLQFWTHEQVLNLEMETVVYHRIVNAMVLASQDAVEDVIPSSTANGEPI
ref|ZP_01171099.1|      ------------------LNFTFDSTATRGLRDSLELATHDAGLQIYNEELVNGNIV
ref|ZP_02598174.1|      ------------------LTLNMNIATYAKSSKYLKEDLEVAVHDASLELKKDELANGKLV
                                                    * :  *    ::      .   . ..

ref|YP_429218.1|        INIVAANIAFRRELASNLGLDANTLAPLKGSAMKTRP-----------------------
ref|YP_001112194.1|     INTPNAQAVFQQQLAKNLGLDETTLNPLSGS-----------------------------
ref|YP_001112320.1|     VHADNAHSTFKKILAKNLGLDEVTLNPLPGS-----------------------------
RAAC02293               FDQTEAAQTFRMTLANNLGLDPNTLQPLSNSTFHVAPKILDEEFYDWSNT-TFPYHYVNS
ref|ZP_01171099.1|      FDQSEARRVLEESLKKNLLLDAS-LQPKPDSFFQDTVQTKFVDYLDDNNTPEFPTNYINE
ref|ZP_02598174.1|      FDPIKAKQTFKFSLKDNTGFQEG-TDYK---------ILEFQVLDQSNS-KFPVKYKAN
                         ..     ^   .:.   * .*   ::

ref|YP_429218.1|        --------------------------------------------
ref|YP_001112194.1|     --------------------------------------------
ref|YP_001112320.1|     --------------------------------------------
RAAC02293               AYGINETLDAPSMVVVVQFTMPSYAANVPPFTITVPMVQSYAGS
ref|ZP_01171099.1|      QYDTVDTVDGPATVVVLETTGPRY--------------------
ref|ZP_02598174.1|      TLKFQDTFQNPTLVAIIETTTKKY--------------------
```

FIG. 45

```
ref|ZP_02327783.1|    ----------------------------------------IKFKTLFLHNFKSHRDLE
ref|ZP_02846176.1|    ----------------------------------------IRLIQEQLINYAGIKDRT
ref|ZP_00235040.1|    SCRESIGNIFICANCEE-IDENTITIESPSITIVESGAPSMKIVFKQLTLENPKNHKNLV
ref|NP_623604.1|      ----------------------------------------MIIKSITLKNFKSHKNTI
RAAC02346             ----------------------------------------MKILSIQLENFRSFTEAS
ref|ZP_02082031.1|    ----------------------------------------MKIKGVTFTDFRNHKAPQ
                                                              : :    : ::  .

ref|ZP_02327783.1|    INFG-ELTKITGENTKGKSSILEAIPWLFYSVDMLG-----SKSDPTPINYEYDHTLVKL
ref|ZP_02846176.1|    ITFG-NVTNLSGKNGEGKSSIGGAPIWILFGKDLYGNDYTKDKYSPRPSNYKYDRVYASI
ref|ZP_00235040.1|    VDYE-QVTQISGKNGFGKTSIGEAVTWLLYGTDLLG-----TKIEPQPLG-TEEEVHVSL
ref|NP_623604.1|      INFNDKNTVIYGDNGTGKTSIGEAIAWCLTGANLFG----TENVTNKLVTIGKNEMSVTL
RAAC02346             FQFH-DITVISGHNGAGKSTLAEAVVWCLFGTDIAG----RQKQDEKLMRLGEKRMAVTV
ref|ZP_02082031.1|    SYTFGDISYITGHNGTGKTTMAHGICYALYGVSYYG-----EQKIERLMNEKATGTQVQL
                        :  :  *.*  **:::  .    :  .    *      :             .  :

ref|ZP_02327783.1|    HFA-VDGKDILLGRGIE-KGKATYYINEVPAKAKEYEELVKSLFDKDLFLSLYNPSYYFT
ref|ZP_02846176.1|    LLS-IDGTEYKFAREIDEKKKNNFYVNDIPKSATDFSAAVVALITQDEFMSLYFPAYFFG
ref|ZP_00235040.1|    LIN-ADGKDLLLTKKQK--KTAKYAINEVPRKATEFADMIDSLFEKNLFYSLYSPGYFFS
ref|NP_623604.1|      VIE-KDGKEYEITRSKK---KNEIEITINGVKSTQIDLYTQFVQDKDIFFTVFNPLYFTT
RAAC02346             TWL-IHGKSVVISRTRASRQGSTLLVNGKRAQPGQIEGWFGTVQE---FLSVFVPGYFSS
ref|ZP_02082031.1|    DFTDQNGTTHTLIRNRS-GDKTALLLDGYTVRQGDIDR---IFCDKETFLSMFNPTYLTE
                       .*.   : :          :           :           *  :::  * * ref|ZP_02327783.1|    LKWNEQRELLLRYVSAPANKEVFAQLPKQQAEKLG-------------------------
ref|ZP_02846176.1|    LKWTEQRELLMKGATAPLTKAVLKEIEKLYADKLE-------------------------
ref|ZP_00235040.1|    QHWQTQREQLLSYVTEPGEKEVLEEMNEIDRTLLS-------------------------
ref|NP_623604.1|      LAPRDAKAILYKVLPEVSNEEVFEKLSPEVAETLKKNGFNNANTFIEKQREILKDWEDGL
RAAC02346             LEPKEAKTVLSRCVPDIPKEDVLARMTSVHASMLA-------------------------
ref|ZP_02082031.1|    RLGEKGRPLILKYLQPVSANAVLEQMSETYREYLDGIDLNTFPPEAKLKEFRG-------
                                :    :     *:  .:          * ref|ZP_02327783.1|    ------------------ELVKKHSLADLEKIHRDNKNKKDKAYIAAQSRTKTLI-----
ref|ZP_02846176.1|    ------------------PLLKKNSLSDLESKHKQDKTRLEKAHTEAGGATKKLR-----
ref|ZP_00235040.1|    ------------------TELNKHLLDDLEAVNRETFKNSDKQYERASERVLTLK-----
ref|NP_623604.1|      LKSEGNIEILRQIINAKIPEMKSFDETQLKELEKKLMEFQKNQNIEIEKELAILK-----
RAAC02346             -----------------------RDQFVMGLDSIEFAMQKVRDEIKECEAERLRLEG---
ref|ZP_02082031.1|    -----------AVRQAEEQEAYLQGNIDSFEEASRTAEQKLSELYADKAAIEKKRKVL
                                           .  :.    .:

ref|ZP_02327783.1|    --EQLQLLPQSPPNLKN---IQDDYDRFLAEIKVIDSMLPKADENNGK--IIKLESQIEH
ref|ZP_02846176.1|    --EMLERMPAVEGELTE---LETQAEALRVEIAKEDAIVAAAWQTNTS--YRELESALFY
ref|ZP_00235040.1|    --EQLSNASEVNMDIKE---ITEQKDALIAERTAIELKEDKNVQLRND--YADAEQKINA
ref|NP_623604.1|      --EQYKNPPIEKPQLKDTSILQKTREELLQEYKQIQEQIKNLKPQYIT--CNKCGNKIDV
RAAC02346             --QCQAYQAVLRRGEPQ----PYVPSVTDEERARYEAAKRELMELEAS--QGNRKERLRD
ref|ZP_02082031.1|    SDKQFEGIEVEDLSIQRNMLLEKLSSVPKGENPKVTQLQEKIEELRHKPYVSKYTQAMAE
                          :                        .     *               .  . :

ref|ZP_02327783.1|    LKEQRDQIKEQIRELHN--EPIDD--RCRACGQTLQGEAKAAAEADKQRRVDQLIEEFNN
ref|ZP_02846176.1|    TQHEVDSSKAAWPALKD--EAIND--TCRTCAQPLQEDAIKAVIADKEKRIAAYRSKHSN
ref|ZP_00235040.1|    LKERILRKREEALNVRE--QKIEE--NCEYCGQTLQGDSIEHAIQYRKEHYNRLVTAGKI
ref|NP_623604.1|      TAKEKQLLLAKLQEIKE--KGTKT--AAELKAVIEENEKAEKEFKEKVNKYRKALEIKIK
RAAC02346             LYARRDSLGRAFRALRDSLPQADT--HCHTCGQPLPEDQAARILQEIAQKRKASLAKMKE
ref|ZP_02082031.1|    NAAEVKNLSERYKALVNRVKGLRPGAQCPACLMRITEQNLPEVRNRMLAELKSLAEQGKE
                                                 :  :         .   :

ref|ZP_02327783.1|    VIT---------------------------------------KRKELEAHLTQIEHI
ref|ZP_02846176.1|    LQS---------------------------------------IRDEAKAALAAAKWV
ref|ZP_00235040.1|    MVE---------------------------------------ELEASKARLAKLENP
ref|NP_623604.1|      RLE---------------------------------------NALNTNANKEQIQQI
RAAC02346             LYD---------------------------------------EGNQVQAEIAKLEAM
ref|ZP_02082031.1|    RVAQGKELAGMDYQSKTVFEQFKADDLKKLYEELKGLKTEAAGKTDGEELRAALDKVEEL
                                                                .*    :
``` continued →

FIG. 45 continued

```
ref|ZP_02327783.1|      ---------DVSKQREEVRELEVRLDQLDEVISNHKSREQLQG--QIDHAETDEAAILTS
ref|ZP_02846176.1|      ---------DVTERQANVRALEDQRDLITEKIRAHKDRARFEV--ELQQSEETEATTLIS
ref|ZP_00235040.1|      ---------EKNFDRVKYKEIDEKILELSGYIQSVGQTEKLHK--QIADAELEQQRIRKQ
ref|NP_623604.1|        ---------MQQIERLRFEERE-VISHNESVKALLRQKEEAKK--KLKEVEEDIKLAEQQ
RAAC02346               PDYDAPHPELVEFVQTMEARLKDEHYREVAYAAQLRAYEQAKG--HFTQAQEDLQATAEH
ref|ZP_02082031.1|      QK-------YGNLDEDEYTELNCLSAELAGIEAQIQAVQDMCDERKLEDAYAQQEVCKGQ
                                                             .: .

ref|ZP_02327783.1|      LNESIFIIDAIKAFAAKEAEMMADKVQALFTTLSLRLFKTNKTDGEIKPDFEIEMDGKPY
ref|ZP_02846176.1|      LRESTLILDAIKAYKAKEAELQAAEIQSNFTRLSVRLFKYVKSNDAYEPDFSIQMDGKDY
ref|ZP_00235040.1|      RNKSQSIVEAIKRFKAKRSDLMVGKVNGLFENITIKLYEVLKN-GTEKPTFEVEWQQKPY
ref|NP_623604.1|        INEVKTLIEYAKAFNAKKLELEATEINKYLNKVSLQLWKIVQSTGEIKDDFKILYDGKEF
RAAC02346               LEGLKQRLQALQEFRFEYLRAQHEQLNGLFRHVAIHLMDVNKETGEVREAFRIEWKGRPY
ref|ZP_02082031.1|      ILKYKNVISALGEFICKRTEIAVSSLQ--MPNVKIKLFDVVRSTGEVINVFKFTYKGRDY
                        :.     :   :       .::    :  : ::*  .  .       *  . . : :

ref|ZP_02327783.1|      RKLSLSESIRAGLELRDVLSQQSGIIAPCMVDNAESITQFKQP--NGQLIVSRV------
ref|ZP_02846176.1|      AFLSTGEKIAAGLELAEVLHKQSGIIAPVFIDN---------------------------
ref|ZP_00235040.1|      SKLSTAEKIIAGIEFANALSLKAETIIPLFADNAESVIELPKP--TGQLITATVKKTKFT
ref|NP_623604.1|        NILSYSERIKAGLEIANLIMGLTKIKFPIFIDNAESI-----------------------
RAAC02346               RLLSYSEKIRCDIEIGRALAQAKGEAMPVYVDNAESVQRLMDETFSGQVIAAYVADGPLT
ref|ZP_02082031.1|      STLSLSEKTLAGIEITAMIRKITGIDCPICVDNTESIAAFNSVSMPSQTLLLRFVKGQPL
                        ** .*    ..:*:   :        *   ** ref|ZP_02327783.1|      ----------
ref|ZP_02846176.1|      ----------
ref|ZP_00235040.1|      VKGVSE----
ref|NP_623604.1|        ----------
RAAC02346               VSKMPEAQGA
ref|ZP_02082031.1|      TVQSRNRA--
```

FIG. 46

```
ref|YP_113896.1|        ------------------------------------PWLVNVAKG-DLKLVGVEA
RAAC02347               MRPSTLYYNGVQMNPVRGGPSMEDKKVLKTVIRNGVTFDNYPVYVSEAYG-DSYLMKHEE
ref|XP_001383704.2|     ----------------------NKSVPSFIIRKPINMNGYDYSVFTNYPTEIDLQHGEH
ref|XP_001664270.1|     --------------------------------------SDSSG-DDHLMKPEE
ref|XP_761114.1|        -------------------------KEIADRGAKADKEWTELFKAYG-EKYPNEHAE
ref|XP_001015776.2|     -----------------------------VQRNGDLESKKISKVVLKSG-ITFLDIQIK ref|YP_113896.1|        VTSEQAACRTAEWEKAADRAPAGLIG---PTQLDLPATAPAEERLMS----------
RAAC02347               LAEQIASCIPQAWRKAA-RFDCKLIA---EFQDDMDETSEDEQRLLSKFERWMSRHN
ref|XP_001383704.2|     LPPAIKESQIKSWESAERISTNVIFGNSSESEDDIDELDEDEITEASRSSKVNSRKN
ref|XP_001664270.1|     LDLRSNFFDKIESTKRQSGEPAPQFD--CNAGMRLSDSSDDDDQAEEPIPSSIQK--
ref|XP_761114.1|        IARRIAGKLPEGWEKS------------------------------------
ref|XP_001015776.2|     VQRDLKLGYTENFRLTN-REGVEMFE    NDIPFLQNNCYLLASMGEEYDSTS-
                        :
```

FIG. 47

```
ref|YP_503850.1|       -KISKKNYDLVFKEAFSIFDNRSLAFLGID-LPPTISFLVTEIPEVETTDDMMDLNFRLE
ref|YP_517477.1|       ---ISYHNNDILMKVLAEQFKNKTLDVFGIK-TAKIKDLIPSVHPAVEANETRNDIIFLLE
ref|YP_001568284.1|    -----------------------------------IISVKPIDIPVINVSNQNPDFVFELE
ref|NP_783815.1|       ------------------------------DTKIIAPANTELKTIDIKTNFTDYTFYTE
ref|YP_149134.1|       --ISHHAKDILFKSLSALYQNQALDVYGLHGLPRIKALLPNEFPSVRADERRADTVFLLE
RAAC02289              MRIARSGNDIVAKIILTNALPGEVLSVTGTH-DAHVVRALPTELPTVEVRQEFTDIMLELA
                                                           :         :     *   :

ref|YP_503850.1|       DGSILHLEEEMNLSKRD-LIRFAHYDLRLFRYYD------APVHTVVLTPADSSSGTKVL
ref|YP_517477.1|       DDTLLHLEFQTTAGEQD-LKRFLYYDARLVRRQE------RKVHTIVIYSGRIEQARERL
ref|YP_001568284.1|    DNSLLHLEFQTTWKKAD-LLRFAQYDIALYQKER------RRINTVVMYSGKYESAESEL
ref|NP_783815.1|       NDDYLHFEFQTTNKEED-INRFLFYCASLFYKYG------KKVNTLVVYSSDIKKSKTKV
ref|YP_149134.1|       DDSILLLEYESNERFLDNHLKYLDYACRILHTYYQQEKRIRPIRIVVTYTSDVTTARERL
RAAC02289              DGRLLHLEFQTT-REPN-LYRFGTYDWAMAERYK------RPIRTVILYTRDVTEAPSEL
                       :.  * :*  :   :    ::  *    :                :. :::  .    :

ref|YP_503850.1|       DIGSLQYNVLQIVLSDRDGDALLSQMRAALEKGEPVNE----LELIFLPLMKSKLTKIELL
ref|YP_517477.1|       ECGSILYQVENIYMKHYNGDQEYNRLKIIKIDNHQLLSETDTLKLIFLPLMKSEQKEEELA
ref|YP_001568284.1|    DMGSNKYKVQQTFMTKYDGIKRYEEIKEKIEKEEELTDKDLMDLVFLPLMRNEKSEEEVT
ref|NP_783815.1|       DAGSLKYEIKAFYMSSLNGDEEYNNLKTKIDKGEDLTKEEILSLTFIPLMDSKEDKSTRT
ref|YP_149134.1|       DAGDVFLSSKAVLLGEFNGDAIFHAIEEKVHNGEPLTPEETMKLILVPLMHTRFDRQTMI
RAAC02289              DAGSMRYAVENVYLGHMDGDGALETVKRHLAAHEWTEEDRVRLAFAFHMRFERRTREEAF
                       : *.        .  :  *       :. :   :        .  : . .

ref|YP_503850.1|       RRTIDIEKELPEKDLRNKVRELTLILADKIVDQKILDELWEELRMFKVVKYAEEKGMEKG
ref|YP_517477.1|       IQAAELAKAAPDEKTKLFAIAALIVITDKIMSESNKRKLLEVLKMTQIEQWIREEGRQE-
ref|YP_001568284.1|    KDVFELAIKIPDEDKKEAVIGSLLGFSDNYVRDEYINELKEVIRMTKIGTSLFEEGVE--
ref|NP_783815.1|       IKSIELAEKMEENNTKLQCITLLYAFLEKFGDAKSKKKFKEVFSMTEIGRMIVEESIEKG
ref|YP_149134.1|       EKTIELAKAIGDEPKQLHIIAGVLTATDKFIDRSYAEKVKEWIKMNKVFRLLVEELEQEK
RAAC02289              GEIVEVVQRVPDVHEQNYLAALILGFSGRVMADEQKEQLRRVLEMTDLLRELEREFEEKG
                        :                  :   :            .       :. . :  * .:    .:  :

ref|YP_503850.1|       --------LEKGLEKGIKKGMEKGKKQERETVAKNMLSLGIEDELIIKATGLDQSIIDKL
ref|YP_517477.1|       ----------------GELKGRRDEKRETAQTMLNLGMSPELIAKAPKLPLEEILEM
ref|YP_001568284.1|    ------------------------EGEKELTIKILNKRFGRRLTEEIKDRIREADKKTTDYT
ref|NP_783815.1|       RAEGIKKGIEEGIKKGRTEGKTEGKSEILIKQLTKKF-KKVPEEYIQKIKTLSIDTIDII
ref|YP_149134.1|       ---------------------EEMLKKVMQEKEQAVQRAIQEKEQAVQRVIQEKEQAVQRA
RAAC02289              ------------IQKGLQQGLQQGELQKAREIAHRLLRKGASVQEVVEITGLSSKDVEEI
                                                           :          .    . :

ref|YP_503850.1|       KKSL------
ref|YP_517477.1|       ----------
ref|YP_001568284.1|    GDNL------
ref|NP_783815.1|       ALEIFDMEDIK
ref|YP_149134.1|       IQ--------
RAAC02289              RQNLH-----
```

FIG. 48

```
ref|NP_607899.1|    ------------------------------------------------------------
ref|NP_269831.1|    SINGLE-STRANDDNA-BINDINGPRTEINSTREPTCCCUSPYGENESMGASREFYPSIN
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    GLE-STRANDDNA-BINDINGPRTEINSTREPTCCCUSPYGENESMGASREFYPSINGLE
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    -STRANDDNA-BINDINGPRTEINSTREPTCCCUSPYGENESMGASREFYPSINGLE-ST
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    RANDDDNA-BINDINGPRTEINSTREPTCCCUSPYGENESMGASSPPSSBSTRPSINGLE-
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    STRANDEDDNA-BINDINGPRTEINSSBHELIX-DESTABILIZINGPRTEINSPPSSBS
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    TRPSINGLE-STRANDEDDNA-BINDINGPRTEINSSBHELIX-DESTABILIZINGPRT
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    EINSPQXASSBSTRPSINGLE-STRANDEDDNA-BINDINGPRTEINSSBHELIX-DEST
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    ABILIZINGPRTEINGBAAKPUTATIVESINGLESTRANDBINDINGPRTEIN-PHAGEA
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------
``` continued →

FIG. 48 continued

```
ref|NP_607899.1|    ------------------------------------------------------------
ref|NP_269831.1|    SSCIATEDSTREPTCCCUSPYGENESMGASGBAAMPUTATIVESINGLESTRANDDNABI
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    NDINGPRTEINSTREPTCCCUSPYGENESMGASDBBACPUTATIVESINGLESTRANDBI
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    NDINGPRTEINPHAGEASSCIATEDSTREPTCCCUSPYGENESSSI-GBAATPHAGESIN
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    GLE-STRANDDNABINDINGPRTEINSTREPTCCCUSPYGENESMGASGBAAXPHAGESI
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    NGLE-STRANDDNABINDINGPRTEINSTREPTCCCUSPYGENESMGASGBAAZPHAGES
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    INGLE-STRANDDNABINDINGPRTEINSTREPTCCCUSPYGENESMGASGBABFSINGL
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    ESTRANDBINDINGPRTEINSTREPTCCCUSPYGENESMGASGBABFSINGLESTRANDB
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ------------------------------------------------------------
ref|NP_269831.1|    INDINGPRTEINSTREPTCCCUSPYGENESMGASGBABFSINGLESTRANDBINDINGPR
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------
``` continued →

FIG. 48 continued

```
ref|NP_607899.1|    ------------------------------------------------------------
ref|NP_269831.1|    TEINSTREPTCCCUSPYGENESMGASGBABFSINGLESTRANDBINDINGPRTEINSTRE
gb|AAF98351.1|      ------------------------------------------------------------
ref|ZP_01171110.1|  ------------------------------------------------------------
ref|XP_414088.2|    ------------------------------------------------------------
RAAC02348           ------------------------------------------------------------ ref|NP_607899.1|    ----------------------------------------------------GAPSVTEV
ref|NP_269831.1|    PTCCCUSPYGENESMGASSCRESIGNIFICANCEIDENTITIESPSITIVESGAPSVTEV
gb|AAF98351.1|      --------------------------------------------------------VTEV
ref|ZP_01171110.1|  --------------------------------------------------------VTEV
ref|XP_414088.2|    ------------------------------------------------------------
RAAC02348           ------------------------------------------------------MAEV ref|NP_607899.1|    VADNFQMLESRATREGGSTGSFNGGFNNNTSSSNSYSAPAQQTPNFGRDDSPFGNSNPMD
ref|NP_269831.1|    VADNFQMLESRATREGGSTGSFNGGFNNNTSSSNSYSAPAQQTPNFGRDDSPFGNSNPMD
gb|AAF98351.1|      VADNFQMLESRATREGGSTGSFNGGFNNNTSSSNSYSAPAQQTPNFGRDDSPFGNSNPMD
ref|ZP_01171110.1|  IARYVQFLDSKKNNQSQEQRRPES--NNTPSGRNSNNNPYAD-PYFEGEP----------
ref|XP_414088.2|    -----KYAEEGEGKQSEEEAKASA-----KIKKNSAPLPAEQ-P----------------
RAAC02348           VAEGVRFLDRGEGNQSAKSASAAP-----PVKNNTSPAPSKQ-PDFGPYDDPFADDLPPG
                         :    .:. .             *:     *   : * ref|NP_607899.1|    ISDDDLPF
ref|NP_269831.1|    ISDDDLPF
gb|AAF98351.1|      ISDDDLPF
ref|ZP_01171110.1|  ISDDDLPF
ref|XP_414088.2|    --------
RAAC02348           FEED-LPF
```

FIG. 49

```
ref|YP_001038860.1|        ---------------------------IEKFQMVVQKTLNEGHCYDIIPGT-SKPSLLK
ref|YP_001396671.1|        -----------------MEIGEVRNTLGKIAQFQSIIQKTLKNGHCYGEIGGV-TKPTLLK
ref|YP_001254879.1|        ---------------------------QKIATFQAVIQKNLKDGHDFGVVAGAGSKPTLLK
ref|YP_754926.1|           ---------------------------KQRLELLQEFVKEMMIPGQDYGIVPGV SKPSLFK
ref|YP_001396310.1|        -----------ISIVPDFAITLNDAKNRVELLQSFVKEMMIINIDYGFIPNC-SKPSLFK
RAAC02349                  MALPERQLPRAYGAGVNMVMDFGALRQRLEELRQFVKEYMVPGEDYGIIG-D-SKPTLFK
                                                      :  ::  .:::  :   . *:. :     :**:*:* ref|YP_001038860.1|        PGAEKILVLLGLTS-EYEIIEKIENYEKGIFA-YTVRCILS--KNGKKVTEGLGSCNSKE
ref|YP_001396671.1|        PGAEKILMLMGLTS-EYNIIEKIEDYDKGIFA-YTIKCILR--KNGQKITEGVGSCNSKE
ref|YP_001254879.1|        PGGEKICMMFGLNP-EYEFLERTEDYKDGFFA-YNIKCTLY--RNGNPVSQGVGNCNSME
ref|YP_754926.1|           PGAEKLTDIFGFSK-QVEILNRTENWENGLFN-YEVKVSLINKRNQLIEAEGIGCCNSKE
ref|YP_001396310.1|        SGAEKLCDIFGFSK-KIEILNRVEDWEKALFH-YEIKTILINKKTGLIEAEGIGSCNNRE
RAAC02349                  PGAEKLCDVYGLSAGEAHIEFTRDDTKTPIYISYRVSLPLISRIDGKIIMVGVGSANSWE
                           .*.**:  :  *:.    : .:   ::  . ::    *  : *        *:* .*. * ref|YP_001038860.1|        DKYRWRWVSEKDLPPNVDKDMLKSKTNEYG---QKLYRTENDETFTQANTILKIAKKRAQ
ref|YP_001396671.1|        DKYRWRWVKEDDLPMGIDKDAVKSKVDNYG---HTKYKVENDDICSQANTILKMAKKRAQ
ref|YP_001254879.1|        KKYRY--INVDAVPDGIDPSTVEKVTTRYG---TVKYKIPNPHIADLVNTTLKMAKKRAF
ref|YP_754926.1|           KRYRS-----------------QDPYN---------------------TVNTVLKMAKKRAL
ref|YP_001396310.1|        RKYKN-----------------QDGYS---------------------IVNNILKMAKKRAF
RAAC02349                  KKYRWRWVTERELPPDLPKETLKQATFDGKYGSYIKYRIPNDEIDDLDNTLLKMAKKRAL
                            :*:                   .                       *.::*** ref|YP_001038860.1|        IDAVLTVAALSEIFTQDVEDMQEF---LQNEQLETMKAEEAVNVKVTFGKHKGKTLGEIY
ref|YP_001396671.1|        VDATLTVASLSEIFTQDIEDMAQF···QERE ... ... ... ... ---------
ref|YP_001254879.1|        IDAVLQVASLSDVFTQDLEEMQE-------------------------------------
ref|YP_754926.1|           IDAVLSATRSSGLFTQDVEDLDISESWVRSPQPQATKIVRGVKPD-SLSVANITQPQLRK
ref|YP_001396310.1|        IDAVLSATRSSGLFTQDMED----------------------------------------
RAAC02349                  IDAVLSATRSSALFTQDIEDLED----LTIRQPESVDRRQRTQPDRSTGSPDISQAQKNL
                           :**.*  .:   * :****:*:

ref|YP_001038860.1|        SQAPDYVQWLAQNARNDVLRKAANMVMNGKGNESQQEAQRSEDL--------
ref|YP_001396671.1|        ------------------------------------------------------------
ref|YP_001254879.1|        ------------------------------------------------------------
ref|YP_754926.1|           VQALAEAIGMTPHQLQALIQDMFRVNHTTRLSKNQASALTQHILS------
ref|YP_001396310.1|        ------------------------------------------------------------
RAAC02349                  ILRKAQERGMDTEALNAFVLQATGKGELDSLTKQEASKLIDLLTSGKPRER
```

FIG. 50

```
emb|CAJ73677.1|       ------------------MTNYNFGEILLLKFPYSDGKGDAKRPVVVLAQTDL-EDIVTAKVTSM
emb|CAJ73386.1|       --------------------GEIILVRFPHTDLQDISKRPALILYDSGD-QDILIARITTQ
ref|YP_001655174.1|   ------PQKTKVYMTIIKGGEFWVAKILFTDGTSSKKRPVLILWVDG--DDVVVTAVTSA
RAAC03270             MPFTMKPSDTYWNLMNVRRGQIYLMKVQFSDLSGEKIRPVVVIGTDRVDDDVTVVFVTSS
emb|CAJ74660.1|       -----------------------MQYPFSGVSVQKVRPAVVVNAPEVSHDLVVPLTSK
ref|ZP_00516046.1|    ---------------MANYWKNDVILVRYPFSDLSNSKIRPAIIVSSPHTSQDVLITPLTSK
                                                :  .:.      **.:::       .*:   . :*:

emb|CAJ73677.1|       -EQRGEYDIAIDAWKDVGLLYPSVVRIDKLATLSKQRVEKRFGTLVGSYKPEIISRIK--
emb|CAJ73386.1|       -EYTTGTDYKIVEWKSCGLVESFIRISKQATIEKKYVIKPLGTLAEAELNAVKSIIKN-
ref|YP_001655174.1|   -MPRTQTDILLKDWANSGLRVPSTVRLSRLDCLEKNLLLAKLGRISNEDAVYLLRAWDDY
RAAC03270             -PPRLRYDVQITEWSVAGLLKPSTVRASKFLTVHKGRFLKPLGTLTDSDLQAVMTAVRSY
emb|CAJ74660.1|       TTSLLKGEFVLTDWTLAGLNVVTAVKRG-IYTVHQSLIIKRLGKLSHADSQKIEVALKEW
ref|ZP_00516046.1|    TQLLLEGEFILSDWKKAGLNVETAVKRG-IYTIYQGLILKKVGKLVDADTTKLEQSLRQW
                       :  : *    **    : ::.    : :  . .* :       :

emb|CAJ73677.1|       --
emb|CAJ73386.1|       --
ref|YP_001655174.1|   I-
RAAC03270             LL
emb|CAJ74660.1|       L-
ref|ZP_00516046.1|    L-
```

FIG. 51

```
sp|P26545|VE2_HPV5B      -STTRSRSTSVGKTRALTSRSRS-RGRSPSTCRRGG-----GRSPRRRSRSPSTYSSCTTQR
ref|NP_041368.1|         -STTRSRSTSLTKTRALTSRSRS-RGRSPTTCRRGG----GRSPRRRSRSPSTSSSCTTQR
ref|XP_001371550.1|      -SRTRSPARRGGRSRSRTPARRGGRSRSRTPARRGGRSRSRTPARRGRS----RSRTPAR
sp|P36786|VE2_HPV19      RSRSKSKSRSRSRSRSLSSNRRS-RSKSR----RKAS-----TTRGRGRGSPTATSDQSSR
RAAC03271                MSRTRSTATNAGKKAARSPFTHG-CAESRSRQRKPN----CTRRGHGSATYTPQNGSPPP
ref|XP_001131003.1|      -TRERARPSPPPESAARARVTHK-AADPRPGVSRAT----TAREQRGETHGAPYAPAPPP
                          :  ::  .    .. : :    :    .   .     :         :   :.        .

sp|P26545|VE2_HPV5B      SQRARAESPTTRGARGSRG--SRGGSRGGRL------RRRGRSSSSSS----
ref|NP_041368.1|         SQRARAESSTTRGARGSRG--SRGGSRGGRG------RRRGRSSSSSS----
ref|XP_001371550.1|      RGRTRSRTPARRGRSRTRSPVRRGRSHSRTP------QRRGRSGSSSER---
sp|P36786|VE2_HPV19      SPSATSSTTSLSRSRGSSRVGRSRGG-RSRVG------RSRGRGKRSR-----
RAAC03271                NSPSLASRRASRGACQKAWTHWHGDVSAKQCSIGFGKNTRGMSASSASRPSG
ref|XP_001131003.1|      -PPPRQPKRSERTR-------HRGA--------------------------
                          .     :  *             : *
```

FIG. 52

```
ref|YP_941474.2|       ------------------------------------------------------------
gb|AAZ42391.1|         ------------------------------------------------------------
prf||2123261AD         ------------------------------------------------------------
ref|NP_498368.2|       ------------------------------------------------------------
RAAC02294              MCSRLRDSRLRPRKALCRAADGARGRSSRMRSAIIFALMFFFILSWNYQPYMDVINGARL
ref|ZP_01171098.1|     ---------------------------------------------FTPFFVYLDSLHR ref|YP_941474.2|       ----------VSEAAFRQYSKTKDPETLVQYIATMLSSSSNHVVING-ITMR--SGSP-I
gb|AAZ42391.1|         ----------VSEAAFRQYSKTKDPETLVQYIATMLSSSSNHVIING-ITMR--SGSP-I
prf||2123261AD         ----------SHMKKVIVFILLY-P--FLLLWNVIISEKYLDFIFGG-FVISYIKRVPWA
ref|NP_498368.2|       ----------SHMKKVIVFILLY-P--FLLLWNVIISEKYLDFIFGG-FVISYIKRVPWA
RAAC02294              EYLQAVAETAISEAKIKGYFSATDLSNIQQAVATHLGYPVSEVQVQG-TTLPTTRGNP-I
ref|ZP_01171098.1|     AVVALVLQQGLKEAAIEGYFSQEIVEGMKDTLEQDYKFERNLIEITTPDSSPQTRGEY-L
                                      .  :              :               . .

ref|YP_941474.2|       DLEEYVPLAVTF-YVMA-----------------------
gb|AAZ42391.1|         DLEEYVPLAVTF-YVMA-----------------------
prf| 2123261AD         SLSKFQIISYVFTFSVTLVTN-------------------
ref|NP_498368.2|       SLSKFQIISYVFTFSVTLVTN-------------------
RAAC02294              DIQISIPTHINL-FSMAPASNQATLTAYESADSEALNPS
ref|ZP_01171098.1|     EVEISVPRGPMFILNIFNQGP-------------------
                       . :.                :      :
```

FIG. 53

```
ref|YP_430185.1|       ------------------------------------------------------------
emb|CAO81523.1|        ------------------------------------------------------------
ref|YP_001233893.1|    ------------------------------------------------------------
ref|YP_001603689.1|    ------------------------------------------------------------
ref|YP_719187.1|       ------------------------------------------------------------
RAAC02353              MNEVNTMENLRAVYVNTFAEGSRSTDPIQLSVDELKMAARGWKRAKTVTHVHLLGMQQKL ref|YP_430185.1|       ------------------------------PASLVERGYVEDLNAYLGQTLRLRVIELDRSKNKV
emb|CAO81523.1|        ------------------------------PASLVERGYVEDLNAYLGQTLRLRVIELDRSKNKV
ref|YP_001233893.1|    ------------------------------------------------DTFDLYIERYEDKDGSI
ref|YP_001603689.1|    ------------------------------------------------------EDRDGSI
ref|YP_719187.1|       ------------------------------------------------------DAVEDGFGET
RAAC02353              VDGTTRDILVGDIGPAKVMLPVDPEYSALEDGEDPMSLTDRWICGIVEDFDLQDEGDSTI ref|YP_430185.1|       VLSRKAILEEEYEKQR-QATWNSLEVGQVRKGIVRRLTNFGAFVDLGGVDGLLHVSEISW
emb|CAO81523.1|        -------LEEMREQERKETALAKLKVGDIVKGKVLRMTTFGAFIDLGGIEGLMHVSETSW
ref|YP_001233893.1|    VLSR----EKARREEAWTALERAYEQQARVNGVIHGRVKGGFTVDLGGATAFLPGSQVDI
ref|YP_001603689.1|    VLSR----EKARREEAWTNLEKAFEGNQRVNGTIYGRVKGGFTVDLGGAMAFLPGSQVDI
ref|YP_719187.1|       KLSR----EKAVRQESWIDLEKAYEEQATVIGLINGKVKGGFTVELNGVRAFLPGSLVDT
RAAC02353              LLNR----KKGLERLRELNAERVSKPGNRAIGVIVGIRRGAYVLNVGGYTALMPKAWYDW
                           ::  ..               :    *  :    . ::: .*  .::   :   .

ref|YP_430185.1|       GRVEHPRDALSEGQEIEVKILGIDREEGKVSLGRKQLLPNP----WDTAAERYPVGTIVE
emb|CAO81523.1|        QHIVRPQDELKKGQEIEVKILDIKGE--KIALSRKVLLEDP----FEVAMKELHEGDIIN
ref|YP_001233893.1|    RPVRDVTPLMGVQQ--PFQLKMDRARGNIVVSRRAVLEETRAEQRSELIQGLKEGQILD
ref|YP_001603689.1|    RPVRDVTPLMGVPQ--PFQILKMDRARGNIVVSRRAVLE---------------------
ref|YP_719187.1|       RPTREADHLLGKEQ--EFKVIKLDQKRNNVVVSRRAVIESENSQEREEILANLAEGSEVK
RAAC02353              DDSKRDQGTIGEEFPVQIQPSKVEDR---IVVSRCHLMENP----NVPSSLRFDRGTILR
                           :             .:   :.       : :.*     ::

ref|YP_430185.1|       GKILRLAP--------FGAFVEVEPGIEGLVHISQLA-DRHVDKPEDVVSIGDIIPVKVL
emb|CAO81523.1|        CRVLRLHN--------FGAFAELKPGVEGLIPISEMSRNRNISHPRDIVKEGDWVQVQIL
ref|YP_001233893.1|    GVVKNITD--------YGAFVDLG-GVDGLLHVTDIA-WRRINHPAEALTI---------
ref|YP_001603689.1|    ------------------------------------------------------------
ref|YP_719187.1|       GTVKNLTD--------YGAFVDLG-GVDGLLHITDMA-WKRVKHPGEIVSVGDFTVKVL
RAAC02353              ATVAFIRNGLIRAEVYPGFLVSVDPVILRQIPKPGDRITVRILGQNKNGYYGMMVDHQPQ ref|YP_430185.1|       G----
emb|CAO81523.1|        -----
ref|YP_001233893.1|    -----
ref|YP_001603689.1|    -----
ref|YP_719187.1|       KFDKD
RAAC02353              SVG--
```

FIG. 54

```
ref|YP_001251565.1|      ------------------PVYIPQDVRVGHTFVVCTTRVGKTRLASILINQDIRNGD--
ref|YP_126374.1|         ------------------PVYIPQDVRVGHTFVVGTTRVGKTRLASILINQDIRNGD--
ref|YP_123382.1|         ------------------PVYIPQDVRVGHTFVVGTTRVGKTRLASILINQDIRNGD--
ref|YP_001251158.1|      ------------------VYIPQEVRVGHTFVVGTTRVGKTRLASILINQDIRNGD--
RAAC02354                MVTHMLTDIKLERHAVPYAPVW_PGRERTGNVLVEGGPGTGKTYCLKTMLHQDIQAMVDG
ref|YP_001438903.1|      --------------------------IILEDVTGAGKTEAALVLAHRLMAAGQAR
                                                   ::  . .  .***     :  ::  :

ref|YP_001251565.1|      -----AVIVVDPKGDQDLVRDMMAACKVSGRTEDFKIVH--LGFPEQSAQYNPLKNFDQIS
ref|YP_126374.1|         -----AVIVVDPKGDQDLVRDMMAACKVSGRTEDFKIVH--LGFPEQSAQYNPLKNFDQIS
ref|YP_123382.1|         -----AVIVVDPKGDQDLVRDMKAACKVSGRTEDFKIVH--LGFPEQSAQYNPLKNFDQIS
ref|YP_001251158.1|      -----AVTVVDPKGDLDLVRDMYSACKASGRLHDFRVVH--LGFPELSAHYNPLKNYDQVS
RAAC02354                QQDCRMIVISPEGSMCDIEDCTSRLQVDWIKIYSRALH--VSSPYEKAFTSALRNLLMVS
ref|YP_001438903.1|      ----GLYIGLP--TMATANAMYARMSQAWLRLYREGSHPSLVLAHSARKLSAGFNASIWV
                              :  :  *        .   :    .     *  :    .    ..    * ref|YP_001251565.1|      -EVATRITDAISAE---------------------------------------------
ref|YP_126374.1|         -EVATRITDAISAE---------------------------------------------
ref|YP_123382.1|         -EVATRITDAISAE---------------------------------------------
ref|YP_001251158.1|      -EVATRVTDAIQAE---------------------------------------------
RAAC02354                PDDSQSTCDRVLAEYGLLKPFLYCSRQNTKIVSLYTGYQFTDTFTGAAFVHYLACNMSKI
ref|YP_001438903.1|      HELLPNDSGDEAAAYFGCAAWFAQSPKKALLAETGVGTLDQAMMAVMAFKH---QNLHLL
                            :       ,      * ref|YP_001251565.1|      ------------------------------------------------------------
ref|YP_126374.1|         ------------------------------------------------------------
ref|YP_123382.1|         ------------------------------------------------------------
ref|YP_001251158.1|      ------------------------------------------------------------
RAAC02354                TMKPTILYVDELHRYAAYAPHAVAKLFECGAEHGISLIAAVQSTEQLNTAESPCLSELVN
ref|YP_001438903.1|      GLNDKVLIADEIHSYDAYMSHVVEKLVETRARYGN---ATILLSATLSQAQRDRLIAAFY ref|YP_001251565.1|      ------------------------------------------------------
ref|YP_126374.1|         ------------------------------------------------------
ref|YP_123382.1|         ------------------------------------------------------
ref|YP_001251158.1|      ------------------------------------------------------
RAAC02354                RNTRFIIVKMRTSEDRDTLRLAPNQALWITSTTRHVIEVSPQFRN
ref|YP_001438903.1|      KG--------LNTTRESPRLGPDDYPWIT---------------
```

FIG. 55

```
ref|ZP_02602342.1|  ------------------------------------------------------
ref|ZP_02597242.1|  ------------------------------------------------------
ref|ZP_02524501.1|  ------------------------------------------------------
gb|ACA42232.1|      ------------------------------------------------------
ref|ZP_02758276.1|  ------------------------------------------------------
RAAC02355           MYALAYWRAKRKEHRRMPEVPALVRVSIAHSTWFMVVIGAIGAFALYRSVFRALGRMAQL ref|ZP_02602342.1|  ------VEIGPHIEHKEMVRIKGKDRTLN------------CIIIGPIGSGK-------
ref|ZP_02597242.1|  ------VEIGPHIEHKEMVRIKGKDRTLN------------CIIIGPIGSGK-------
ref|ZP_02524501.1|  ------VDIGPHIKHKEMIRIKGKDRTLN------------GIIIGPIGSGK-------
gb|ACA42232.1|      ----LILFVLPALISGLMIFIQVRDFMVH------------KDMLSESFMTW-------
ref|ZP_02758276.1|  --KIESINGEAGETLDTPVFIPLKDRFLH------------MLILGPTGCGK-------
RAAC02355           GTLAVIAMAGFGVVKLHGLIAAWQNRMLHPSTPKAATTATNSHAIINPLTSGTGPKLPLS
                              ::   ::                  ::.

ref|ZP_02602342.1|  ---------------------------------------TSSLIIPMINQDLHWMARFI
ref|ZP_02597242.1|  ---------------------------------------TSSLIIPMINQDLHWMARFI
ref|ZP_02524501.1|  ---------------------------------------TSSLIIPMINQDLHWMVRFI
gb|ACA42232.1|      ---------------------------------------KAPIIRRFTHKKLLGTADII
ref|ZP_02758276.1|  ---------------------------------------TSQTIIPMINQDLQNKE---
RAAC02355           ALNATNPLVHENAWVIALALVAGVLGLLAFFVYRGLSPTAKAQFLQRMQATDFDRSTHRR
                                                            .:   :   :    .:

ref|ZP_02602342.1|  N---------------------------KFINVFKKKDYHTEEVKGTFLN--------
ref|ZP_02597242.1|  N---------------------------KFINVFKKKDYHTEEVKGTFLN--------
ref|ZP_02524501.1|  N---------------------------KFENTYKKNNYDTEEVKGTFLN--------
gb|ACA42232.1|      IGYQFKTMIP-------------IVLKEAQRFLHEAVIGATGSGKTSTALLLRIAQDLIN
ref|ZP_02758276.1|  -----------------------------------------------------------
RAAC02355           DDDPNKFSLVGVEVGIRKDNGRPIRIEGKDRFINTLVLGSTGTGKTSRIMLKAVYQDLRS ref|ZP_02602342.1|  --------GVTVIEPSNDLCQKVFKLVQAHKIPESAVYYIDPTNPDTKNINILRGPVDKV
ref|ZP_02597242.1|  --------GVTVIEPSNDLCQKVFKLVQAHKIPESAVYYIDPTNPDTKNINILRGPVDKV
ref|ZP_02524501.1|  --------GITVIEPSNDLCQKVFKLVQAHKIPESSIYYIDPTNPDTKNINILRGPVDKV
gb|ACA42232.1|      IATGRRKMGLVFLEPKGDGVDDVLKMCKKLKIPDEKIKVIDATKAFTIKFNPFIGPSAPA
ref|ZP_02758276.1|  -------IGVTVLEPKSDLAEKVYQMAKIHNR---EVIYFNPLLADCPYFNPLFGHESEV
RAAC02355           MANG-TPMDVIAMDPDGGFAQAAVNMANQLGVET-IIMDLRGTMPSTVSFSPFGGEIADI
                        .:   ::*...   :  ::   :         :      :    :..  :  * ref|ZP_02602342.1|  AEVFAMVIQGLSESNNAFFEQAQRNHLKQHIYLLKLHNPQKD-----------------
ref|ZP_02597242.1|  AEVFAMVIQGLSESNNAFFEQAQRNHLKQHIYLLKLHNPQKD-----------------
ref|ZP_02524501.1|  AEVFAMVIQGLSESNNAFFEQAQRNHLKQHIYLLKLHNPQKD-----------------
gb|ACA42232.1|      AATFEGTINALSGDQDDFYKGQQNEAASTLTKLAKIAFGEKTNIFHIQRMFSDPRYLANI
ref|ZP_02758276.1|  IENMATTFNMLNPDSPQFFKDMSDGLIRKSVKLLKRLYGDDA-----------------
RAAC02355           IDNVRAALQEKMGKQDGFFQNAQDDLVRTVIQVQVPLWPEAD-----------------
                      .  .::    .. *::  .         :           :

ref|ZP_02602342.1|  ----------------VTFDDLIEMYD----DVEHVRMHKLLKVQVEKLYDFVQSGAAS
ref|ZP_02597242.1|  ----------------VTFDDLIEMYD----DVERVRMHKLLKVQVEKLYDFVQSGAAS
ref|ZP_02524501.1|  ----------------VTFDDLIDMYD----DVEHVRMHKLLKVQVEKLYDFVQSGVAS
gb|ACA42232.1|      VESIREQITTNREKQFREQKDLIMLLDSLGTSVEHIEQTEHELMFKLKNLSNSSAINENQ
ref|ZP_02758276.1|  ----------------------TLIDLND-------LVWNSNGIGKKIVNEFSKLPVKNPLQ
RAAC02355           ----------------FLQFADLVT----DPLHFRAICSMVQDCAAQEAGTAKKKRKS
                                     :  :           .           :            .

ref|ZP_02602342.1|  R------DQKNEYKIIKGIHEWFDNTIREKLDFQGEPAVYKSGKYRGQPMHYDR------
ref|ZP_02597242.1|  R------DQKNEYKIIKGIDEWFDNTIREKLDFQGEPAVYKSGKYRGQPMHYDR------
ref|ZP_02524501.1|  R------DQKNEYKIIKGIDEWFDNTIREKTGFQGEPAVYKSGKYRGKPMHYDR------
gb|ACA42232.1|      KKLNEIQELKKRNNLLRAQQIEIDNTEQIIFYFENEVLLYKVDQRTQQPILYPKNHIYAN
ref|ZP_02758276.1|  Q---------------------KENEEIAIWFLTDYYSGMTGDRKGT------------
RAAC02355           E-------MDEAMSMWEHERPEVEARFHRLTPHEKSMVLSAARSFLMDTATEQK------
                    .              .      .    .    .    .
``` continued →

FIG. 55 continued

```
ref|ZP_02602342.1|       -------EEEYVKGLRNILKDLASNVLIRRVLFGKSD----FDFDVHLEQG--GILLVNT
ref|ZP_02597242.1|       -------EEEYVKGLRNILKDLASNVLIRRVLFGKSD----FDFDVHLEQG--GILLVNT
ref|ZP_02524501.1|       -------EEEYVKGLRNILKDLASNVLIRRVLFGKSD----FDFDVHLEQG--GILLVNT
gb|ACA42232.1|           QQMVESKKDKFVTGAKKYLNDIALNDLLKNLFIGAEGE-EVFDADEFLREG--GVLLVNT
ref|ZP_02758276.1|       ------KTYEHCSGVRTQISKLVSNEYLRKALNPPRGHGTDIDFDKALEEG--LVITMTT
RAAC02355                ----LEKLETITKGLKIVVNELATNPRLRQVFKTDELP--PFDFQGFLAAGKEQPGRLVV
                                 .*  :  :..:. *  ::. :          :*  *  *      :  .

ref|ZP_02602342.1|       AKGELADLSNVLGKFVLLSMQNAVFRRD--PNVSPYHHIIVDEFPDYVVRPFKEFPAQSR
ref|ZP_02597242.1|       AKGELADLSNVLGKFVLLSMQNAVFRRD--PNVSPYHHIIVDEFPDYVVRPFKEFPAQSR
ref|ZP_02524501.1|       AKGELADLSNVLGKFVLLSMQNAVFRRE--PNISPYHHIIVDEFPDYVVRPFKEFPAQSR
gb|ACA42232.1|           SLAELDELSLMFGQFFIRQFQSAIFRRP--QEGRIPIFFYIDEFPLYVNEAFERILTLGR
ref|ZP_02758276.1|       TQGSLRDLGKFLGYFIILQLQSSVFRRPGDEDSRRENMLYIDEFQVYANQGFGEMLTQGR
RAAC02355                VVTGNRPAGKLFGKLFLVTLKMYALEREGTEDTRRPVYLYVDEFAVGTESFTEMFSQAR
                           . .:* :.:  ::    :.*  :      :  :*** *  . *  .: : .* ref|ZP_02602342.1|       KYKVILTIASQTLSQLALD-FTEQYMFTLLGSFRNKMIFGDVTPYDAKIFSDMFGEKEEF
ref|ZP_02597242.1|       KYKVILTIASQTLSQLALD-FTEQYMFTLLGSFRNKMIFGDVTPYDAKIFSDMFGEKEEF
ref|ZP_02524501.1|       KYKVILTIASQTLSQLALD-FTEQYMFTLLGSFRNKMIFGDVTPYDAKIFSDMFGETEEF
gb|ACA42232.1|           SYNVGAVIAMQSIGQLEG--VKAGYQDIILGNASSKTVFGRGPNKDNEYFSLEFGEKEIN
ref|ZP_02758276.1|       SYRVASHLATQARDQMSVGREGDSFLELVSANARNKIIYPGISITDAKYYSEEFGEELRT
RAAC02355                KYRVGMMLAIQARAQLLD--VSKKFMDVVEGSCRNKIYFPAPSPDDARFLEHALGSVKNI
                          .*.*   :* *:  *:            :   :  .* :  .  *  . . :*.

ref|ZP_02602342.1|       KEAESEQGIS--------------------------------------------------
ref|ZP_02597242.1|       KEAESEQGIS--------------------------------------------------
ref|ZP_02524501.1|       KESESEQGIS--------------------------------------------------
gb|ACA42232.1|           EESLNESASPMTSEDQKWGYRLNTAKKKVARFSTTAIRE-LPFKHMIVQIVDETNSIAPP
ref|ZP_02758276.1|       TIGKSYSKDRYFSSFSDEKMTTKVDERYEPRFSPSNLIY-RDFGQITHCLVKNNTVQIPA
RAAC02355                RETYSENKLSWFFDTRNLDRRVSTQETIDPRYRLEDISYGLSKDEAIFAMTVDNQVQAPC
                          . .

ref|ZP_02602342.1|       ------------------------------------------------------------
ref|ZP_02597242.1|       ------------------------------------------------------------
ref|ZP_02524501.1|       ------------------------------------------------------------
gb|ACA42232.1|           LKAVGRFVNEARFIKPYLNLKKSDIKSNQE------------------------------
ref|ZP_02758276.1|       LAQIEY------------------------------------------------------
RAAC02355                VGITSYADEWVKKQRGFFDVRRSQNRSQRQPTPINVAVKVVEHGVSERRSMPEPRDETYV ref|ZP_02602342.1|       ------------------------------------------------------------
ref|ZP_02597242.1|       ------------------------------------------------------------
ref|ZP_02524501.1|       ------------------------------------------------------------
gb|ACA42232.1|           ------------------------------------------------------------
ref|ZP_02758276.1|       ------------------------------------------------------------
RAAC02355                PSPASPSKVRPTADRNAKINVQAFARAIQEAAFHMSDASRADTVDVEPVETHTETSPQQG ref|ZP_02602342.1|       ------------------------------------------------------------
ref|ZP_02597242.1|       ------------------------------------------------------------
ref|ZP_02524501.1|       ------------------------------------------------------------
gb|ACA42232.1|           ------------------------------------------------------------
ref|ZP_02758276.1|       ------------------------------------------------------------
RAAC02355                ETSPYASPNESTAQEAERPIEEPAIVRIDLRPQRPPKRCPQCEAELTLTPDERKWRCPRC ref|ZP_02602342.1|       -------
ref|ZP_02597242.1|       -------
ref|ZP_02524501.1|       -------
gb|ACA42232.1|           -------
ref|ZP_02758276.1|       -------
RAAC02355                GFERKNR
```

FIG. 56

```
ref|NP_347717.1|        ------------------------------------------------AVGLAVGVLGALM
ref|YP_429187.1|        ------------------------------------------------IGRGIVG---
ref|YP_423535.1|        ---------------------------------------------MMVVSHVVLGVSA
RAAC02356               MMGRSHMAIGAVGAVAATPLVLHERWESLRDLLTHPWASMPHIVVVQAAFVAATVVGALV
ref|YP_645289.1|        ------------------------------------------------------------
ref|ZP_01860459.1|      -------------------------------------------------IGAGGISGLT ref|NP_347717.1|        PDIDTSRSKVSYNLRKIV-----------------VYAALVIVGAYILMANFYPEVEKTNL
ref|YP_429187.1|        --------------------------------------IAILGAWHQTR----------
ref|YP_423535.1|        WTLAQRAG-------------------------LAVPLGPEGAAAAALG----------
RAAC02356               PDLDQCDAKLTYTIEIVFGLPVLALAIVVMVLMHWATSLTAWGIALLLMFIFGAAHNVTR
ref|YP_645289.1|        ------------------------------------------------------------
ref|ZP_01860459.1|      PDLDVDGKLSNTFTSSYK---------------FLMTLVQFIGVAVIVYSWWAGTDQEMW ref|NP_347717.1|        FLKNMGVYKLKDYIPYNLKLSNAGLLIIVGCIIFSKFTKHRSFSHSILGLILFTVGVKLL
ref|YP_429187.1|        --------------LPLLLPAG--------VAFVALAFLPHRGITHSALGLVLAWLAIKTL
ref|YP_423535.1|        -----------ALLPDIDHPSSWLGRRLWFISKPISMVLGHRGLTHSLLAVMGGLAVLMLV
RAAC02356               MLGLGALATILLDLAYHHRMPMEAAVLLAAWMVATMPAKHRTFTHSLLGLAVFGAGCYLS
ref|YP_645289.1|        ------------------LRAT--------SFVLVRTVGHRTLTHSLLGLALFCAPVWLL
ref|ZP_01860459.1|      KG-------IAAGLGIMLVSSFIKKRHLLTVAGGGALAGGMFLAETWLQLLGIYIVIASL
                                          ::.:  *  :

ref|NP_347717.1|        LG-----NIFIY---FAVGFISHMVADTFTNSGIEVFYPIKKKISLKLVHTGSMLDHFTG
ref|YP_429187.1|        G------WPQVP---FLIGYGIHLAEDLLTPSGIPLLYPWQERMRIPLAQTGGIIDRTLG
ref|YP_423535.1|        EPGRGLVRLAEP---LALGYLSHLAADALTPAGVPLLWPWKQRFGVGLCSTGGVMEWLV-
RAAC02356               EPALSHLHLGVAAYGLILGYVLHMAADFIAG-GVPLLWPWCKRQGVHLVKSFSAVDYLIG
ref|YP_645289.1|        LGG--YPAFALA---LAAGYASHLLADALNTRGVPLLWPLGK-----------------
ref|ZP_01860459.1|      VSHRSYTHSLIG--LAFFAVIAYYLQASIKTEGILLACTGG--YVSHLIADMKWLPFNKR
                            .    :       :    *: :  .

ref|NP_347717.1|        GLAFIVFLAIIL-
ref|YP_429187.1|        LAALALFL-----
ref|YP_423535.1|        -------------
RAAC02356               GIGIFTFVGLALV
ref|YP_645289.1|        -------------
ref|ZP_01860459.1|      GIKLFLPVSRKE-
```

FIG. 57

```
ref|NP_217638.1|      PRTEINTBHGMYCBACTERIUMTUBERCULSISSTRHAARLEMGBABQHYPTHETICALP
ref|ZP_00876805.1|    ------------------------------------------------------------
ref|NP_856790.1|      ------------------------------------------------------------
gb|EAY58379.1|        ------------------------------------------------------------
ref|ZP_01505670.1|    ------------------------------------------------------------
RAAC02357             ---MVCDMAIRYDGWSIAAQYRRCGKSACRVCREGPGHGPYWYGSKTVDGRRLTKYFGKVP ref|NP_217638.1|      RTEINMRAMYCBACTERIUMTUBERCULSISHRAGBABRHYPTHETICALPRTEINTBFG
ref|ZP_00876805.1|    ------------------------------------------------------------
ref|NP_856790.1|      ------------------------------------------------------------
gb|EAY58379.1|        ------------------------------------------------------------
ref|ZP_01505670.1|    ------------------------------------------------------------
RAAC02357             PVEQEIAQDEPSVLKELSRLREENENLRAQVAQLQAELAALRTPFALSDPPHPLEETKEA ref|NP_217638.1|      MYCBACTERIUMTUBERCULSISFSCRESIGNIFICANCEIDENTITIESPSITIVESGA
ref|ZP_00876805.1|    ------------------------------------------------------------
ref|NP_856790.1|      ------------------------------------------------------------
gb|EAY58379.1|        ------------------------------------------------------------
ref|ZP_01505670.1|    ------------------------------------------------------------
RAAC02357             SQDELTIHEQPRRRASVRSSDELTKADVEAIWCEETEGLDEEPDILAEVHDALVRNLFPV ref|NP_217638.1|      PSSISENYRRCGKPN--CVCAQEGHPGHGPRYL-------------WTRTVAGRGTKGRQ
ref|ZP_00876805.1|    --SISENYRRCGKPN--CVCAQEGHPGHGPRYL-------------WTRTVAGRGTKGRQ
ref|NP_856790.1|      --SISENYRRCGKPN--CVCAQEGHPGHGPRYL-------------WTRTVAGRGTKGRQ
gb|EAY58379.1|        --SISENYRRCGKPN--CVCAQEGHPGHGPRYL-------------WTRTVAGRGTKGRQ
ref|ZP_01505670.1|    ---SLIERYKRCGKPG--CKCADG--PGHGPKYY-------------LSVSFPGRRPQMDY
RAAC02357             PTQDTTRLKTGTNPRKPYVCPFRATKRGGRLTFGSADKLVRTAIPWLIQSVKHQREWREL
                           . :   :*        *.         *                    :. :

ref|NP_217638.1|      LSVEEVDKVRAELANYHRFA-------------------------QVSEQIVAVNEAI
ref|ZP_00876805.1|    LSVEEVDKVRAELANYHRFA-------------------------QVSEQIVAVNEAI
ref|NP_856790.1|      LSVEEVDKVRAELANYHRFA-------------------------QVSEQIVAVNEAI
gb|EAY58379.1|        LSVEEVDKVRAELANYHRFA-------------------------QVSEQIVAVNEAI
ref|ZP_01505670.1|    VPQADYTDVAEHLANYHRVR-------------------------EIIEEICEINREL
RAAC02357             SRRRQQDRIAELLSTYRRMDTLELVHLVERMERAILMGDRTGWTVRLEELDEHVEVIRQV
                       :    :   *:.*:*.                             : ::   : . :

ref|NP_217638.1|      CEARPPNP
ref|ZP_00876805.1|    CEARPPNP
ref|NP_856790.1|      CEARPPNP
gb|EAY58379.1|        CEARPPNP
ref|ZP_01505670.1|    LRRR----
RAAC02357             LQERNT--
                      . *
```

FIG. 58

```
ref|YP_655149.1|        ------------------------------------------------------------
ref|NP_943831.1|        ------------------------------------------------------------
ref|YP_001456771.1|     ------------------------------------------------------------
RAAC02358               MRPVQRAIPGPVKRWKFRLVVSRHSSQVPNSNRPCRCDHSTGTPPVPTARTNIVRPAEGR
ref|YP_024839.1|        ------------------------------------------------------------
ref|XP_748956.1|        ------------------------------------------------------------ ref|YP_655149.1|        ------------ELRPYQREAVEAIESHWSQGVTRVGVVLPTGTGKSTVIGRTAVNGYQN
ref|NP_943831.1|        ------------MRPYQREAVEAIESHWSQGVTRVGVVLPTGTGKSTVIGRTAVNGYQN
ref|YP_001456771.1|     ------------ELRAYQTEAVNAVLGEWVDGK-RTCVVLPTGTGKSTVIAKLAEIAYKA
RAAC02358               ALNDVEGISVAIQLRPYQQAAVDAFFQALAEGRKRQLIVLPTGAGKTIVFGSVARRFHEE
ref|YP_024839.1|        ------------LRPYQEKALEGIEKAEREGVRRPLVVLPTGTGKTVVFSHGIKNRADR
ref|XP_748956.1|        --------SPKLVLRDYQEECIQSVLKYLDEGHKRLGISLATGAGKTVIFTELIGRIPSR
                                    :* **   .::..    :*   *   :  *.**:**: ::        .

ref|YP_655149.1|        R---EPVLMVAHRGELIDQMAGTIFEVDPSIPRSHVGIVRAEMDDHSAPIVVATLQTLAT
ref|NP_943831.1|        R---EPVLMVAHRGELIDQMAGTIFEVDPSIPRSHVGIVRAEMDDHSAPIVVATLQTLAT
ref|YP_001456771.1|     G---QRVILLAHRRELLDQMAQSIRMVAPQIPTDDIGFVQAERDQPERPIVCASFQTLMS
RAAC02358               VSRERPILVIAHRTELLDQAEQKIHFVWP---EAFIGRIQGARNEQLGDVLLASTQTLVA
ref|YP_024839.1|        G----RSLVLVHRDELVRQTIEKIGMVAP---ELTTGVVKADENGLDADVVVASVQTAQV
ref|XP_748956.1|        NEIGDKSLIIVHRKELVEQAAQHCRRAYP--DRTVEIEMGHSHASGAGDIVVASVQTLTR
                            ::::.** **:  *       .  *      :           :: *:  **

ref|YP_655149.1|        AHRREAVGFRR------RILWDEVHHAGAEGFHTTFTELGGYTDAL----FAGFTATMRR
ref|NP_943831.1|        AHRREAVGFRR------RILWDEVHHAGAEGFHTTFTELGGYTDAL----FAGFTATMRR
ref|YP_001456771.1|     ASRLQAVGERT------VVLVDEVHHSAASTYAEILSAPN-FDGAF----KAGFTATLQR
RAAC02358               GRRIPQPG---------LIIYDECHHSRAEGALGVLERLGVFESDGPP--LLGVTATPSR
ref|YP_024839.1|        DRRLAQLVEAAKRSPFGTVWVDEAHHAPAPSWTKVLTGLGSFNPYGPL--TVGFTATPER
ref|XP_748956.1|        GNRLAKFDPKR----FKLLLVDEAHHIVASSYREVLKHFGADETSADSPVLVGVSATFSR
                              *       :    *      :  .          *.:**  * ref|YP_655149.1|        DDKGKSPVGLGDVIEKV-----VYEKDILWAIDSGYLVRPRGLTVRIKNLNALDDVRTVA
ref|NP_943831.1|        DDKGKSPVGLGDVIEKV-----VYEKDILWAIDSGYLVRPRGLTVRINNLNALDDVRTVA
ref|YP_001456771.1|     ADGG-----LADYWDSI-----AFERDLRWALDEGFLVPPQGKTVVIPGLDTTN-IKLRN
RAAC02358               SDRT----ELGDIFEHL-----TYERTILDMIMDGYLSDVRGVKVEVPGLNLGA-IRTTA
ref|YP_024839.1|        DKKTLGVWERLAAFMSIREAIYGNGKRGKDGHEGGYLVPILPAVVVETEMDLTR-VRKTG
ref|XP_748956.1|        SDGLK----LGAAIDHI-----VYHKDYIDMINDNWLAN-AVFTTVRSEANLSKVKKDSF
                                        :      :                :      . :     :

ref|YP_655149.1|        GDFQQSDLAEVM--EAATEYVVDAIKLHAADRR-PIIFAASVDAAHHIADALTAADFPAV
ref|NP_943831.1|        GDFQQSDLAEVM--EAATEYVVDAIKLHAADRR-PIIFAASVDAAHHIADALTAADFPAV
ref|YP_001456771.1|     GDYAAGDLSEVM--MSSVDSTVEAIHTHAPDRR-MLIFGAGVEHCQALSDTLSATGIHTA
RAAC02358               GDYNSKDLSYVMNIESALDAVVDAVVTHAPGRK-CLVFAVDVKHAHALAERFQKRGIACA
ref|YP_024839.1|        GDFSEGDLGREMEESGAIAQIADAYLINAHDRK-GVAFTPTVATAHALAAALCARGIRTE
ref|XP_748956.1|        GDFAIGPLSKAVNTENVNNITVRAWLANAQDRKSTLVFCVDVAHTKALTETFRNYGIDAR
                        **:    *. :        .*  :* .*:  : *         :::  :      .:

ref|YP_655149.1|        AVTGSMSYAERQPVYEAYRNGTAKALVTVQVLTEGADFPMCDCVVLARPTRSRNLYSQMI
ref|NP_943831.1|        AVTGSMSYAERQPVYEAYRNGTAKALVTVQVLTEGADFPMCDCVVLARPTRSRNLYSQMI
ref|YP_001456771.1|     LVVGSTSSEERTELFEEFTAGRVQALVTVQVLTEGTDLPACDCVVLARPTRSAVLFTQMV
RAAC02358               AVDGGAMKAEERAAILQAFAENRLCVLVNCQILTEGYDQPDVDCVVIARPTRSQALYVQMV
ref|YP_024839.1|        ALDGTTHKDERRAILRRLKTGETQVVTNCGVLTEGFDEPSISCVVRAPTKFHGLYVQMI
ref|XP_748956.1|        YITAKTPKDVRMEQLRAFRNGEYPVLLNCGLFTEGTDIPNIDCVLLARPTRSRNLLIQMI
                        :.             *          .:  .    :::*** *  .  **.::****:    *  **:

ref|YP_655149.1|        GRALRLYDGKQDALVLDLAGSS------------------RSMKLVNLTQLV-------
ref|NP_943831.1|        GRALRLYDGKQDALVLDLAGSS------------------RSMKLVNLTQLV-------
ref|YP_001456771.1|     GRALRLHQDKNDALVLDLAGST------------------RDVAMVTLSSLV-------
RAAC02358               GRALRLIIPDKTDALVLDLTGAS------------------DDKSLQTFARLMRTQRKTA
ref|YP_024839.1|        GRGTRLYPGKKDLMILDLVAAS------------------RRHEFVGYVDLG-LDLDEG
ref|XP_748956.1|        GRGLRLYPGKEDCHIIDMVATLNTGVLSTPTLFGLHPDEILQNAKAKDLRDMPLEKTTTG
                        **. **:  .* *  ::*:...:                            :
``` continued →

FIG. 58 continued

```
ref|YP_655149.1|       ----------------------------------------------------------
ref|NP_943831.1|       ----------------------------------------------------------
ref|YP_001456771.1|    ----------------------------------------------------------
RAAC02358              THALVGAEEGEDAVPMEDGESVGEWLTRVAQKRELAEQVAQAINLFANRSRYRWVRVKDN
ref|YP_024839.1|       KKPKEGEPERQACPTCEEPCEVTEHRCALCHRYLPVAVTAEGGSRHENCQANGSGRVN--
ref|XP_748956.1|       TGTALAGEETEEPPPTPDDLDVNLTFTKYDTIYDLIADLKSEKHIRSLSPHVWVRVGDHR ref|YP_655149.1|       ----------------------------------------------------------
ref|NP_943831.1|       ----------------------------------------------------------
ref|YP_001456771.1|    ----------------------------------------------------------
RAAC02358              FAIAYGHDGWAYLYRDGDEFWPVLELKNEKFMPLHDRSLPLEYAQGVVEGFLSLFESSLI
ref|YP_024839.1|       -------------------VFGESRLRWLPVGPAWVLGAGKEIVVMVPEGVDTWKLAAYE
ref|XP_748956.1|       YVLSDASGWLTIDKEEDTSRAYRPRLNPDPTSIANTPDEPYIFTVRHVAKFKNSDDSIMH ref|YP_655149.1|       ----------------------------------------------------------
ref|NP_943831.1|       ----------------------------------------------------------
ref|YP_001456771.1|    ----------------------------------------------------------
RAAC02358              TKEADWRNAPMTERQKYVLQKYRIRYDDTWTRGMAADALGQRFAAKRVRVLQKNFDAQ--
ref|YP_024839.1|       NGRVEVLHEEIPSDWAMGIGEDRAKAFQKLVERQARWLNEPVSISQKGRLVREGLPEK--
ref|XP_748956.1|       TRPRLIATAPDFETALRAADTFATKEFEERYVSVRQTWRQLPATEAQVRFLNKAKVRHGS ref|YP_655149.1|       ------------------------------------
ref|NP_943831.1|       ------------------------------------
ref|YP_001456771.1|    ------------------------------------
RAAC02358              KWRDVLAQPHGQAWLEHRLMALRARAQSRARVAQTS
ref|YP_024839.1|       HLPRVKTKGEAADLLTRISGKRAVRKL---------
ref|XP_748956.1|       IQRKHLTRGQAADLITKLKFGGKQRFEARRAERL--
```

FIG. 59

```
ref|YP_001086797.1|    ------------------------------------------------------------
ref|ZP_01805266.1|     ------------------------------------------------------------
ref|ZP_01966753.1|     ------------------------------------------------------------
ref|ZP_01188985.1|     ------------------------------------------------------------
ref|YP_001681547.1|    ------------------------------------------------------------
RAAC02361              MDTQCIEVRCGSARHHLSYEDLFTPEVQSLFEECYALGVEVRCLCNPDRPVPMHLRRVRI ref|YP_001086797.1|    ------------------------------------------------------------
ref|ZP_01805266.1|     ------------------------------------------------------------
ref|ZP_01966753.1|     ------------------------------------------------------------
ref|ZP_01188985.1|     ------------------------------------------------------------
ref|YP_001681547.1|    ------------------------------------------------------------
RAAC02361              RPPTYTVVTNPLGIHHPNCPRFRQSRHPSASHKTRDAQAVETTPNHIEEWLPHRRIFVPT ref|YP_001086797.1|    LDTLNPAQREAVEKTEGPVLILAGAGSGKTKVLTTRIAYLIEDKGVQAPNILAITFTNKA
ref|ZP_01805266.1|     LDTLNPAQREAVEKTEGPVLILAGAGSGKTKVLTTRIAYLIEDKGVQAPNILAITFTNKA
ref|ZP_01966753.1|     -DTLNKPQKEAVFHTEGPLLILAGAGSGKTRVLTHRIAYLIEEKGVNPWNILAITFTNKA
ref|ZP_01188985.1|     LTGLNPEQKKAVEHFEGPLLILAGAGSGKTRVLTHRIAYLIENYGVNPLQILAVTFTNKA
ref|YP_001681547.1|    LHSLNPVQREAVLHQEGPLLLLAGAGSGKTRVLTHRIGHLIEQCRVSPFHILAITFTNKA
RAAC02361              LDQLNDAQREAATHKNGPCMVVAAAGSGKTAMLIARIQHLIN-QGVRPGDILACTFTRKA
                        * **   *::*.   :  :**  ::: *.******  :*   **  :**:      *    .  .*** ***.**

ref|YP_001086797.1|    ANEMRERVEQNIGPETKDMWISTFHSCCVRILRKDINKIGYNRSFVIYDSADQVTLVKDC
ref|ZP_01805266.1|     ANEMRERVEQNIGPETKDMWISTFHSCCVRILRKDINKIGYNRSFVIYDSADQVTLVKDC
ref|ZP_01966753.1|     AEEMRQRVDSLVGIGAESIWVSTFHSMCVRILRRYIDRLGYDNRFTIYDTDDQKTLMKEV
ref|ZP_01188985.1|     AGEMKERVDNLLGGMAGDLWVSTFHSLCARILRKEIGKIGYDNNFVIFDTDDQQKLISRI
ref|YP_001681547.1|    AAEMRERLGRLIGPRAHDVWVSTFHSTCMRILRKDGEKLGYDRSFVIYDYDDQQRLLKEC
RAAC02361              AQEMTDRLLAAVGERGKAVTIGTIHSVAYRMVTPELG--EDWRVLSDPTWMIERVLEEPS
                       * **  :*:    :*          :  :.*:**    *::            . :         : *  .

ref|YP_001086797.1|    LKELNLSDKVFEPKAVISAISGAKDKLYTPKQFKDINMADNRMVKIADIYALYQDRLKRN
ref|ZP_01805266.1|     LKELNLSDKVFEPKAVISAISGAKDKLYTPKQFKDINMADNRMVKIADIYALYQDRLKRN
ref|ZP_01966753.1|     CRKTDIDTKRFKERMLLSVISSAKNEMILPEEFELNAGGDFVQLKIAKVYKEYEAQMRAN
ref|ZP_01188985.1|     LKELNLDPKKTRPRAITLSEISRAKNELIDPRSYANNVG-DYFQDITARIYPLYQERLKES
ref|YP_001681547.1|    LKELNIDEKRFKPQAVGAAISSAKNRLVGPVAFERQAY-DHFAQISAKVYHIYQKKLKAH
RAAC02361              GKNPHGVGPVMKLGEAISAIAKAKADALGP---------HQVSDPLTKVYAAYETLKAER
                        ::   .         .         : *:  **       *              . :* :*:

ref|YP_001086797.1|    SALDFDDLILKTVELFKANDEVLAYYRSRFRYIMVDEYQDTSKAQYELIKLLAREHQNIC
ref|ZP_01805266.1|     SALDFDDLILKTVELFKANDEVLAYYRSRFRYIMVDEYQDTSKAQYELIKLLAREHQNIC
ref|ZP_01966753.1|     NALDFDDLLVKTVQLLETQPDVRENYQERFRYIMVDEYQDTNTVQFRLVSLLAGKYRNLC
ref|ZP_01188985.1|     NALDFDDLIMKTIEVFVDNPMVLEYYQERFKYILVDEYQDVNFAQYKLVQLLANKYRNLC
ref|YP_001681547.1|    NAMDFDDLLVNGVCLFREFPHVLDNYQDRFRYIHVDEYQDTNHAQYVLVKLLADKYRNLC
RAAC02361              KTLDFEDMILHAIRLFRTDEAFAKRWQRWRYVMVDEFQDTNTAQWLFLLELVKAHNNLF
                       .::**:*:::: : ::          ::.*::*: ***:**..  .*:  ::    *.   .: :*:

ref|YP_001086797.1|    VVGDDDQSIYGWRGADIRNILEFEKDYDNVHVVKLEQNYRSTQVILDAANKVISNNIERK
ref|ZP_01805266.1|     VVGDDDQSIYGWRGADIRNILEFEKDYDNVHVVKLEQNYRSTQVILDAANKVISNNIERK
ref|ZP_01966753.1|     VVGDDDQSIYKFRGANIRNILDFEKEFSDAKVIKLEQNYRSVGNVLEVANSVIRNNKGRK
ref|ZP_01188985.1|     VVGDPDQGIYGFRGADIRNILNFEEDYPEARVIKLEQNYRSKEKILKAAHHVIRNNTARK
ref|YP_001681547.1|    VVGDDDQSIYGWRGADIQNILDFERDYPEAVVLKLEQNYRSTGKILEAANAVVGNNRGRK
RAAC02361              VVGDDWQSIYYFRGARPDLMKEFLRRFPDAKRVTLETNYRSHDLIVDVGRRIIRLNDGHQ
                       ****  *.**  :***      :  :* . : :.  :.**  ****   ::. . . :      *  :

ref|YP_001086797.1|    RKK---LWSEKKEGELIKIQLTGSEIEEADFIADSIAQIARKENRPYKDFAVLYRANAQA
ref|ZP_01805266.1|     RKK---LWSEKKEGELIKIQLTGSEIEEADFIADSIAQIARKENRPYKDFAVLYRANAQA
ref|ZP_01966753.1|     EKT---LWTDNEKGEKIRLRQFDTAYDEAQFIAEDIKDETAQG-ANYSDHAVLYRTNAQS
ref|ZP_01188985.1|     EKR---LWTKRGKGEDLKLYVAFDDKDEASYVCRKIKELKREKNYKFSDFAVLYRTNSQS
ref|YP_001681547.1|    SKK---LWTQNPSGQPIVAYQGETEHDEARYIVRTIKRLSESENRPYRDFAILYRTNAQS
RAAC02361              LPKRVVAHRSMPEGAIAQIVTVRSDLEEARFVAQELQRLRKEHGVSWSDCAVLYRTNIQS
                        .  .*           :  :  :** :  : :  .   :  . * *:**:*  *:
``` continued →

FIG. 59 continued

```
ref|YP_001086797.1|     RPVEDALNRSQIPYNIYGGTKFYERKEIKDLLAYLRVIQNPQDDISIKRIINVPRRGIGL
ref|ZP_01805266.1|      RPVEDALNRSQIPYNIYGGTKFYERKEIKDLLAYLRVIQNPQDDISIKRIINVPRRGIGL
ref|ZP_01966753.1|      RLLEEKFVAMNIPYKIVGGINFYSRREIKDVLSYLKTIDNGKDDLAVRRIINVPKRGIGL
ref|ZP_01188985.1|      RSVEEMMVKYAIPYQIVGGFRFYDRMEIKDILAYLRVIYNPSDEVSLLRIINRPKRGIGQ
ref|YP_001681547.1|     RVLEEHFMYAGIPYRIFGGLRFYERKEIKDIVAYLRFISNPADAVSFRRVVNVPKRGIGD
RAAC02361               RLFEEALADADIPYHVVGDKHFYESPDVKIILDYLRTTQDTSDPTVWGHLLNRPKRYIPI
                        *  .*: :    ***.: *. .**.  ::* :: **:    : *      :::* *:* * ref|YP_001086797.1|     RTIEKIEDRANLKQESIYSVLIDIETNSDISTKARASISGFVDIIGTLRTIKEVYPVSKL
ref|ZP_01805266.1|      RTIEKIEDRANLKQESIYSVLIDIETNSDISTKARASISGFVDIIGTLRTIKEVYPVSKL
ref|ZP_01966753.1|      TTINRIQESAAARGIGFYDALSAPDLIPGIGRSASK-LDSFAALIEYFKGRSEESGVTDL
ref|ZP_01188985.1|      GTISKLSRYARERGISLYKAGTEAESNPYLTASFKKRVKAFFDLLEELREKSETLSIDTL
ref|YP_001681547.1|     ATVQKLLEHADSEGWTVGEALARVGEVPGLSR-AVKALSAFGQMIEELRREAPSLLVTQI
RAAC02361               DVVHEVQHGG---------------WEAVVAHPKCRAFVTTIDTLRRIEE--PSKAI
                          .: ..:  .                         . *     :  ::          :

ref|YP_001086797.1|     IEKVLDTTGYMDELVEIRNKNEKDLTGKGEEAQDRIDNLREFISIALEFESSNDDTYENK
ref|ZP_01805266.1|      IEKVLDTTGYMDELVEIRNKNEKDLTGKGEEAQDRIDNLREFISIALEFESSNDDTYENK
ref|ZP_01966753.1|      LTEVIEKTGYTESLEADDP---------EELEARVQNIDELVSKAAVYEESCSDRGERP
ref|ZP_01188985.1|      THQVVTRTGYQRELNEEGT---------QQARNRLENIQELFS---VIEEFMKG-NENK
ref|YP_001681547.1|     VEAILNRTGYVRELEAEKT---------EEAKGRIENIKEFLS---VTKEFDRT-ADDK
RAAC02361               QWLVDNHPGLVRQQDEDEP---------------IKWVDSLIAS----------ASRYK
                         :   .*  .                       :. : .:.:

ref|YP_001086797.1|     DLETFLTSIALTSESNDE-EDNDRVSLMTIHTSKGLEFPVVFLTGMEEGLFPISRAIKSM
ref|ZP_01805266.1|      DLETFLTSIALTSESNDE-EDNDRVSLMTIHTSKGLEFPVVFLTGMEEGLFPISRAIKSM
ref|ZP_01966753.1|      TLSGFLEEVALVADIDSVAEDRDYVILMTLHSAKGLEFPHVYLAGMEDGLFPSYMSISGD
ref|ZP_01188985.1|      TLGAFLEEVSLISDVDNMEDNQNVVTLMTLHSAKGLEFPVVFIIGMEEGLFPHANSMM--
ref|YP_001681547.1|     TLEEFLAGVSLVSDTDNYNEDEDAVVLMTMHSAKGLEFPVVFVAGMEEGVFPHSRVQF--
RAAC02361               TVASFLRFVDWIIE-KSKEPKDEAVQLMTIHKAKGLEWTTVFVAGLAEGLLPHKKALK--
                        : **   :   :  ..     . : * ***:*.:****:. *:: *:  *::* ref|YP_001086797.1|     SDSQIEEERRLCYVGITRAKEELYM----------------------
ref|ZP_01805266.1|      SDSQIEEERRLCYVGITRAKEELYM----------------------
ref|ZP_01966753.1|      DPEELEEERRLCYVGVTRAEEKLTLTCAR------------------
ref|ZP_01188985.1|      DHEELEEERRLCYVGITRARDELYLTRAR------------------
ref|YP_001681547.1|     EETQVEEERRLCYVAITRARERLYLARA-------------------
RAAC02361               -GEELREETRLCYVAATRARDNLYLMAAKWYGDKEREVSRYVNAVKNP
                          :.** *****. ***.:.* :
```

FIG. 60

```
ref|ZP_02406784.1|    ----RRHARRRCGDDRRIAVVEQRLHARQIVVVHVDRAHLMRIRAELAAEPRRE-VLLQ
ref|YP_335221.1|      ----RRHARRRGGGDDRRIAVVEQRLHARQTVVVHVDRAHLMRIRAELAAEPRRE-VLLQ
ref|ZP_02485527.1|    ----RRHARRRGGGDDRRIAVVEQRLHARQIVVVHVDRAHLMRIRAELAAEPRRF-VLLQ
ref|ZP_02509777.1|    ----RRHARRRGGGDDRRIAVVEQRLHARQIVVVHVDRAHLMRIRAELAAEPRRE-VLLQ
RAAC02362             MFPVPYILLIRTYVRIRGVRMNRPTALLRQLLILELIQAHIVRERARVKAQMRAEGLHIV
ref|YP_157691.1|      --------------VQILDVRLKRVDL---PLEVSESVYRRMEAERKRVANELRSEGGATA
                                          : : .        : : .     ::    * .:  : * *   :

ref|ZP_02406784.1|    EREREHVVQQPDVRVVRAHERDHVQPAFAQQQLQ--AERA-----
ref|YP_335221.1|      EREREHVVQQPDVRVVRAHERDHVQPAFAQQQLQ--AERA-----
ref|ZP_02485527.1|    EREREHVVQQPDVRVVRAHERDHVQPAFAQQQLQ--AERA-----
ref|ZP_02509777.1|    EREREHVVQQPDVRVVRAHERDHVQPAFAQQQLQ--AERA-----
RAAC02362             ERQDGDMDIRVEFRVGDHYDEAVFMRKMLEAEAANRAKRTGMISR
ref|YP_157691.1|      EKIRADADRQREVIIAFAYRDAQQAKGAGDAKAT------GI---
                      *:    .   : :.  :    :              : :
```

FIG. 61

```
ref|ZP_02329650.1|        KRVIF LADCQSFYASVEKAHHPEYRNR----------PLVVAGDPARRSGIVLAACPL
ref|YP_001421775.1|       ----- LVDMESFYASVEKAEAPHLKSR----------PVIVSGDPERRSGVVLAACPL
ref|YP_177318.1|          ------LVDMESFYASIEHAANPQYDGR----------PLVVSGDVNRRSGVILAACPL
ref|NP_243607.1|          MDKVIF-MVDMESFFASVERANHPELSGR----------PLLVSGDPERRSGVILAACPV
ref|YP_001681084.1|       -------LADMNSFYASVEMAHNPTLRGC----------PVLVCGDPERRHGIILAASRE
RAAC02363                 MTKLIYGLVDMQSFYASCEVASREEYAARRKEFDESTDPPLVVSGDPARRSGIILAATPT
                                   :.* :: * *        :       *::*.  *::*** ref|ZP_02329650.1|        AKKYGITTAERLGEAINKCPDLVVVRPRMQEYIKVSLQTTEILQSYTDLVEPLSVDEQHL
ref|YP_001421775.1|       AKRYGVKNAERLWEAQAKCPDAVIVRPRMQRYIDVSVMITELFERYTDLVEPYSIDEQFL
ref|YP_177318.1|          AKAKGVRNAERLFEAQQKCPDLVVVKPHMQRYVDISLQISKILGTFTDLVEPYSIDEQFM
ref|NP_243607.1|          AKARGVTNGERLWEAQQKCPEAVVVRPHMQQYVTVSVQITEILERFTDLIEPFSIDEQFM
ref|YP_001681084.1|       AKRRGVKTAMTVGEARAICPDAVCVRPRMSLYLEVSWQIQQIARTLSPLVEPYSVDELFI
RAAC02363                 AKRYGVENAMRLGEALRLYPRLIVVRPHMAFYLHVSVRIQMLMQQCFPFQEQFSVDEGFI
                          ** *: .. : **        * : *:*:*  *: :*  *  :       : * *:** .:

ref|ZP_02329650.1|        DVTASIKLLGSPQEIAKSIQSRVWNETGVYTRIGISENKVLAKMACDNFAKKNGDGIFYL
ref|YP_001421775.1|       DVTGSRRLFGDPFTIAKSIQQAIMREFGIYARVGIGPNKALSKMACDHFAKKNASGIHRL
ref|YP_177318.1|          DVTGSQKLFGPPYEIAEKVKQAIMDRFGVKARVGIGENKVLAKLACDNFAKKSSEGIYWL
ref|NP_243607.1|          DVTHSQRLFGAPREIAQKVQQAIWHETGVRARIGMGESKVLAKMACDNFAKKMPSGVFHL
ref|YP_001681084.1|       DVRGAEHIWGDAVEAAGIFRQRVWEAVKVPCSVGVGPNKFLSKMACDVEAKKSPSGVALW
RAAC02363                 AFPYPSNLFPDPIAAARNLQARIWDQFRIRARIGLAPNKWLAKMAK-KAAKKTPGGTVWW
                                . ..:    .   *  .:  :        :   :*:. .*  *:*:*   ***  *:

ref|ZP_02329650.1|        PKTEMEQKLWPLPVNKMYHTGSRMTRELKRMGIHTIGDLACASVLRLQKRWGINGEVIWR
ref|YP_001421775.1|       DMSNIRQDLWPLPVGKLFGIGKRMEHELRRMGISTIGGLAGHPAELLKKRWGINGELLQR
ref|YP_177318.1|          RKDSLDLDLWCLPIEKLFGVGRKMSVELRNMGIRTIGQLAQTDGARIKKRFGVHGCVLWM
ref|NP_243607.1|          TKERMERLLWPLPIECLYGVGRQMTKYFRNCGIRTIGQLANTSLERIKGKWGVNGHVLWL
ref|YP_001681084.1|       RVDDVEAKLHPLPIGKMFMVGSRMERHFRNMGLLTIGDLAHYPVDYLMRRFGLRGAVYHN
RAAC02363                 REEDIPSVLHPLPVEEMWGLKRRAEVLRRKFKCETIGDVARLPVGVLKAEFGVWGEVIHR
                                  :  *  **:  ::  :      :.   *** :*     : ..:*: * :

ref|ZP_02329650.1|        LANGLDDSPVTPDT-YIGQKSVGHQMTLPRDYMTINELLVPLLELSELVCQRCRAKGYMG
ref|YP_001421775.1|       TARGIDPSPVMVNT-HSRQKAIGHNMTLPRDYSRFEDIKVVLLELSEEVARRARFKQYTG
ref|YP_177318.1|          SANGEDYSPVTRAA-HARRKGYGNGMTLPRDYVKKEDICVVLLELCEEVCARLRQDGWMG
ref|NP_243607.1|          TAHGIDPSPVTPHS-HDKQKGIGHGMTLPHDYVKAEDIHVVLLELCEEVCKRARRAHLMG
ref|YP_001681084.1|       LAWGRDGSPVRPDS-LEQTKSVGHSVTLPRDYHHSDDIELVLLELTDEVCRRARKLGKAG
RAAC02363                 WANGIDVSDINPDSYHAPHKGFSHRTTLPRDFYERSEIAVVILELLDEVCHRLRQAHQAG
                            *  *  *     :        *.   *****:*:  ::    :*** :*.  *    * ref|ZP_02329650.1|        QVVSVGCQGTDFDYPTGFHRQMKLEDPTNLSDEVNRAVVILFKRHWNGLPVRKISVSLTG
ref|YP_001421775.1|       HTVSVSIRGADFEFPSDFHRQRKLVSPTNFGMDIFKTAVKLFKEHWNGEPVRSAGVSLSQ
ref|YP_177318.1|          STVSLSVNGADFVEKRGFHRQYTIPFETNITMEVYEAACALLERFWDGYPIRRLSIGVSN
ref|NP_243607.1|          RTVAIGVSGANMETPTGFHRQMKLTNHTNTTMEVYEGAATLFERFWDCKPIRRLHVNLSN
ref|YP_001681084.1|       RTVSVGLR--AYDLTRGFYRQTTLPSPSNLSGFVFEKAQLLFRRHWDGRPVRTVTVDLSG
RAAC02363                 RRVGLGLTYEGLTG--GFYRARTLPRATNDPAELYPVLLALLDEHWDGSGVRAVSVAVDM
                           *.:.     . *:*    .:     :*          *:  ..:*  :*   : : :

ref|ZP_02329650.1|        LVRDDTFQLVLFED---RMKKLALEKALDGIKDRFGNASIMRAVSLTAAGQAKDRSMKIG
ref|YP_001421775.1|       LEPCDYVQLSLFDA---QEKKISLGKVLDDIHERYGPASLLHAASLTEAGQAFHRAEKIG
ref|YP_177318.1|          LQSDQNWQLSLFDDNASRDRLSTIGYVMDGIRQKYGKLAIQRASSLQKASQLRDRSQKIG
ref|NP_243607.1|          LTSDEAWQLSFFGN-RDRAHQLGYTMDTIKEKFGDTAIRRAVSFLSASQAEERAKKIG
ref|YP_001681084.1|       LEEDGTLQQELFRD---MDRQDRVSRTMDRIRDAMGTTAIVRASSLLPAGQARDRAVKIG
RAAC02363                 LQFRETLQLSLFEN---VPARTRLYETVDEIRARFGETSIMRAVSLTRAGQLRERSLRIG
                           *       * :*     :  :   :    *:  *  ::  *: * .*: ; :**

ref|ZP_02329650.1|        GHY-
ref|YP_001421775.1|       GHY-
ref|YP_177318.1|          GHY-
ref|NP_243607.1|          GHY-
ref|YP_001681084.1|       GHY-
RAAC02363                 GHYA
                          ***
```

FIG. 62

```
ref|ZP_01860132.1|    -RDRGRIKWTS--MMLPEHVKVLRDWAKEDSYEQRKEIDEQHLEELSEITAEAMEYGRLV
ref|ZP_01171904.1|    IRDRGRIKWTS--MMLPEHVKLLRDWAKEDTYEKPKELDEQQLEQMNETLAEAMEFGQAV
ref|YP_079689.1|      LRDRGSIKWVS--MMLPEHVELLREYHESFQKIKKPILDEQKYEEFNEIICEAMAENRFL
ref|ZP_02329649.1|    -------LWESSRMMLPEHREQLLEQRRELKKHAKPLLDEQRLEELSTILNYALATKHKV
ref|YP_001487332.1|   -------MWESSRMMLPEHREQLLAQKRKKKEYTPPPLSTDQLEEMNFLITQSITEDQAI
RAAC02364             MNIRDGNIFEAMRLVLPEHRALMAQIQRERMKRKRPMLTEERLEEMQYVLSEAIREGRIV
                            : :    ::****        :     ..         :  :: *::.      ::     : :

ref|ZP_01860132.1|    TITHYVGRRHELLIGRI-------------------------------------------
ref|ZP_01171904.1|    AITHFRTHRHELVIGNIHYWDEIGQKLEVIDHFGEVHRIPLNTVADV-----
ref|YP_079689.1|      QFAYYRQGEVKTIAGRIHYADALKRELRIVSRADEICILKIEDIIEIEYD--
ref|ZP_02329649.1|    RFTVYDVYEDQHIAGVLIKYDPLTRSLGVISEANKAMHIMLENIIDVRLE--
ref|YP_001487332.1|   CVTYAAAGRKEQFWGWVKTIHYETQRIKIVND-EDVLNLSLQQ---------
RAAC02364             RVTMFTPERDVVLVGRVS---ARGRELR-VRTAAGVHIVDVRDVVGVEMERS
                          .:         .    . *  :
```

FIG. 63

```
ref|YP_161675.1|        ------------------------------------------------------------
RAAC02366               MRSSKTMHKEGDLLVVDTWTGREERFSYDEASAKRSEWLSQYENRERYRFYCLCRGHERI
gb|ABH06559.1|          ------------------------------------------------------------
gb|AAB95339.1|          ------------------------------------------------------------
ref|YP_001202661.1|     ------------------------------------------------------------
ref|ZP_01614696.1|      ------------------------------------------------------------ ref|YP_161675.1|        ------------------------------------------------------------
RAAC02366               RLHLVKREHWHLASNPGQARLHAPHCGFYRNEVVRIVERRKKQFGIETVETVNEKGERVA
gb|ABH06559.1|          ------------------------------------------------------------
gb|AAB95339.1|          ------------------------------------------------------------
ref|YP_001202661.1|     ------------------------------------------------------------
ref|ZP_01614696.1|      ------------------------------------------------------------ ref|YP_161675.1|        ------------------------------------------------------------
RAAC02366               SLIFHVDDFFSADQEQTEEHEPPCPNMSSAAETERTILPFKRIIVRGERKERGKLTFSGF
gb|ABH06559.1|          ------------------------------------------------------------
gb|AAB95339.1|          ------------------------------------------------------------
ref|YP_001202661.1|     ------------------------------------------------------------
ref|ZP_01614696.1|      ------------------------------------------------------------ ref|YP_161675.1|        ------------------------------------------------------------
RAAC02366               LREWYRVGLQWYEHHQQRQAKNVSELLYGMWRVMLDGTITFHDGKDPRALLFIPNRYVEP
gb|ABH06559.1|          ------------------------------------------------------------
gb|AAB95339.1|          ------------------------------------------------------------
ref|YP_001202661.1|     ------------------------------------------------------------
ref|ZP_01614696.1|      ------------------------------------------------------------ ref|YP_161675.1|        ------------------------------------------------------------
RAAC02366               WHGERQKIVVGQLGDRSRSGSGEFWRVJGIYAKGTSLRANWNVLVSEVHLCPNPHIGALV
gb|ABH06559.1|          ------------------------------------------------------------
gb|AAB95339.1|          ------------------------------------------------------------
ref|YP_001202661.1|     ------------------------------------------------------------
ref|ZP_01614696.1|      ------------------------------------------------------------ ref|YP_161675.1|        ------------------------------------------------------------
RAAC02366               ALRVKHETDQLMSVCPAKQALIVERDGCAWVDSLVEYQFHEILMNGLQRRPDVKVEKPLE
gb|ABH06559.1|          -----EQTEKSHPRSP-----------------------NVLSVALSQRTTAPEEELNP
gb|AAB95339.1|          ------------------------------------------------------------
ref|YP_001202661.1|     DNLSEYHSILMTSEDP-------------------DPDLEGEAAKEAREKDEADD
ref|ZP_01614696.1|      ---YRNEVMWLYQHKN---------------------KHYRVKNLQDALEQG-YTVAA ref|YP_161675.1|        ---------PDFIL-TDVAPEVVIEVLGMSGNADYDARIAEKRAHY--LAS-G-IPLLEW
RAAC02366               GLVEYDGRRPDYVLRMEGKPPLIIEIWGMSCKTDYDESKEKRQAFYRQLEKRGELRFLEW
gb|ABH06559.1|          KILALQNAQRKRKIEHDGS---LFQAVGIGTLLCQPDDRATTTS----------LSWKRV
gb|AAB95339.1|          ------EEQTKGAITFES----VAREWHAAN-KRWTEEHSRRV----------LKSLED
ref|YP_001202661.1|     RRLSYLGTQLDLL_NQKKP--LQKALWGISDEILALDTKEERQA-----------------
ref|ZP_01614696.1|      HVGSYYGEQFEHLKNIYPK----CIIFTGAAKTRFALLAKQRV----------------- ref|YP_161675.1|        D-------------------
RAAC02366               DSRNPRERAAVLRNICLWMKK
gb|ABH06559.1|          KGCKSSEQNGMEQKTIIFIPS
gb|AAB95339.1|          N---------------LF---
ref|YP_001202661.1|     ---------------------
ref|ZP_01614696.1|      ---------------------
```

FIG. 64

```
ref|ZP_02093159.1|      ------------------------------------------------------
ref|ZP_02091713.1|      ------------------------------------------------------
ref|ZP_02423704.1|      -----------------------------------------------------A
ref|ZP_02026447.1|      ------------------------------------------------------
ref|YP_001127515.1|     -----------------------------------------------PEAIEE
RAAC02367               MYDGRQTVVREATALQQPQWTRDIVMVNPNELVEHPRRDEAGERYDTPEAMDNLPTNLVS ref|ZP_02093159.1|      ---SVEQYGVLSPLIARPRP--EGGYEIISGHRRQHAAQLAGLDTLPVIVRQMDDDAAVL
ref|ZP_02091713.1|      ---SVEQYGVLSPLIARPRP--EGGYEIISGHRRQHAAQLAGLDTLPVIVRQMDDDAAVL
ref|ZP_02423704.1|      LAESIKMHGVVSPITVRPLENTADEYEIISGHRRVMASRKAGITEVPALVVSLDRDAAAI
ref|ZP_02026447.1|      LTESIRERGVLLPTLVRKTN--DEEYEIISGHRRTHAARLAGLEKVPVIIRELSNDDATI
ref|YP_001127515.1|     LKQSILQHGILQPLIVRRSL---KGFEIVVGERRYRAAKEANLPSVPVVVRELTDEQMME
RAAC02367               LQANILQNGIREPLLVQRST-----NILMTGHFRRAVAIQAGWTEVPVQYLDVTDEEAYA
                          .:    *:   *::.:        ::  *. *   .:  *.   :*.    .:   :

ref|ZP_02093159.1|      LMVDSNLQR------ENILPSERAFAYKMKLEALKNQGARSDLTSVQVAP--------KL
ref|ZP_02091713.1|      LMVDSNLQR------ENILPSERAFAYKMKLEAIERTVGRPKNVG-QVVPD----YFGKK
ref|ZP_02423704.1|      VLVDSNLHR------EHILPSEKAFAYKMKAEALAHKGYRTDLTSVQVAP--------KL
ref|ZP_02026447.1|      VMVDSNIQR------EEILPSEKAYAFQMKLEAIHHKGIKG---------------AE
ref|YP_001127515.1|     FALLENLQR------EDLNPIEEAMAYKMLMDKLH------------------------L
RAAC02367               IMLADNWERNTGIMEDYMAVARNMFYFALRLKLLNEIDDDSVDISPSRKQEGTVPSFSSE
                          . :.* .*       :   :   ..   :    :

ref|ZP_02093159.1|      STEKIGEEVGMSKDNVKRYIRLTNLVPFLLDMVDEKKIAFNPAVELSYLDEAQQRDFLE-
ref|ZP_02091713.1|      STEIVAEGTGESYKQVQRFIRLTNLIPELLDMVDEKKIAFNPAVELSYLDESQQRDFLE-
ref|ZP_02423704.1|      ATEQIAEDAGTSKDTIKRYIRLTNLIPEILQYVDDGRIAFTPAVELSYLNEQECYDLL--
ref|ZP_02026447.1|      SREVVGEANGLSGRQVSRYIKLTNLLPELLEMVDKKKIAIKLAVEIAELSESECQEILDY
ref|YP_001127515.1|     TQEETASRVGKSRPHIANHLRLLSLPPEVQKLLIDGTLSMGHGRALLGLKKKGKMKSIVE
RAAC02367               IVHLVSKKFERSRAVVRKHFALLKLIPELQHWISEKKIGFEGGAMLAGMSEQAQRDFMRD
                         . :..  *    :   ..: * .* **: . :  ..:    : :.:   : . :

ref|ZP_02093159.1|      -------------------------------------------------AMNDTQNA
ref|ZP_02091713.1|      -------------------------------------------------AMQDTQNA
ref|ZP_02423704.1|      ------------------------------------------------------
ref|ZP_02026447.1|      FNLGYKVS---------------------------------LEQVKAIKNKEKS
ref|YP_001127515.1|     R------------------------------------------------TVREGLNV
RAAC02367               YADWPKISDSDIKAFRNTWESIVERQTNGLGAAEKPISIPEPSSETLVAEWEEMRSDESV ref|ZP_02093159.1|      PSLSQA----------------------------------------------------
ref|ZP_02091713.1|      PSLSQA----------------------------------------------------
ref|ZP_02423704.1|      ----------------------------------------------------------
ref|ZP_02026447.1|      TDIIERPEEKTKESTKVTISRKKLKQYFP--------ENYTKAEMENTTYQLLEKWKSDG
ref|YP_001127515.1|     RQLEKLVQQMNENVSRETSKRKPPEKSVF--------IRESESLLRE-----------
RAAC02367               PHITKYASDAYELSVVADGGRHQPMYSAEKRSISIVDVPEHKTLLARNRLALLVKKQRRA ref|ZP_02093159.1|      ----------
ref|ZP_02091713.1|      ----------
ref|ZP_02423704.1|      ----------
ref|ZP_02026447.1|      YDI-------
ref|YP_001127515.1|     ----------
RAAC02367               MERMTNELSQQAEALMEEIKEGGLQEMMEDIEQLEFHTKGMLALIENLKLHDREAVQRLS ref|ZP_02093159.1|      ----------
ref|ZP_02091713.1|      ----------
ref|ZP_02423704.1|      ----------
ref|ZP_02026447.1|      ----------
ref|YP_001127515.1|     ----------
RAAC02367               DIFEEFEDHA
```

FIG. 65

```
ref|ZP_00960984.1|     -PQICKGAPMAPRKL-YAGAKLRETRSRLGLTQKDFAARLGVSLPYLNQMENNNRPVSTT
ref|ZP_01903846.1|     -------------------AKLRETRQRLGLTQKDFATKLGVSLPYLNQMENNNRPVSTT
ref|ZP_01880414.1|     -------------------AKLRETRQRLGLTQKDFAGKLGVSLPYLNQMENNNRPVSTT
ref|ZP_01035782.1|     -------------------AKLRETRQRLGLTQKDFAGKLGVSLPYLNQMENNNRPLSTT
RAAC02370              MPRLSKDALVPPEKRDTFIAWLINKRDELGFTQKDMADFLGLSLSYYNAIENRKRNLSAK
ref|ZP_01742943.1|     -----------------------RRIDLGLRQGDLALKVGISPAYLNLIEHNKRRIGGK
                                            *  **:  *  *:*     :*:*  .*  *  :*:..:*   :. .

ref|ZP_00960984.1|     VVLALAQE----------------------------------------------------
ref|ZP_01903846.1|     VVLALAQE----------------------------------------------------
ref|ZP_01880414.1|     VVLALAQE----------------------------------------------------
ref|ZP_01035782.1|     VVLALAQE----------------------------------------------------
RAAC02370              LVIQLASKLPQGPRFAVQLLGPEVVGKYMNLIQLPPEKEEEYEAEDALLDAIQQREKSAT
ref|ZP_01742943.1|     LLVSLAATLAVEPIALTQGGAAAVVAGLKNAASNAPQIDVEEANVDQFL-----------
                       :::  **

ref|ZP_00960984.1|     ------------------------------------------------------------
ref|ZP_01903846.1|     ------------------------------------------------------------
ref|ZP_01880414.1|     ------------------------------------------------------------
ref|ZP_01035782.1|     ------------------------------------------------------------
RAAC02370              DYLGLLRSVLHHSKAVMAVSVQPNLCWFGLTPEDVAIITFVTDLKALIPGQLVYVVDRTA
ref|ZP_01742943.1|     ------------------------------------------------------------ ref|ZP_00960984.1|     ------------------------------------------------------------
ref|ZP_01903846.1|     ------------------------------------------------------------
ref|ZP_01880414.1|     ------------------------------------------------------------
ref|ZP_01035782.1|     ------------------------------------------------------------
RAAC02370              QAGEFAFVRALHGKELTSVESTLMMMLDLPRDTTQLFEWGIDPRRALMSWNADDPNLMVC
ref|ZP_01742943.1|     ------------------------------------------------------------ ref|ZP_00960984.1|     ------------------------------------------------------------
ref|ZP_01903846.1|     ------------------------------------------------------------
ref|ZP_01880414.1|     ------------------------------------------------------------
ref|ZP_01035782.1|     ------------------------------------------------------------
RAAC02370              EVVTICKASPSRIVPLTSPGYEEWSLLERKTILQQGIVYNRLRQEMKETLQKFRRIMATQ
ref|ZP_01742943.1|     ------------------------------------------------------------
```

FIG. 66

```
ref|ZP_01551668.1|    ------------------------------------------------------------
RAAC02371             MRMGKADEWEARSEQRADEVSRALVRMGVMTHGQLTRLLGINPKSERDLIRRWWDRFEEQ
ref|ZP_02756730.1|    ------------------------------------------------------------
ref|YP_521772.1|      ------------------------------------------------------------
ref|ZP_02833143.1|    ------------------------------------------------------------
ref|YP_887014.1|      ------------------------------------------------------------ ref|ZP_01551668.1|    ---------------IKQNNFSEAIKLGESLIANSGQLDHIRINKK---------------
RAAC02371             HNVAKWVASSRYSVPGNRVMRLVRLTDAALTEWAEREGIRRARNRVKPRMLAQTINMGEV
ref|ZP_02756730.1|    ----------YAIIGKRIRNYRKRAGYSQEALAKKAGLFHAYLG----------------
ref|YP_521772.1|      ---------MNIGMAREQDKLAMQSSLPTEAQRVLVREHPCKSVELLR-------------
ref|ZP_02833143.1|    ---MADLQAFEWVGAECARRTLSRLSPRKLSTMKAPVIFANEVATG---------------
ref|YP_887014.1|      -KNPRLADDIVSAVAELGPATAGQIEAHLEAEPRGRKGPWWDRSDT--------------- ref|ZP_01551668.1|    ----------LIECSMMLSQIDKANLYLKKLSLNDPDYKFYQALIYQKLSRNEKAMK--I
RAAC02371             LIALRRDGALYDEWDMMLPQDGDEGLHAWLVKQDDPDYRMGLFLLPTRLTQEEQGKKGLI
ref|ZP_02756730.1|    ----------------QIERGESKASLRSIFKIANALEMPLEILFENIIQNEKDPE---
ref|YP_521772.1|      ----------------LMGVSDEDQLDIVRWHHEVNESHGLAHNVMARRLLRLADGFV---
ref|ZP_02833143.1|    ----------------LFGHLVGAIAGGAVYRKSTFLLDSLGKQILPEWLTIEEHPHL---
ref|YP_887014.1|      ----------------KWVAEALFAAGILTTATRVGFARHYDLAENVLPPEVLAREVGDE---
                                      :    ::   :

ref|ZP_01551668.1|    YQELIR-----------------------------------------------SGYRNA
RAAC02371             YHGVIRRVIQNTKIRDTLFLVPRKYYTVALRLLSYIEQVGGGLYVLPFEAFLKNPGWYLD
ref|ZP_02756730.1|    ------------------------------------------------------------
ref|YP_521772.1|      ------------------------------------------------------------
ref|ZP_02833143.1|    ------------------------------------------------------------
ref|YP_887014.1|      ------------------------------------------------------------ ref|ZP_01551668.1|    SIYQN-------------------LGYEFASLG-----QHKLAQNYYTEAINI-----
RAAC02371             SIYRGESQQRASLIDVLRPVRKLNMPLQYQFAALVQLPDGYRMIDTYTSGDVKRVQNWI
ref|ZP_02756730.1|    -------------------------------TLSSEA------YELIDSLTSKEQKAIIKLL
ref|YP_521772.1|      ----------------------------------------AKMAARKTRLAMSPLGAAK
ref|ZP_02833143.1|    ----------------------------------------RKGLASSPFDSEGVRTER
ref|YP_887014.1|      ----------------------------------------EAVRELALRAATAL----
                                                              .

ref|ZP_01551668.1|    ------------------------------------------------------------
RAAC02371             RFVLGYQVPNTGQVACADVYVFDETMREGLDAVLRMKSKKRFDVSMVEVHAWPEGMVTPK
ref|ZP_02756730.1|    KEIIEYR-----------------------------------------------------
ref|YP_521772.1|      SVFLG-------------------------------------------------------
ref|ZP_02833143.1|    RDTVKDGVL---------------------------------------------------
ref|YP_887014.1|      ------------------------------------------------------------ ref|ZP_01551668.1|    ------------------------------
RAAC02371             PGRDELRDAFDEVDDSHIDWDAWLNEPW
ref|ZP_02756730.1|    ------------------------------
ref|YP_521772.1|      ------------------------------
ref|ZP_02833143.1|    ------------------------------
ref|YP_887014.1|      ------------------------------
```

FIG. 67

```
ref|YP_324842.1|            ------------------------------------------------
ref|NP_486002.1|            ------------------------------------------------
RAAC02372                   MAKRMHPVNKINLEMLKNSNDPLDMLRQWGILMSTVYETLTQLTMNEDDE
ref|ZP_01733540.1|          ------------------------------------------------
ref|XP_660834.1|            ------------------------------------------------
sp|Q7ZXB1|MCM7B_XENLA       ----------------------------------------------GL ref|YP_324842.1|            ------------------------------------------------
ref|NP_486002.1|            ------------------------------------------------
RAAC02372                   LVTEYLSGI-EELDDKIQEYLYEEAAARIAHFDERTSKVVFDQWPTGLCL
ref|ZP_01733540.1|          --------------NPVHHYKMNVGLLQQNDYADFIVVEDLVNFKVSKTF
ref|XP_660834.1|            ------------SRNDQELAKYGAVALRLAMLVGALVDAEERRQELQ---
sp|Q7ZXB1|MCM7B_XENLA       LSETYLESHRLVKMNKTEDDELGTEELSEEELRQITEEDFYEKLAASIAP ref|YP_324842.1|            ------------------HGSKDQQHPLYNR----DRPF-I---------
ref|NP_486002.1|            ------------------HGSKDQQHPLYNR----DRPF-I---------
RAAC02372                   VPSNFGFEIRNLPVWMLGHGAKRKHHPLYHR----DRPF-IRRQLWYWL
ref|ZP_01733540.1|          ING----------ELVAENGISNVKHVPFDR----PNNFNITTKTISDFE
ref|XP_660834.1|            ----------------GNGRSVSYSIAWMS----EEQQ----QRIQEIL
sp|Q7ZXB1|MCM7B_XENLA       ---------------EIYGHEDVKKALLLLLVGGVDHSPRGMKIRGNINVC
                                                         :

ref|YP_324842.1|            ------------------------------------------------
ref|NP_486002.1|            ------------------------------------------------
RAAC02372                   VHELKWNYLNSVASWDDSLLPKNPPRYAHMNIRFMSRNDYEIRDLDNYVV
ref|ZP_01733540.1|          IES-TASKIRVIE-----------------------------------
ref|XP_660834.1|            GQRHPETYLSVRY-----------------------------------
sp|Q7ZXB1|MCM7B_XENLA       LMGDPGVAKSQLLSYIDR------------------------------ ref|YP_324842.1|            ------------------------------------------------
ref|NP_486002.1|            ------------------------------------------------
RAAC02372                   SLPMIVNALVANGLIQSDRPGYFTYSVEWVQKHEQDEVQEPTTTLRVRYL
ref|ZP_01733540.1|          ------------------------------------------------
ref|XP_660834.1|            ------------------------------------------------
sp|Q7ZXB1|MCM7B_XENLA       ------------------------------------------------ ref|YP_324842.1|            --------
ref|NP_486002.1|            --------
RAAC02372                   ERPNVSTL
ref|ZP_01733540.1|          --------
ref|XP_660834.1|            --------
sp|Q7ZXB1|MCM7B_XENLA       --------
```

FIG. 68

```
ref|YP_001236354.1|        ----VVRTGAAMTIRFRRITDG---DLFAIRNWLH-QPHIRQW----WGDPDEQY
RAAC02296                  MGEFMCHPPVLRIGARREIRGRRIREGRHPGLSDLREFLLTEPHIRHR----QADHDDHH
ref|XP_001563017.1|        ----------HLSSHVAER-NDQHER----VDDWRGVPPKLPGSSYR----YEERHPQQ
ref|ZP_01776409.1|         ----LCQPP--RLHDRRRHRGRRLREQG--RPGQIRGVLDLHQDGRQQPLEAERDQPEVT
ref|ZP_01565636.1|         ---------------RREQHDQRQHGR----RADFHPVLLADEHHGQR----AADEQDHR
ref|XP_001615133.1|        ---------------KSSLKGAKKKKGRGSYTDDLAEHETTWENKKRR---RSAEGDNHD
                                                    :                              :

ref|YP_001236354.1|        GLIDGDRDEP--------------------------------
RAAC02296                  EQPDDDLPHPPR---LLSCST-IRFESEHFTPRVRHIFIHLHSRA
ref|XP_001563017.1|        RHMAHHHHQPA-------------------------------
ref|ZP_01776409.1|         APPDIGLKPPLKGTGSARCRSPFSELAARLRPKKWRLFVELH---
ref|ZP_01565636.1|         PREPREQPHPQR----------QVRAARFE--------------
ref|XP_001615133.1|        EQEDDEEYEPKR----  KVPRKDMDDDYEIINT----------
                                     *
```

FIG. 69

```
ref|YP_001376930.1|   ------------------------------------------------KIKTYKVEG
RAAC02373             MLTIGLDVGNGSIGLCVRDGDTLVQDTTPSVYGRVDPTRQVLSVPGKSAPRKVDVFTFGG
gb|AAW81277.1|        ------------------------------------------------------------
ref|YP_001312077.1|   ------------------------------------------------------------
ref|ZP_02852259.1|    ---VGIDLGYGYVKFIDGKEP----KMFPSVVGYGNSQKYKSALQLDLNPLDDLQIKIGD
ref|YP_001642790.1|   ------------------------------------------------VYTYEG ref|YP_001376930.1|   TEYVWGDDIIKVNN--TLNTYAQQNRYKTNQYKTLSKIALAEMAAKTNVKS--YDEILVI
RAAC02373             EHFVLGYKNVHAMHSTPIGAYDREQRYASRQFETLAKLALLDAATRTGRTG--VIEVVVA
gb|AAW81277.1|        ------------------------RYNSEAFKLLANFALGLLASDFKIANNQVLEVVVT
ref|YP_001312077.1|   -------------------------------------------------------VRVI
ref|ZP_02852259.1|    EHFPIGDLAIRQSEVASRSLGKDRSQDKKARVLMLTALSLLSSWDKQ-------GFNLV
ref|YP_001642790.1|   IRYVICEAQC------ISSSARNDDRYSSAGYRTETILAISQLVKDGS--------EIVVG
                                                                         .  :

ref|YP_001376930.1|   TGVPSEEIG---TKAVDEIKEVYQGAHDLEVNGKKVSINVVDVIVLAQPVGTVMSRYLDE
RAAC02373             CGTPSEDFT---TRTVEIMQRWFSEPVTGAKNGEQVVVMIKRLEVIPQPFGVFLDAYLDQ
gb|AAW81277.1|        AGLPTGDYAD--QERLRSLLKVLEGQHQVTIDDQIVTVRVRKVYILPQPTGTLYNELLDD
ref|YP_001312077.1|   TGLPAQFFA---EQKNSLIKALENRRVFMKLNGENRSFTITKVIVFPQSAG---------
ref|ZP_02852259.1|    TGLPTNFYAAFAEEEWESTLNGEFKTKMKIGGKTQERSFQIEEVTTLPQPFGTLYDQVLNS
ref|YP_001642790.1|   TGLPSEDYKN--GDNHEKVKRNLVGEHTVQIDGKTKTFSILRVYTPMQPIGSVVNRIYDY
                      * *:         :           . :   . :   :    *. * ref|YP_001376930.1|   DGFVADDTYED--MTVGIIDIGTGTTDLDVISMLRREKE-STSVPKGMHDVYEPIVAKIK
RAAC02373             DGLVVDEELEK--QDVLVIDSGSSTLDLSEIHRLELTR--QTSIPAGLNDVYQLILEEIR
gb|AAW81277.1|        QCFIKNKALLD---EKVSIVDVGGGTILTDTILNFELSGKNRCQFNTGVNDLYEAIASRIE
ref|YP_001312077.1|   -LFLYDKSLVE--KDTLVVDIGGGTLDIAYMSNGQFKEG--RTYPLGVNPTYDVLLQELT
ref|ZP_02852259.1|    VGKVVDRDLTD--SKIGIVDIGFKTTDLAVSDGMEFINPLSFSTTTGLSNVNRLVNEKTR
ref|YP_001642790.1|   NLKVRKDMESERTARKLVIDIGFGTTDVCEAEGLRIVRY--DGVQVGMLEANRIIKDELS
                         :  .      ::* * *   :         .        *:       :   . :

ref|YP_001376930.1|   K---------ETS----ATINDYKLEKVFEEGAYQASKRMDPID-FNDE--KTASIKE
RAAC02373             R---------EEPKVYATAYDLEAQLRAQDGAQEFWFEYGALR-MNITNLRERAMRQ
gb|AAW81277.1|        G---------DVS-----LYQLEKELRHGNQQHQWSYRFSKNRQDDITELVGKESDR
ref|YP_001312077.1|   K---------YGVN-------YSNRMKAEQIIADKAIFVEGKE-IDVSKDIDNVLSL
ref|ZP_02852259.1|    H---------EFKID-------REEHQLDDCINSQKIMVAGKS-EDISSWVREALQT
ref|YP_001642790.1|   KRGARGIVSLLHMDTLLRNAKREYVKDEFTDKEILSKVIIEIGGKE-YEIKDLMEQALEY
                       .               :    :

ref|YP_001376930.1|   VYDFIVNGVNNAWKTFDRFDEVLVSDGGANTF-HELLEEWIGKVTKLEES--QTANVEGF
RAAC02373             VWDRMQQGIQYAYPDRSSFGRVIIAGGSGEAF-RNYFLAWMPSIRIAPEP--QLAVARGL
gb|AAW81277.1|        FTRRLVANVTSTLKNLDSIDTLFFTGGGANLINQKIILKTTFTNAALVKDT--EVANVNGF
ref|YP_001312077.1|   RAGEIINAIKQAFPEQSKYSRFVFIGGGALLLKNY----------------------
ref|ZP_02852259.1|    VSDKTSVETESKWDYRD-FDTLLLTCGGGEML-YPYLKDKFPNLVLVEDP--QTANVRGY
ref|YP_001642790.1|   TARIVMQRVDNLGYVLKDYDVVLFTGGSLLAL-HKYIKPYLTGVNTKAEQGAQTANVKGY
                         :   :           .  ... .*.  :

ref|YP_001376930.1|   YRYGKFEVGEE-
RAAC02373             YKYALAQGAEES
gb|AAW81277.1|        YKYGLSQQVQE-
ref|YP_001312077.1|    .        ---
ref|ZP_02852259.1|    QKLA--------
ref|YP_001642790.1|   TKYAMIQDAK--
```

FIG. 70

```
ref|XP_001467069.1|    LVSTWPQSRRFLESRILQTADMQAEDMISGDGGS-----QHIEDDSVSVTPSTS------
ref|YP_001208199.1|    ------------------------------QGAGGL-----SGMQSSSPSSSSSTP------
ref|YP_946581.1|       --------RRLAERLTARLNEIYAERQLMAVGGSEWAAPGAAPQSNPGIPASTA------
ref|YP_001376929.1|    ---------MANKTYLLSYDDVLDKDIKEWLESL-----PRNRKAEMVRAI---------
RAAC02374              ---------MTIRRYVLSYDDEYDREIAEVIEQT-----PKRRRAERVRQLTLLGIQAEA
gb|EAU86007.1|         -------QTVIVKRRAKPEPTGYDGNPTNAAASP----- AFSTTQLTASPPSL------ ref|XP_001467069.1|    ---------------------APS-PAPRSAAATGAPPLAPR-----
ref|YP_001208199.1|    ---------------------SSTGLEPRSGGAGGCQPLMPNVRITP
ref|YP_946581.1|       ---------------------TPAHMMAQAGSSTGADPVLAR-----
ref|YP_001376929.1|    ------------------------------------------------
RAAC02374              EMRGEGGMKPVQTGSPASDDSSIPPSPQTFQSGSSTGKRPVIPRITPKS
gb|EAU86007.1|         ---------------------FPNSPPTGTSSGIRPLIPHIVPPS
```

FIG. 71

```
ref|XP_975359.1|    ------------------------------------------------------------
RAAC02375           MCKMWTKRWTDFLAVSILTATVTGCGQIPHAVSQTSSTATPAPSVHAVVDRLPGHLQAKL
ref|ZP_02840410.1|  ---------------------------------------TPAKAGEAHLERLLRHVHSR
ref|ZP_01467536.1|  ----------------------------------------QGXLNRIDVASKRVTPIPHIV
ref|YP_001016790.1| ---------------------------------------PLRLRCWRISMRTMVQRAAAE
ref|XP_001315633.1| ---------------------------------------LQAEFINFENAEN ref|XP_975359.1|    ---------------------------------------------------RRKSKEENK
RAAC02375           IGFDVRKKRVSHLPIAVKGTNVLYISPMEQYAIQQFQQIWPRLKAYPVVVWTGVTKAQAE
ref|ZP_02840410.1|  AGLEAAPSRIED--------------------QLDHV-----------ARTVKGRNL
ref|ZP_01467536.1|  KGTRTLFARVHS--------------------PQAQAVVPERFPVKMLRWVQVSPKGDR
ref|YP_001016790.1| LGIEVIPSRRTY--------------------ALLDWLAERE--------RDVYPLEEG
ref|XP_001315633.1| TGFSLKQS-----------------------SKLVIS---------EQRSNKNYQ ref|XP_975359.1|    LDREKSDYAPESVPIVGEE-------NGVHYYEDGHFWMEVPG-LLPESEEED------
RAAC02375           MVWRKEGYPGDPLPSQQTEYVSQTIPTPDAYHRDGKAWVEVPG-ILPASQLEDWVTFFR
ref|ZP_02840410.1|  LFVVADEIPASPALEQLLR---------RLRAQHEILWLTIR-----DAE---------
ref|ZP_01467536.1|  VVYQALGHLYTRELPDGLP---------RRLTKQTEHFEMHPS-FSRDGKSIV------
ref|YP_001016790.1| YMAGPLAPPPTPIPTPPVP-------LPEAVRGDAWSWASLPLGLLRFAQ---------
ref|XP_001315633.1| KFWQRL-WSAMTMPLALWEG--------ATSKKIEMIYQRD-----------------
                                                    :
```

FIG. 72

```
ref|ZP_01091610.1|   ------------------------------------------------------------
RAAC03273            MDMAWEPSQDPYTLLQDFSCFYGTDVKGPNSVLTQKDMMAIRNNIVEVSRGWRQLGPNKV
ref|YP_944003.1|     ------------------------------------------------------------
ref|YP_502758.1|     ------------------------------------------------------------
ref|YP_462360.1|     ------------------------------------------------------------
gb|EAU81483.1|       ------------------------------------------------------------ ref|ZP_01091610.1|   ------------------------------------------------------------
RAAC03273            ELLEPLMDPSAVSGAFV-YLAKEHEDWSLSDWPKVYLAFIRTVDSQTLTFEPNGNVIYTY
ref|YP_944003.1|     ------------------------------------------------------------
ref|YP_502758.1|     --------PSEVSGNFLSALNKLSLDDYSKIITSIESGFSTNLDSIIQLLERKGQIILYG
ref|YP_462360.1|     ------------------------------------------------------------
gb|EAU81483.1|       ------------------------------------------------------------ ref|ZP_01091610.1|   ----------------------------------------------------------RL
RAAC03273            KRGTGLTPNVTGVFEKGVDTVYSSYSYSDQIGVEAYKEDDPSLNSKIFYEPDYQVFSPKT
ref|YP_944003.1|     ------------------------------------------------------------
ref|YP_502758.1|     PPGTGKT---------------------------------------------YSVQSLIK
ref|YP_462360.1|     ---------------------------------------------------------HSYR
gb|EAU81483.1|       ------------------------------------------------------------ ref|ZP_01091610.1|   HRSNYTYTYT----ASCGTLSFSQWACVALTFDG-----------YQYRFYKNGFLISTH
RAAC03273            HLSNYHYSYPGYVPPSNGQIAFELWGTVCDPYTARVGGAIFIEGMYEFTYY-NGHLVNAH
ref|YP_944003.1|     ------SYSYN----DEVGTLDY-ILASASLK----------------DKIVDSMYWNIN
ref|YP_502758.1|     KTASTPYIST    TKDYGNIQFFWLITYKDKYDDIS---------TINSKSIYTYQWKSN
ref|YP_462360.1|     AGAGLTYNLT--EISDLG-LDYAYSKSDYDEEDK------------VDSTKDTVSMAYR
gb|EAU81483.1|       ----YPGYIP----PSSAQIESALRGTIYDALIRR----------IMWEGVRGKWGVPST
                                    . . :

ref|ZP_01091610.1|   GIGGSPVNNPAASVWIGD---
RAAC03273            QIGQESENYPSEVTRYGD---
ref|YP_944003.1|     SSESSLFEYSTKYTGYLP---
ref|YP_502758.1|     YNYSKYFYMINEGDYFAIYLW
ref|YP_462360.1|     HFFRERRDIVTVTPFYSRY--
gb|EAU81483.1|       HQGEDGEERYSEIDTWG----
```

FIG. 73

```
ref|YP_074959.1|       ------------------------------------------------------------
ref|ZP_01846154.1|     NTEGRASECATALYTICREGINMETHYLBACTERIUMSP GBACAINTEGRASECATALY
ref|YP_594046.1|       ------------------------------------------------------------
RAAC02967              ------------------------------------------------------------
sp|Q45618|TRA6_BACST   ------------------------------------------------------------
ref|YP_828009.1|       ------------------------------------------------------------ ref|YP_074959.1|       ------------------------------------------------------------
ref|ZP_01846154.1|     TICREGINMETHYLBACTERIUMSP-GBACAHYPTHETICALPRTEINMMETHYLBACTE
ref|YP_594046.1|       ------------------------------------------------------------
RAAC02967              ------------------------------------------------------------
sp|Q45618|TRA6_BACST   ------------------------------------------------------------
ref|YP_828009.1|       ------------------------------------------------------------ ref|YP_074959.1|       ---MAP--------------------------------------YRPMAKAAATVRF
ref|ZP_01846154.1|     RIUMSP-SCRESIGNIFICANCEE-IDENTITIESPSITIVESGAPSLRPSAPLPIERRF
ref|YP_594046.1|       ---VRPFRR-----------------------------------TQVSAARVTTRF
RAAC02967              ---MKPLR------------------------------------PVVSAKATERF
sp|Q45618|TRA6_BACST   ---MKPFR------------------------------------ETAKKKYTVRY
ref|YP_828009.1|       -----PWR------------------------------------EECRERAFVRF
                          *                                            *:

ref|YP_074959.1|       ETPPGKQAQVDWADFGYIEVD--GRRLKLYCFIMVLAYSRAMYLEFVTATDMKTFMRCHI
ref|ZP_01846154.1|     ETPPGEQAQVDLARFEVVFADEPGVTRIVWLFAMVLGHSRYLWARFVVHQDLQTVLRCHI
ref|YP_594046.1|       ETAPCEQAQVDFCRYSYLNLE--GQTRSIWAFVMVLCWSRALYVEFIRKADTASFIRCHL
RAAC02967              ESDPGEQAQIDLGAFLYYDSH--GQRRTIWAFAMVLAYSRMLYVEFIKAADQLHILQALR
sp|Q45618|TRA6_BACST   ETLPGEQMQVDWKEVGEVVIE--GKKVKLSLFVATLGYSRMKYAVFTPSQDQEHLMECLI
ref|YP_828009.1|       ETGPGEQSQMDWGHFGN--WD--GR--RLYGFALTLCYSRMRYIEFTQSQDIHHLLACMV
                       *: **:* *:*         .  *  : *  * * ** :  *   *   .: - ref|YP_074959.1|       NAFKFFGGVPHEILYDNVKTVVKDRDDDNRPVFNERFLDFSSYYGFRPRLCLFYHAWTKG
ref|ZP_01846154.1|     AAFQALGGAPREILYDRMKTAVIGEDPDGLVIYNRSLLDLARHYGFLPRACRFYRAKTKG
ref|YP_594046.1|       NAFAYFGGMTQSILYDNTKQVVLERDETGQPVWNPQFLDFSLRLGFSIRLCRFYRPRTKG
RAAC02967              NDLEFFGGVPRVMLSDNCSPLVVANDGQGHVDWQPAYLDFAKFYGFVPKACRPRRSRTKG
sp|Q45618|TRA6_BACST   QSFKYFGGVPKKVLFDNMKTVTEGREQ-GVVKWNQRFSEFASYYGF-PKVCRPYRAQTKG
ref|YP_828009.1|       RAFRYFGGVTESVLTDRMKTVLIDQTG-GELHFNQKFLQFAAYYGFVPRVCRPYRPETKG
                          :**  .. :* *. .         .    ::    :::   **  : *  *  :. *** ref|YP_074959.1|       KVERPVRYIRQNFW---
ref|ZP_01846154.1|     KVERPFRYLREDFF---
ref|YP_594046.1|       KVESGVGYVEKNFW---
RAAC02967              KVERPIRYIRDSFWPVA
sp|Q45618|TRA6_BACST   KVERAIQYIMDHFY---
ref|YP_828009.1|       KIESSVRFVKQNFWP-
                       *:*   . ::   *:
```

FIG. 74

```
ref|YP_148969.1|        ------------------------YLQLAHNEWDPKAKYAKAKVIYSFGREDEVDRAVLER
ref|YP_001126171.1|     ------------------------YLQLAHNEWDPKAKYAKAKVIYSFGREDEVDRAVLER
ref|YP_146154.1|        ------------------------------------------------------------
ref|YP_146741.1|        ------MYIRRVTRKNKDGTTVAYVQLAHNEWDPKAKYAKAKVIYSFGREDEVDRAVLER
RAAC03589               MPYHVGMYIRVIRRKNKNGSVTGYVQLAHNFRDPNTGQPKAKVLYTFGREDEIDLEALRR
ref|ZP_02130848.1|      ------MYIRTISRKNKDGSKVEYVQLAHNYRDPKSKQARAEVLYSFGRKDQLDMEAIRR ref|YP_148969.1|        LAKSISRFLSPEQAWEIETLTGEVSDDFQFQSSKRLGGAWLLDQLWRQLGLGEILHSLFA
ref|YP_001126171.1|     LAKSISRFLSPEQAWEIETLTGEVSDDFQFQSSKRLGGAWLLDQLWRQLGLGEILHSLFA
ref|YP_146154.1|        ----------------------------------------------------------VC
ref|YP_146741.1|        LAKSISRFLSPEQAWEVEKLTGEASDDFQFQSCKHLGGVWLLDQLWRQLGLGEILHSLFT
RAAC03589               LAQSIHRFVG--DEFTAGRGQSERIQTTLLDS-RPMGGAYLLDELWRQLGLDEVLRERLA
ref|ZP_02130848.1|      LAKSVERFLAKTGDVETQCKLQFPGEDVRFVESRPMGGVFVLKKIWDRLRISECLDKALA ref|YP_148969.1|        SRHHQIPLERLIFAMVANRALHPSSKLAMEEWVEKDVHIPHLPQVASHQLYRAMDELLAV
ref|YP_001126171.1|     SRHHQIPLERLIFAMVANRALHPSSKLAMEEWVEKDVHIPHLPQASHQLYRAMDELLAV
ref|YP_146154.1|        SRHHQIPLERLIFAMVANRALHPSSKLAMEEWVEKDVHIPHLPQVASHQLYRAMDELLAV
ref|YP_146741.1|        SRHHQISLERLIFAMVANRALHPSSKLAMEEWVEKDVYIPHLPQVASHQLYRAMDELLAV
RAAC03589               DRKFKAAVERVIFAMVANRALAPSSKLAMEEWVDREVALPGMTELDVWQAYRAMDFLHDV
ref|ZP_02130848.1|      DRQYTAPIGDAVFAMVANRALAPDSKLAVEDWAAKDVHLELDQPLKVQHLYRAMDFLLEN
                           .*:.     .:    :********* *.****:*:*.   ::*    :    : ****A * ref|YP_148969.1|        QPELERQVFHAVADLLNLEVDLIYFDTTSSYFEVDPSETPEGESLRKQGFSKDKRPDLVQ
ref|YP_001126171.1|     QPELERQVFHAVADLLNLEVDLIYFDTTSSYFEVDPSETPEGESLRKQGFSKDKRPDLVQ
ref|YP_146154.1|        QPELERQVFHAVADLLNLEVDLIYFDTTSSYFEVDPSETPEGESLRKQGFSKDKRPDIVQ
ref|YP_146741.1|        QPELERQVFHAVADLLNLEVDLIYFDTTSSYFEVDPSETPEGESLRKQGFSKDKRPDLVQ
RAAC03589               AEDLQYEVFRRVSDLLNLVDLLFFDTTSTYFET---EDESDDSLRRRKGYSKDHRPDLPQ
ref|ZP_02130848.1|      QEAIQKEVFWSTANLLNLEVDLVFFDTTSTYFER---DEEDEEGLRRYGHSKDKRKDLPQ
                         :: :  ,:::*:*:*** ;*    .     . . .*:: *.***:* **   * ref|YP_148969.1|        IVIGLAVTREGVPIRAWVWPGNTMDMTVIKQVKQDLIGWKLGRVISVMDRGFSSEENLRI
ref|YP_001126171.1|     IVIGLAVTREGVPIRAWVWPGNTMDMTVIKQVKQDLIGWKLGRVISVMDRGFSSEENLRI
ref|YP_146154.1|        IVIGLAVTREGVPIRAWVWPGNTMDMTVIKQVKQDLIGWKLGRVISVMDRGFSSEENLRI
ref|YP_146741.1|        IVIGLAVTREGIPIRAWVWPGNTMDMTVIKQVKQDLIGWKLGRVISVMDRGFSSEENLRI
RAAC03589               VVIGLAVTRDGTPVRCWTWPGNTADMSVVEEVKQDLIGWRLGRVTTVVDRGFVSESNLRI
ref|ZP_02130848.1|      VVVGLAVTKEGLPIRSWVFPGNTPDVNTVEQIQKEMNDWKLGRVVWAMDRGMTSEENRAI
                         :*:*****::*:*;*.*.:****  *;..:::;:::;  .*:**:  .;*.** *   * ref|YP_148969.1|        LQQAGGHYIVGEKMRSGKAAVEEALNRRGRYQQVRENLHIKEIIVGDGEARQRYVLVYNP
ref|YP_001126171.1|     LQQAGGHYIVGEKMRSGKAAVEEALNRRGRYQQVRENLHIKEIIVGDGEARQRYVLVYNP
ref|YP_146154.1|        LQQAGGHYIVGENMRSGKAAVEEALNRRGRYQQVRENLHIKEIIVGDGEARQRYVLVYNP
ref|YP_146741.1|        LQQAGGHYIVGENMRSGKAAVEEALSRRGRYHEVDENLHIKEIIVGDGEARQRYVLVYNP
RAAC03589               LQRAGGHCIAGEKMTSGKPAVEAALARPGRFRELRPNLKVKEVVVGDGEARVRYVLAFNP
ref|ZP_02130848.1|      LQRGGGNYILGEKLR-GSNMSKAVLGSPGRFTTVRDNLEIKEVTAGDGACRRRYVIVRNP
                         **:.**: * **::  *.    : .*    **:   .* **:.** .* *** ;. **

ref|YP_148969.1|        SEAERQRKEREKLLESLKEELEGLRQLPNEAHHKATCRLRSHPSYGKYLRQLKDGTLRID
ref|YP_001126171.1|     SEAERQRKEREKLLESLKEELEGLRQLPNEAHHKATCRLRSHPSYGKYLRQLKDGTLRID
ref|YP_146154.1|        SEAERQRKEREKLLESLKEELEGLRQLPNEAHHKATCRLRSHPSYGKYLRQLKDGTLRID
ref|YP_146741.1|        GEAERQRKEREILLESLKEELEGIRQLPNEAHHKATCRLRSHPSYGKYLRQLKDGTLRID
RAAC03589               EEAKRDEARREAMLRELRMELERLKELQGEAHTKAHCRLASHPTFKRYLKQDRWGNLRID
ref|ZP_02130848.1|      KQVKRDQATRERLIRRAEQEIEAIGDLTGKKHTKAACALLSHRSMGKYVRELKSGKLKIN
                         :.:*:.   **  ::.   .    *:*   :*   .: *   ** *  *  :    :*::: : *:*:* ref|YP_148969.1|        KQAVREAEKYDGKYLIRTSDDTLSAEDVALGYKQLVDIEQAFRTLK-------
ref|YP_001126171.1|     KQAVREAEKYDGKYLIRTSDDTLSAEDVALGYKQLVDIEQAFRTLK-------
ref|YP_146154.1|        KQAVREAEKYDGKYLIRTSDDTLSAEDVALGYKQLVDIEQAFRTLK-------
ref|YP_146741.1|        KQAVRDAEKYDGNYLIRTSDDTLSAEDVAIGYKQLVDIEQAFRTLK-------
RAAC03589               PEAVRQAAHLDGKYLIRTSDETLSTEDVALGYKQLLMVESALRTLKKFWTSVP
ref|ZP_02130848.1|      KAKITEEEKLDGKYLLSCSDDTLSPEEIALGYKQLLEVERAFRTLK-------
                         :   :     :  **:**:    *****.*.::;*****   :*  *:****
```

FIG. 75

```
ref|ZP_01665148.1|    ------------------------------------------------------------
ref|YP_001111903.1|   ------------------------------------------------------------
ref|YP_753434.1|      ------------------------------------------------------------
ref|YP_753226.1|      EFYPHYPTHETICALPRTEINSWLSYNTRPHMNASWLFEISUBSPWLFEISTRGETTING
ref|YP_752864.1|      ------------------------------------------------------------
RAAC03695             ------------------------------------------------------------ ref|ZP_01665148.1|    ------------------------------------------------------------
ref|YP_001111903.1|   ------------------------------------------------------------
ref|YP_753434.1|      ------------------------------------------------------------
ref|YP_753226.1|      ENGBABIHYPTHETICALPRTEINSWLSYNTRPHMNASWLFEISUBSPWLFEISTRGETT
ref|YP_752864.1|      ------------------------------------------------------------
RAAC03695             ------------------------------------------------------------ ref|ZP_01665148.1|    ------------------------------------------------------------
ref|YP_001111903.1|   ------------------------------------------------------------
ref|YP_753434.1|      ------------------------------------------------------------
ref|YP_753226.1|      INGENGBABIHYPTHETICALPRTEINSWLSYNTRPHMNASWLFEISUBSPWLFEISTRG
ref|YP_752864.1|      ------------------------------------------------------------
RAAC03695             ------------------------------------------------------------ ref|ZP_01665148.1|    ------------------------------------------------------------
ref|YP_001111903.1|   ------------------------------------------------------------
ref|YP_753434.1|      ------------------------------------------------------------
ref|YP_753226.1|      ETTINGENGBABIHYPTHETICALPRTEINSWLSYNTRPHMNASWLFEISUBSPWLFEIS
ref|YP_752864.1|      ------------------------------------------------------------
RAAC03695             ------------------------------------------------------------ ref|ZP_01665148.1|    ------------------------------------------------------------
ref|YP_001111903.1|   ------------------------------------------------------------
ref|YP_753434.1|      ------------------------------------------------------------
ref|YP_753226.1|      TRGETTINGENGBABIHYPTHETICALPRTEINSWLSYNTRPHMNASWLFEISUBSPWLF
ref|YP_752864.1|      ------------------------------------------------------------
RAAC03695             ------------------------------------------------------------ ref|ZP_01665148.1|    --------------------EAXTRANSPSASEISFAMILYPRTEINTHERMSINU---
ref|YP_001111903.1|   ------------------------------------------------------------
ref|YP_753434.1|      ------------------------------------------------------------
ref|YP_753226.1|      EISTRGETTINGENGBABIHYPTHETICALPRTEINSWLSYNTRPHMNASWLFEISUBSP
ref|YP_752864.1|      ------------------------------------------------------------
RAAC03695             ------------------------------------------------------------ ref|ZP_01665148.1|    ------SCARBXYDIVRANSNRGBEAXTRANSPSASEISFAMILYPRTEINTHERMSINU
ref|YP_001111903.1|   ------------------------------------------------------------
ref|YP_753434.1|      --------------------IHYPTHETICALPRTEINSWLSYNTRPHMNASWLFEISU
ref|YP_753226.1|      WLFEISTRGETTINGENGBABIHYPTHETICALPRTEINSWLSYNTRPHMNASWLFEISU
ref|YP_752864.1|      ------------------------------------------------------------
RAAC03695             ---------------------------------------------------MLPRRFFMDNref|ZP_01665148.1|    ----SCARBXYDIVRANSNRSCRESIGNIFICANCEE-IDENTITIESPSITIVESGAPS
ref|YP_001111903.1|   ------------------------------------------------------------
ref|YP_753434.1|      BSPWLFEISTRGETTINGENSCRESIGNIFICANCEE-IDENTITIESPSITIVESGAP-
ref|YP_753226.1|      BSPWLFEISTRGETTINGENSCRESIGNIFICANCEE-IDENTITIESPSITIVESGAP-
ref|YP_752864.1|      ------------------------------------------------------------
RAAC03695             --------TVDFLEPFAESRVLVRQG----FFEHKEGLHPNLRERKWYPANHFKGAKSN
``` continued →

FIG. 75 continued

```
ref|ZP_01665148.1|      MYIRQKPLFSFDTLMQYQPKTRLAMVFESIDLHPLLKTLPIKSIR--GPKGYSSAALIKA
ref|YP_001111903.1|     MYLLQPNLFSFEELLKFEPETKLQKVLSVLDLSPALN-VVKRAVL--GPKGHCVGNMIRA
ref|YP_753434.1|        -SIRQNCIFSFEDALKIQPKSRLEKIINTLDLKPVLCKLDKPGEIRVGPKPYPAYAMLNA
ref|YP_753226.1|        -SIRQNCIFSFEDALKIQPKSRLEKIINTLDLKPVLCKLDKPGEIRVGPKPYPAYAMLNA
ref|YP_752864.1|        --IRQGYVFSFEDAINLQPRSRLEIVLATLDFDDVITVLDKENKQHRGPTGYPFESKLNA
RAAC03695               VYVRQAWLFSFDEWMEMSPCERRELFFSTLDLSPYAAKLRSSTPQ--GAKPISREAILRA
                          :  *  :***:    ::  .*     :    .:   :*:          *..     ..* ref|ZP_01665148.1|      FLAMRLCSIPTVTLLVERLKTDLVFRYECGFSLEQPVPSLATFSRFFQKIAETDS-----
ref|YP_001111903.1|     LVAKQLEQIPTVAALVKRLSNDIRFRFQCGFSLSKPIPSESTFSRLIQKLAATDETNKTE
ref|YP_753434.1|        LIAMRLENMGTFTQLVERLTYDPHLRYVCGFEPFGTAPSKSCFSRFYSKLAQSGC-----
ref|YP_753226.1|        LIAMRLENMGTFTQLVERLTYDPHLRYVCGFEPFGTAPSKSCFSRFYSKLAQSGC-----
ref|YP_752864.1|        LIAMRVYNMATFTELVERLTHDPVLRYNCGFDVFGKVPSIATFSRFYERLTQSEV-----
RAAC03695               FLAAPLEGISTFTQLHRRLESDLRFRYQCGFSLHESIPSVSTLSRVFQAIVDKGV-----
                        ::*         :  :  *.:  *  .**    *    :*:  ***.       . .

ref|ZP_01665148.1|      --LQVLFSALVDTAIQDKVISGEVVAIDASAIDSYEKPVPKKELNSNGDSATWGAKLDTH
ref|YP_001111903.1|     SVMKQIFDNLVKSAKDMGLIDSNCVAIDSSKIDAYEKSKPKKDLQGD-KTANWGAKRDTH
ref|YP_753434.1|        --LETLFTSLVKQAEEMGLLDLSSVAIDATKVEAYEKSVPRKNIIQDGNVADWGIKSDTN
ref|YP_753226.1|        --LETLFTSLVKQAEEMGLLDLSSVAIDATKVEAYEKSVPRKNIIQDGNAADWGIKSDTN
ref|YP_752864.1|        --LRELFKKQVTTAESMGLIDTSSIAIDASKVDANEKSVPRKNIKDDGQSANWGSKLDTN
RAAC03695               --AATLFAELVRQCRDEGLIEGEHVAIDSTAIHAYERKHPRSGVQPS-NRANWGAKFDAF
                            :*   *  . .. .::. . :***:: :.:  *:  *:. :  . . * ** * *:

ref|ZP_01665148.1|      GNQHVWFGYKLHLAVDTKSELPIAVKVTPANRNDVTQAIPLMDEIK------HQPKYYCM
ref|YP_001111903.1|     GNQISWFGYKAHVAVDCHSELPIAIMVTPANTHDAKMAIPLIELVNKALEDSKKPKYYTM
ref|YP_753434.1|        GNPIKWFGYKLHIGTDVKSGLPIAMKVTPANYSDSSVALELVEKCCANTQ--SKIVYFLM
ref|YP_753226.1|        GNPIKWFGYKLHIGTDVRSGLPIAMKVTPANCSDSSVALELVEKCCANTQ--SKIVYFLM
ref|YP_752864.1|        GNQITWFGYKLHIATDVKSELPVALSITPASTNDGIMAESILEECSNNLN--SKPQYYLM
RAAC03695               GNKLAWFGYKVHLAVDAKSELPMALTVTPANVYDGEMAIPLMEELHHHDW---RIRFVLM
                            *** *:..*  :*  **:*:  :***.   *    *    :::            :   :  * ref|ZP_01665148.1|      DMGYDAKDVYQAAY-ERQAQAIIPLNRRKEKLPPEGMDENRTPTCSMGYPMVYWGCEREK
ref|YP_001111903.1|     DMGYDSKDIYSVVMNDFNAQAIIPINSRGSKDHPEGCDFDGTPICSMGQRMVFWGSDAKA
ref|YP_753434.1|        DAGYDHREIYSVIRDKYHAQAIIALNKRGAKQPPEGFDWDGTPICSARYRMVYWGS--YQ
ref|YP_753226.1|        DAGYDHREIYSVIRDKYHAQAIIALNKRGAKQPPEGFDWDGTPICSARYRMVYWGS--YQ
ref|YP_752864.1|        DAGYDQKSIYELIRKDYKAQAIIPLNHRGAKEPPEGLDWDATPICSAGYRMAYWGG--SN
RAAC03695               DAGYDQTKNYEAAR-ALGAQAIIPMNRRNEKEPPEGMDFDGTPRCTMGYRMTYWGV--HN
                        * ***    .  *.      *****.:*  *    *** *** *:  ** * *:   *.:**

ref|ZP_01665148.1|      GILKFRCPHVCGKVNCPNGSAWCSPSNYGLVIKKKVEDDPRSFCTPHRGTREWEKLYAER
ref|YP_001111903.1|     GTNKYRCPHVMGKCDCPYGSAWCSPSSYGLVVKTKVKDDPRMNCIPARGTKNWQSLYNKR
ref|YP_753434.1|        GVNKFRCPHIMGKCDCPFGSAWCSDSNYGMVVKTKVKDDPRLFSSPHRGSANWQKQYNLR
ref|YP_753226.1|        GVNKFRCPHIMGKCDCPFGSAWCSDSNYGMVVKTKVKDDPRLFSSPHRGSANWQKQYNLR
ref|YP_752864.1|        GVNKFRCPHVMGKCDCPFGSSWCSDSNYGMVVKTRARQDSRLFIVPHRGTSNWKLLYNKR
RAAC03695               AWLKFRCPHATGQVDCPLGMAACSASYGMVVKKHIDEDVRRYANPHRGSRTWKMLYDER
                        .  *:****  *:  :** *  :  ** * **:*:*.:      :*     * **:   *:    *   * ref|ZP_01665148.1|      TSVERAFSRLKEQLGANT-VRVQGIKKVTAHLMLCCIALLAGTIAVNR--------
ref|YP_001111903.1|     TSVERCFGRLKQHLGANS-IRTRGLEKVTLHITLSCIALLAGSIAVAKTKRIEQAA
ref|YP_753434.1|        TYSERCFSRFKENLGLEDGLNVRKITKVETHAYLCAITMIAAVIAINQ--------
ref|YP_753226.1|        TYSERCFSRFKENLGLEDGLNVRKITKVETHAYLCAITMIAAVIAINQ--------
ref|YP_752864.1|        TSVERCFGRLKEHLGLETGLNVRGIKKVKTHAYLSVITMIASVIAINKDKSSTDIA
RAAC03695               TAVERCFARLKEWLTLDG-VHVRGIEKVTVHAYIHAIVLLASALAMHRTNRIEQVA
                        *  **.*:*.*:*  *    :   :  : * ::: *   *.::*. .*:   :
```

FIG. 76

```
ref|YP_754943.1|    ------------------------------LNAKVKWYEEQFRLSROKQFGASSEK------
ref|YP_754865.1|    ANCEE-IDENTITIESPSITIVESGAPSLNAKVKWYEEQYRLSRQKQFGTSSEK------
ref|YP_431166.1|    ------------------------------------------------------------
RAAC02318           ------------------------------MRQQVAYLEEQIHLLRHRLFGASSEKRRKTQA
ref|ZP_02171171.1|  ------------------------------------MQKKKFGTSSEK-----T
ref|YP_519650.1|    ------------------------------IKQQNQWLMEQFRLLKHKQYGASSEQ------ ref|YP_754943.1|    -TTPEQINLFNEAEDITDPKLEEPS--------------LETVTYQRKKKQAGQREDKLKD
ref|YP_754865.1|    -TTPEQINLFNEAEDIVDPEIKEPD--------------IETITYERKKKQPGQKADKLKD
ref|YP_431166.1|    ------------------------------------------------------------
RAAC02318           ESDSVQLSLFNEAEVEADAQSSEETGEADTKAPSEDVETETITYERRKPRAVRERDAWLY
ref|ZP_02171171.1|  DERFEQGSLFNESEKEQDAAEEEPT--------------VEAITYERKKKRKARKD---LT
ref|YP_519650.1|    -HSAEQMDLFNEAEATAELSAPEPF--------------LTEVKTHYRKRTRLTTDK---LP ref|YP_754943.1|    L--PVEIIEYRLEKHEQICPCCQGELHEMSIQVRHEIKIIPAQAISVKHVQYIYACRRCE
ref|YP_754865.1|    L--PVEVIEYRLLEHEQVCPCCQGSLHEMSTQIRQEIKVIPAQVKVVQHVQYIYSCRQCE
ref|YP_431166.1|    ---------------MSTEVRQELKIIPAQVKVVKHIRYVYACRHCE
RAAC02318           QGEADEVVEYRLSDDERVCPKCAGELHEMSREITRRVKIIPAQMKKVEYVRYVYACRHCE
ref|ZP_02171171.1|  ENLYTETVTYTLPVEDQVCSCCNGELHIMKTQVKDELEIIPAEVKVKRYETTIYSCRHCE
ref|YP_519650.1|    EDLPVEVMEYELPEPERRCPECSGELHTMGRDIWEELKIIPAKAVIVRHIQHVYACRCCE
                                                *  ::  .:::***:     .:    :*:** **

ref|YP_754943.1|    KENITTPIIKAEMPKPTLPGSLASPSILAYIMDQKYTNSLPLYRQEQQFSRLGIELSRQT
ref|YP_754865.1|    KENITTPIIKAQMPNPTLPGSLASPSILAYIMDQKYTNSMPLYRQEQQLSRLGIELSRQT
ref|YP_431166.1|    REELTTPVVTAPMPAPVLPGSPVSPSLLAYVMHQKYGEGLPLYRQEQQFKSLGLELSRQT
RAAC02318           AQDVETPVVRAPTPKPVQAKSLATPFAVAYVMTKKFVDGMPLYRQEQQFARHGYPLSRQT
ref|ZP_02171171.1|  RTGTRNPIVKAPSPERPFPGSLASPSIVSYMTNQKFVQGVPLYRQEQEFKRMDVPISRQT
ref|YP_519650.1|    ATSEHVPMLKAQRPSPVIKCGFACAETIAHLAVQKFMMGSPLYRQEQEWKHNGILLSRQT
                     *::  *    *        .  ..  ::::   :*:  .  *******:    .  :****

ref|YP_754943.1|    MANWLLAAADPWLKIIYDRLHFQLLEKDILHADETTLQVLKEPGRRAESKSYMWLYRT-G
ref|YP_754865.1|    MANWVLNVADPWLKIIYDRLHVELLDRDTIHADETTLQVLKEPGRSAETKSYMWLYRT-G
ref|YP_431166.1|    LANWVLHGANTWLTHIYDRLHEYLLKRDILHADETTLQVLREPGREAATKSFLWLYRT-G
RAAC02318           LANWVVHAAETWLEPLYAKLRQVLLAQRYLHADETTLQVLHEAGRAAQTCSYMWVYRS-G
ref|ZP_02171171.1|  MSNWIIEASEQMLEPIWDLMIRILTSLDVLHADETTVQVLKEDCKEAAAKSYMWLYRS-G
ref|YP_519650.1|    MSNWLIKASQDWLEPLYEAMKLRLCEHDVLHGDETTLQVLKRPGKTAQSKSYMWLYRTSG
                     ::**::  ::    *  :: :    *     .:*:* *:  * ::*::*:**: * ref|YP_754943.1|    RDGPPIVLYDYQTTRASKHPDSFLSGFKGYLQTDGYSCYGSLT-SVTLAGCWAHARRKFT
ref|YP_754865.1|    RDGPPIVLYEYQTTRASKHPDRFLSGFKGYLQTDGYSAYCKLT-GITLVGCWAHARRKFT
ref|YP_431166.1|    RDGPSIVLYDYQTTRASKHPCRFLAGFKGYLHVDGYAGYNELP-DVTLVGCWAHARRKFD
RAAC02318           TDEPPVVLYDYQETRNAEHPQRFLAGFQGYLHVDGYAGYFGLP-DVTLACCWAHARRKFD
ref|ZP_02171171.1|  SHDVPIVIYDYQPGRASKYPRRFLEGFTGYLHVDGYGGYHALKPKVELVGCWAHARRKFF
ref|YP_519650.1|    EAKHPLVIYEYQPDRKHNHPQTFLKEFSGYLHTDGYEAYHKLPGNITVVGCAAHLRRKFF
                     .:*:*:**   *   ::*  **   * *:.*  .*   *    : :.  **** ref|YP_754943.1|    EALKALPAEQKDKPVAASI------------------------
ref|YP_754865.1|    EALKALPAAQKDKPVAA--------------------------
ref|YP_431166.1|    EALKALPEDKRNAAVAA--------------------------
RAAC02318           EALKAVPPKERKGKTAAEAIAWRKPTCASLTTSHTPRSPRTFQTSKE
ref|ZP_02171171.1|  DAVQTLPDDRDSTTSAAK--------------------------
ref|YP_519650.1|    DALKTLPKDRQADSNAAKGVAY----------------------
                     :*::::*  .       **
```

FIG. 77

```
ref|ZP_02171383.1|        -----------VYLARGSTDLRKSIDGLAAIVQEGFELDPFSSSLFVFCNRYRDKIKILY
RAAC02319                 MLAFDWTSDHRVYLACGATDMRKSIDGLAALVQASFQLDPFSPCLFVFCNRQRDKLKILH
ref|YP_431168.1|          -----------RVYLACGATDLRKSIDGLAVLVKEGFELDPFSSCLFVFCNRNRDKLKILH
ref|YP_001212944.1|       -----------RVYLALGATDLRKSIDGLAVLVKEGFELDPFSSCLFVFCNRKCDKLKILH
ref|YP_754944.1|          -------SNRQVYLACGSTDLRKSIDGLAVLVKEAFELNPFSPCLFVFCNRQRNKLKILQ
ref|YP_754864.1|          -------SNRLVYLACGSTDLRKSIDGLAVLVKESFHLDPFSPCLFVFCNRKRDKLKILQ
                                     ****  *::*******.:*:   .*.*:*..*****   :*:*** ref|ZP_02171383.1|        WDHNGFWLYYRRLEKGRFPWPTSGSDEPMIITERQLRWLLDGLPLDQKGAHR--------
RAAC02319                 WSHNGFWLYYRRLERGRFDWPETGDAKTMVITRRELNWLLDGLPLEQPRAHRAVYVRSAI
ref|YP_431168.1|          WEHNGFWLYYRRLEKGKFVWPQDTTSSTITITRRELRWLLDGLPLKQPQAHPEVKARTIL
ref|YP_001212944.1|       WDHNGFWLHYRRLEKGKFHWPADAGSPTLVISRRELRWLLDGLSLKQPKAHPEVKARTIL
ref|YP_754944.1|          WDHNGFWLYYRRLERGKFEWPA-ADSQVVSISYREFRWLLDGLSLKQKQAHKAVKERTII
ref|YP_754864.1|          WEHNGFWLHYRRLERGKFDWPT-AHTDVVSISYREFRWLLDGLSLKQNQAHKAVKQR---
                          *.******:*****:*:* **           : *: *::.******.*.*   **
```

FIG. 78

```
ref|ZP_02734990.1|      ------------------DIGSEADRYVEKSRAPNTRRAQRSDWKDFSSWCAKYARSP--
ref|YP_713924.1|        ---------------------ELAARVGDYARASRSASTWRAYDSDLRQFRAWCARRPAAPSA
RAAC02333               MQEIMDTNVSSTIHVGLTELSASANKYVLNSKARNTIRAYQSDWRSFCTWCDERHLSS--
ref|YP_008142.1|        ------------------DLVKTAKEYATFARSFNTNKSYRSDWDDFVFWCQEKNLRP--
ref|ZP_01265219.1|      ---------------ITDIKALQEETLLNLQSSKANNTVRAYKSDFNDFGLFCAKNGFKS--
ref|YP_266430.1|        ---------------ITDINALKKETLLNLQSSKSINTARAYKSDFTDFSLFCVKNGIKS--
                                          :    .    :::  .*  ::   **  .*   :*  .

ref|ZP_02734990.1|      LPAAPDTVAYYLADRSQE------------LKTSTLQRRLMSISDAHRTAGFDSPTKSAQ
ref|YP_713924.1|        LPATAATVAGYLATLADAG-----------YKPSTIRRRLAAISVAHQLAQHPNPAAAPE
RAAC02333               LPAEPKTVALYLSDMADRG-----------YRTSTIGRHMISIGLAHRTKGFPSPTSDET
ref|YP_008142.1|        LPALPQTIVVYLISRADNAWTNQKGKLQKPLKISSLSRRLTSISQAHKLAKQPFDKKCPF
ref|ZP_01265219.1|      LPSEPKIVSLYLTHLSTKD---------------VRMSTLKRRLVSIGVIHKLKGHYLDTKHPS
ref|YP_266430.1|        LPSEPKIVSLYLTYLSTKE---------------VKMSTLKRRLVSIGVIHKLKGHYLDTKHPA
                        **:  .    :   **    :                 :  *:: *:: :*.   *:

ref|ZP_02734990.1|      VKLVWAGIRRDKGVAQNHKKPTLTKHIREMVEHLPQG------LLGVRDRALLLLGFACA
ref|YP_713924.1|        VGAVWDGIRRTRGVRPTRKTALDTDLLTRVVAGLRDDD-----LADIRDRALLVGFAGC
RAAC02333               VRAVWRGIRNTLGVAPQGKSPILVEDIRRMLQHVPND------LMGLRDRALLLIGFAGA
ref|YP_008142.1|        IQEVWKGIKNKLGSAQIRKDPILLDDIRKMTESINNDNSKANSLSGMRDKALLLLGFVGA
ref|ZP_01265219.1|      IVENIMGIKRRKGSIQRGKKPLLINNLKKIINVIDQQKKEE--IKKLRDRSIILIGFSGG
ref|YP_266430.1|        IIENIMGIKRRKGSIQKGKKPLLINNLKQIIDVIDQQKKEE--IKKIRDRSIILIGFSGG
                        :      **:.  *      *   .    :  .:  : :      :  :**::: :*:** * ref|ZP_02734990.1|      MRRSELVGIDATDVALTDEGLVVTIRKSKTDQVQEGRTLGIPYGEHEGTCPVRAVLAWVD
ref|YP_713924.1|        LRRSELVGLDVADLVETADGLILTVRRSKTDQEGEGALVGIAYGSYRPTCPVRAWRAWAQ
RAAC02333               FRRSEIVALNVEDVEFVREGLVITLRRSKTDQEGEGRKVGIPYGSFIETCPVRALQAWLN
ref|YP_008142.1|        FRRSELVSLTIDDIKFVREGLQITLRKSKTDQEGKERIIAIPYGSNILCPVRTLNDWLD
ref|ZP_01265219.1|      FRRNEIVSLDYEDLDFVQEGLKINLRRSKTDQFGEGFVKGLPYFQNPQYCPVISIHKWIE
ref|YP_266430.1|        FRRNEIVSLDFDDLDFVSEGLKINIKRSKTDQFGEGFTKALPYFDSSQYCPVVSLRNWLE
                        :**.*:*.:   *:   :**  ..:::*****   :  .:.^       ***   :  *  :

ref|ZP_02734990.1|      QAAILEGPLFRSVNKHGHVMGTRLSDRTVAEVVKRSLVAAGHTARGYAAHSLRAGLITQA
ref|YP_713924.1|        AADLRQGPAFRAVSRHGHVGATRLYPGSVARVVQRRVAAAGLDPADFAGHSLRSGFATAA
RAAC02333               ATGIDSGPLFRRVTKGHDVRDARLSDKTVARIVKRYVRLIGLDQRHFAGHSLRAGLATSA
ref|YP_008142.1|        CSKISEGLLFRPINRHGQIEDKALTSKSVALIIKRNKHLE-NQKNSFSGHSLRAGFATTA
ref|ZP_01265219.1|      ISKIKSGALFRRFIKGSKISDNRLTDQTVALIVKEYLKLAGIDCKNYSGHSLRSGFATSA
ref|YP_266430.1|        ISRIKSGSVFRRFIKGSKLSENRLTDQTVALLIKEYLSMLGIDTKNYSGHSLRSGFATSA
                          :  :  .*  **   .:    .:    *    :  :::.          ::.**:*: *  * ref|ZP_02734990.1|      AIAGASDRDIQDQSGHKSLLVMRRYIRDGSLF-RQNVAAKVGL
ref|YP_713924.1|        ARAGVADRSIMRQGRWRSSASLDGYVRAGRLFDRDNPSGRVGL
RAAC02333               ALAGVSERDIMAQTGHRSPMMVRRYIRDSNLF-RSNAAARIGL
ref|YP_008142.1|        AIFGVPEHLIMKQTGHKSFDTIRRYI-----------------
ref|ZP_01265219.1|      AESGAEERSIMAMTGHKSTEMVRRYIKEANLF-KNNALKNI--
ref|YP_266430.1|        AESGVEERNIMAMTGHKSTEMVRRYIKDANLF-RNNALNKI--
                        *  *.  :: *       :*    :  *:
```

FIG. 79

```
ref|YP_001036724.1|    TRANSPSASEMUTATRTYPECLSTRIDIUMTHERMCELLUMATCCGBABNTRANSPSASE
ref|YP_001039064.1|    ------------------------------------------------------------
ref|YP_001039349.1|    ------------------------------------------------------------
RAAC03703              ------------------------------------------------------------
ref|YP_076118.1|       ------------------------------------------------------------
ref|YP_074958.1|       ------------------------------------------------------------ ref|YP_001036724.1|    MUTATRTYPECLSTRIDIUMTHERMCELLUMATCCGBABNTRANSPSASEMUTATRTYPE
ref|YP_001039064.1|    ------------------------------------------------------------
ref|YP_001039349.1|    ------------------------------------------------------------
RAAC03703              ------------------------------------------------------------
ref|YP_076118.1|       ------------------------------------------------------------
ref|YP_074958.1|       ------------------------------------------------------------ ref|YP_001036724.1|    CLSTRIDIUMTHERMCELLUMATCCGBABNTRANSPSASEMUTATRTYPECLSTRIDIUM
ref|YP_001039064.1|    ------------------------------------------------------------
ref|YP_001039349.1|    ------------------------------------------------------------
RAAC03703              ------------------------------------------------------------
ref|YP_076118.1|       ------------------------------------------------------------
ref|YP_074958.1|       ------------------------------------------------------------ ref|YP_001036724.1|    THERMCELLUMATCCGBABNTRANSPSASEMUTATRTYPECLSTRIDIUMTHERMCELLU
ref|YP_001039064.1|    ------------------------------------------------------------
ref|YP_001039349.1|    ------------------------------------------------------------
RAAC03703              ------------------------------------------------------------
ref|YP_076118.1|       ------------------------------------------------------------
ref|YP_074958.1|       ------------------------------------------------------------ ref|YP_001036724.1|    MATCCGBABNTRANSPSASEMUTATRTYPECLSTRIDIUMTHERMCELLUMATCCGBABN
ref|YP_001039064.1|    ------------------------------------------------------------
ref|YP_001039349.1|    ------------------------------------------------------------
RAAC03703              ------------------------------------------------------------
ref|YP_076118.1|       ------------------------------------------------------------
ref|YP_074958.1|       ------------------------------------------------------------ ref|YP_001036724.1|    TRANSPSASEMUTATRTYPECLSTRIDIUMTHERMCELLUMATCCGBABNTRANSPSASE
ref|YP_001039064.1|    ------------------------------------------------------------
ref|YP_001039349.1|    ------------------------------------------------------------
RAAC03703              ------------------------------------------------------------
ref|YP_076118.1|       ------------------------------------------------------------
ref|YP_074958.1|       ------------------------------------------------------------ ref|YP_001036724.1|    MUTATRTYPECLSTRIDIUMTHERMCELLUMATCCSCRESIGNIFICANCEE-IDENTIT
ref|YP_001039064.1|    ------------------------------------------------------------
ref|YP_001039349.1|    ------------------------------------------------------------
RAAC03703              ------------------------------------------------------------
ref|YP_076118.1|       ------------------------------------------------------------
ref|YP_074958.1|       ------------------------------------------------------------ ref|YP_001036724.1|    IESPSITIVESGAPSMATNNRMALLEQLSKYVVEKDKDFLKEALTLLINALMDAEVTSII
ref|YP_001039064.1|    ---------------MATNNRMALLEQLSKYVVEKDKDFLKEALTLLINALMDAEVTSII
ref|YP_001039349.1|    ---------------MATNNRMALLEQLSKYVVEKDKDFLKEALTLLINALMDAEVTSII
RAAC03703              ----MTNTKSRRHATMASLNSFAVLEWIRKMQDVDQIDFLRELMQLVTQFLIDAEAAEKI
ref|YP_076118.1|       ------SNTSQRGNPQVTNFRIALEELLRK-SGVDDVDFLREGVRVLAQGLMELEVSQQI
ref|YP_074958.1|       --------------------LEELLRK-TGVDDFDFLREGLRVLAQGLMELEVSQRI
                                            :  *  : *       .: ***:*  : :: : *;; *.:. *
                                                                        continued →
```

FIG. 79 continued

```
ref|YP_001036724.1|   GAEKYERNNNRNNYRNGYRLREWDTRVGTLQLSIPKLRHGSYFPSLLEPRKMSEKALLNV
ref|YP_001039064.1|   GAEKYERNNNRNNYRNGYRLREWDTRVGTLQLSIPKLRHGSYFPSLLEPRKMSEKALLNV
ref|YP_001039349.1|   GAEKYERNNNRNNYRNGYRLREWDTRVGTLQLSIPKLRHGSYFPSLLEPRKMSEKALLNV
RAAC03703             GAERYERTESRVTQRNGYRSRAWDTRLGTVDLKIPKLRQGSFFPSILEPRRRAEQALASV
ref|YP_076118.1|      GAERYERSSERSNYRNGYRERQWDTRVGTIDLQIPKLRKGSYMPSWLEPRRRAEKALVAV
ref|YP_074958.1|      GADRYERSAERSTYRNGYRERQWDTRVGTIDLQIPKLRKGSYMPSFLEPRRRAEKALVAV
                      ::*. .* . ***** * **:::*.***:.:. **. :*:**  * ref|YP_001036724.1|   VQEAYVHGVSTRKVDELVEALGMKGIDKSEVSRISKQLDEFVEEFKNRRLEGEYPYLWLD
ref|YP_001039064.1|   VQEAYVHGVSTRKVDELVEALGMKGIDKSEVSRISKQLDEFVEEFKNRRLEGEYPYLWLD
ref|YP_001039349.1|   VQEAYVHGVSTRKVDELVEALGMKGIDKSEVSRISKQLDEFVEEFKNRRLEGEYPYLWLD
RAAC03703             IQEAYVKGVSTRKVDDLVRALGLDGISKSEVSRLCQLIDEEVRQFKERPLEREYPYVWLD
ref|YP_076118.1|      VQEAYIQGVSTRKVDELVQALGMTCVSKSQVSRLCAELDEVVEAFRNRPLEGRYPYVWLD
ref|YP_074958.1|      VLEAYVNGVSTRKVDDLVQALGMTGVSKSQVSRLCAELDEVVQAFRNRPLESRYPYVWLD
                      : *::****:.***: *:.:*:.  :** *. *:*: .*:*** ref|YP_001036724.1|   ATFPKVREGGRVCSMALVIAVGVNQQGEREILGFDVGMSEDGAFWEEFLRRLVARGLKGV
ref|YP_001039064.1|   ATFPKVREGGRVCSMALVIAVGVNQQGEREILGFDVGMSEDGAFWEEFLRRLVARGLKGV
ref|YP_001039349.1|   ATFPKVREGGRVCSMALVIAVGVNQQGEREILGFDVGMSEDGAFWEEFLRRLVARGLKGV
RAAC03703             ATFPKVREGGRVQSMALVIAIGVTDTGEREVLGFDVGTSEDGAFWSDFLRSLKARGLRGV
ref|YP_076118.1|      AKYEKVRENGRVSSMALVIAMGVREDGEREILGLDVGPSEDGAFWTAFLRQLVARGLKGV
ref|YP_074958.1|      AKYVKVRENGRVCTMALVVAVGVREDGDREVLGLDVGPSEDGAFWTAFLRQLVTRGLKGV
                      *.: ****.***  :****:*:** . * *:**:**:***  ******  *** * :***:**

ref|YP_001036724.1|   RLVISDAHEGLKAAIKKILTGSAWQRCRVHFMRNVLSQVPKHYQGMVSSIIRTIFAQNDQ
ref|YP_001039064.1|   RLVISDAHEGLKAAIKKILTGSAWQRCRVHFMRNVLSQVPKHYQGMVSSIIRTIFAQNDQ
ref|YP_001039349.1|   RLVISDAHEGLKAAIKKILTGSAWQRCRVHFMRNVLSQVPKHYQGMVSSIIRTIFAQNDQ
RAAC03703             RLVVSDAHAGLRQATSEVLTGATWQRCKVHTIRNVLSQVPKREQSMVASIIRTIFTQPTQ
ref|YP_076118.1|      LLVISDNHVGLREAIRTVFSGASWQRCRVHFMRNLLGYVPKNLQSMVSAAVRTIFAQPDQ
ref|YP_074958.1|      LLAISDSHVGLQEAIRTVLSGASWQRSRVHFMRNLLGYVPKHWQSMVAAAVRTIFAQPDQ
                      *.:** * :     :::*::*.: :**:*. ***. *.:: :**:*  * ref|YP_001036724.1|   ESAREQLRHVVDELKNRFPKAMKILEEAEEEILAYMAFPREHWAQIHSTNPLERLNREIR
ref|YP_001039064.1|   ESAREQLRHVVDELKNRFPKAMKILEEAEEEILAYMAFPREHWAQIHSTNPLERLNREIR
ref|YP_001039349.1|   ESAREQLRHVVDELKKRFPKAMKILEEAEEEILAYMAFPREHWAQIHSTNPLERLNREIR
RAAC03703             EAAREQLRRVVAELRGRFPKAMDILEAAEEDVLAFMALPIEHWRQICSTNPLERLNREMR
ref|YP_076118.1|      QAAKSQLAVVVENLRKQFPRAAQLLEDAEEDILAYMAFPTEHWRRLHSTNPLERLNREIG
ref|YP_074958.1|      QAARRQLAVVADNLRPQFPRAAQLLEEAEDDILAYMAFPTEHWRQLHSTNPLERLNREIG
                      ::*: ** *. :*: :**:* .:** **:::**:**:* *** ::  **********:

ref|YP_001036724.1|   RRTDVVCIFPNREAVIRLVGAMLEQNDEWKVG-RRYFSLESMSKITSINEFTLTPVALL
ref|YP_001039064.1|   RRTDVVCIFPNRKAVIRLVGAMLEQNDEWKVG-RRYFSLESMSKITSINEFTLTPVALL
ref|YP_001039349.1|   RRTDVVCIFPNREAVIRLVGAMLEQNDEWKVG-RRYFSLESMSKITSINEFTLTPVALL
RAAC03703             RRMDVVGIFPNRASVVRLAGAILQEQHEEWLVS-RRYFSLESMAKLKPNRPF-LAAEAML
ref|YP_076118.1|      RRTEIVGIFPNREALIRLAGAVMIEQQEEWMTAPRRYFSQASMAKLYAHDPSLGRPELL-
ref|YP_074958.1|      RRTDVVGIFPNREAFIRLAGAVLIEQQDEWTAAPRRYFSQASMAKL---------------
                      ** ::* *****  :.:**.**:: **::**  ..   ***** **:*:

ref|YP_001036724.1|   HK
ref|YP_001039064.1|   HK
ref|YP_001039349.1|   HK
RAAC03703             QK
ref|YP_076118.1|      --
ref|YP_074958.1|      --
```

FIG. 80

```
ref|YP_001039349.1|     ------------------------------------------------------------
ref|YP_001036724.1|     TRANSPSASEMUTATRTYPECLSTRIDIUMTHERMCELLUMATCCGBABNTRANSPSASE
ref|YP_001039064.1|     ------------------------------------------------------------
RAAC03568               ------------------------------------------------------------
ref|YP_076118.1|        ------------------------------------------------------------
ref|YP_074958.1|        ------------------------------------------------------------ ref|YP_001039349.1|     ------------------------------------------------------------
ref|YP_001036724.1|     MUTATRTYPECLSTRIDIUMTHERMCELLUMATCCGBABNTRANSPSASEMUTATRTYPE
ref|YP_001039064.1|     ------------------------------------------------------------
RAAC03568               ------------------------------------------------------------
ref|YP_076118.1|        ------------------------------------------------------------
ref|YP_074958.1|        ------------------------------------------------------------ ref|YP_001039349.1|     ------------------------------------------------------------
ref|YP_001036724.1|     CLSTRIDIUMTHERMCELLUMATCCGBABNTRANSPSASEMUTATRTYPECLSTRIDIUM
ref|YP_001039064.1|     ------------------------------------------------------------
RAAC03568               ------------------------------------------------------------
ref|YP_076118.1|        ------------------------------------------------------------
ref|YP_074958.1|        ------------------------------------------------------------ ref|YP_001039349.1|     ------------------------------------------------------------
ref|YP_001036724.1|     THERMCELLUMATCCGBABNTRANSPSASEMUTATRTYPECLSTRIDIUMTHERMCELLU
ref|YP_001039064.1|     ------------------------------------------------------------
RAAC03568               ------------------------------------------------------------
ref|YP_076118.1|        ------------------------------------------------------------
ref|YP_074958.1|        ------------------------------------------------------------ ref|YP_001039349.1|     ------------------------------------------------------------
ref|YP_001036724.1|     MATCCGBABNTRANSPSASEMUTATRTYPECLSTRIDIUMTHERMCELLUMATCCGBABN
ref|YP_001039064.1|     ------------------------------------------------------------
RAAC03568               ------------------------------------------------------------
ref|YP_076118.1|        ------------------------------------------------------------
ref|YP_074958.1|        ------------------------------------------------------------ ref|YP_001039349.1|     ------------------------------------------------------------
ref|YP_001036724.1|     TRANSPSASEMUTATRTYPECLSTRIDIUMTHERMCELLUMATCCGBABNTRANSPSASE
ref|YP_001039064.1|     ------------------------------------------------------------
RAAC03568               ------------------------------------------------------------
ref|YP_076118.1|        ------------------------------------------------------------
ref|YP_074958.1|        ------------------------------------------------------------ ref|YP_001039349.1|     ------------------------------------------------------------
ref|YP_001036724.1|     MUTATRTYPECLSTRIDIUMTHERMCELLUMATCCSCRESIGNIFICANCEE-IDENTIT
ref|YP_001039064.1|     ------------------------------------------------------------
RAAC03568               ------------------------------------------------------------
ref|YP_076118.1|        ------------------------------------------------------------
ref|YP_074958.1|        ------------------------------------------------------------ ref|YP_001039349.1|     ---------------MATNNRMALLEQLSKYVVEKDKDFLKEALTLLINALMDAEVTSII
ref|YP_001036724.1|     IESPSITIVESGAPSMATNNRMALLEQLSKYVVEKDKDFLKEALTLLINALMDAEVTSII
ref|YP_001039064.1|     ---------------MATNNRMALLEQLSKYVVEKDKDFLKEALTLLINALMDAEVTSII
RAAC03568               ----MTNTKSRRHATMASLNSFAVLEWIRKMQDVDQIDFLRELMQLVTQFLIDAEAAEKI
ref|YP_076118.1|        ------SNTSQRGNPQVTNFRIALEELLRK-SGVDDVDFLREGVRVLAQGLMELEVSQQI
ref|YP_074958.1|        -----------------------LEELLRK-TGVDDFDFLREGLRVLAQGLMELEVSQRI
                                               : * : *    .: ***:* : :: : *:: *.:. *
``` continued →

FIG. 80 continued

```
ref|YP_001039349.1|    GAEKYERNNNRNNYRNGYRLREWDTRVGTLQLSIPKLRHGSYFPSLLEPRKMSEKALLNV
ref|YP_001036724.1|    GAEKYERNNNRNNYRNGYRLREWDTRVGTLQLSIPKLRHGSYFPSLLEPRKMSEKALLNV
ref|YP_001039064.1|    GAEKYERNNNRNNYRNGYRLREWDTRVGTLQLSIPKLRHGSYFPSLLEPRKMSEKALLNV
RAAC03568              GAERYERTESRVTQRNGYRSRAWDTRLGTVDLKIPKLRQGSFFPSILEPRRRAEQALASV
ref|YP_076118.1|       GAERYERSSERSNYRNGYRERQWDTRVGTIDLQIPKLRKGSYMPSWLEPRRRAEKALVAV
ref|YP_074958.1|       GADRYERSAERSTYRNGYRERQWDTRVGTIDLQIPKLRKGSYMPSFLEPRRRAEKALVAV
                       ::*. .* . ***** * **:::*.***::: **:  :*:**  * ref|YP_001039349.1|    VQEAYVHGVSTRKVDELVEALGMKGIDKSEVSRISKQLDEFVEEFKNRRLEGEYPYLWLD
ref|YP_001036724.1|    VQEAYVHGVSTRKVDELVEALGMKGIDKSEVSRISKQLDEFVEEFKNRRLEGEYPYLWLD
ref|YP_001039064.1|    VQEAYVHGVSTRKVDELVEALGMKGIDKSEVSRISKQLDEFVEEFKNRRLEGEYPYLWLD
RAAC03568              IQEAYVKGVSTRKVDDLVRALGLDGISKSEVSRLCQLIDEEVRQFKERPLEREYPYVWLD
ref|YP_076118.1|       VQEAYIQGVSTRKVDELVQALGMTGVSKSQVSRLCAELDEVVEAFRNRPLEGRYPYVWLD
ref|YP_074958.1|       VLEAYVNGVSTRKVDDLVQALGMTGVSKSQVSRLCAELDEVVQAFRNRPLESRYPYVWLD
                       : *::*****:.***  *:.:*:.  :** *,. *::*   .*:*** ref|YP_001039349.1|    ATFPKVREGGRVCSMALVIAVGVNQQGEREILGFDVGMSEDGAFWEEFLRRLVARGLKGV
ref|YP_001036724.1|    ATFPKVREGGRVCSMALVIAVGVNQQGEREILGFDVGMSEDGAFWEEFLRRLVARGLKGV
ref|YP_001039064.1|    ATFPKVREGGRVCSMALVIAVGVNQQGEREILGFDVGMSEDGAFWEEFLRRLVARGLKGV
RAAC03568              ATFPKVREGGRVQSMALVIAIGVTDTGEREVLGFDVGTSEDGAFWSDFLRSLKARGLRGV
ref|YP_076118.1|       AKYEKVRENGRVSSMALVIAMGVREDGEREILGLDVGPSEDGAFWTAFLRQLVARGLKGV
ref|YP_074958.1|       AKYVKVRENGRVCTMALVVAVGVREDGDREVLGLDVGPSEDGAFWTAFLRQLVTRGLKGV
                       *.: ****.***  :****:*:**  : *:**:**:***  ******* *** *  :***:**

ref|YP_001039349.1|    RLVISDAHEGLKAAIKKILTGSAWQRCRVHFMRNVLSQVPKHYQGMVSSIIRTIFAQNDQ
ref|YP_001036724.1|    RLVISDAHEGLKAAIKKILTGSAWQRCRVHFMRNVLSQVPKHYQGMVSSIIRTIFAQNDQ
ref|YP_001039064.1|    RLVISDAHEGLKAAIKKILTGSAWQRCRVHFMRNVLSQVPKHYQGMVSSIIRTIFAQNDQ
RAAC03568              RLVVSDAHAGLRQAISEVLTGATWQRCKVHTIRNVLSQVPKREQSMVASIIRTIFTHPTQ
ref|YP_076118.1|       LLVISDNHVGLREAIRTVFSGASWQRCRVHFMRNLLGYVPKNLQSMVSAAVRTIFAQPDQ
ref|YP_074958.1|       LLAISDSHVGLQEAIRTVLSGASWQRSRVHFMRNLLGYVPKHWQSMVAAAVRTIFAQPDQ
                       *.:** * :   :::*::*.:  :**:*.  ***.  *.::  :**::   * ref|YP_001039349.1|    ESAREQL-
ref|YP_001036724.1|    ESAREQL-
ref|YP_001039064.1|    ESAREQL-
RAAC03568              EAGREQLP
ref|YP_076118.1|       QAAKSQL-
ref|YP_074958.1|       QAARRQL-
                       ::.: **
```

FIG. 81

```
ref|YP_516922.1|      MFARIKTAYNRDGSPRRYLQIVESRREEGKVRQKVLCNLGRVEDLQNGKLDDLIRSLAKF
ref|YP_519084.1|      MFARIKTAYNRDGSPRRYLQIVESRREEGKVRQKVLCNLGRVEDLQNGKLDDLIRSLAKF
ref|ZP_01370818.1|    MFARIKTAYNRDGSPRRYLQLVESRREEGKVRQKVLCNLGRVEDLQNGKLDDLIRSLAKF
ref|ZP_01372264.1|    MFARIKTAYNRDGSPRRYLQLVESRREEGKVRQKVLCNLGRVEDLQNGKLDDLIRSLAKF
ref|YP_519534.1|      MFARIKTAYNRDGSPRRYLQLVESRREEGKVRQKVLCNLGRVEDLQNGKLDDLIRSLAKF
RAAC03707             MFAQIVSTKKPDGKTYKYLHIVESYREGRTVKKRRVASLGNISQYSEREIEQIIRTLESL
                      ***:*  ::  : **..  :**;:*** **  .*:::  :..**.:.:  .:  :::::*:*   .:

ref|YP_516922.1|      SDKLAVVDAAEDLFADWSKEYGPSMVFNRLWDNLGLHKILDGLFSERELSIDVREAIFCM
ref|YP_519084.1|      SDKLAVVDAAEDLFADWSKEYGPSMVFNRLWDNLGLHKILDGLFSERELSIDVREAIFCM
ref|ZP_01370818.1|    SDTLAVVDAAEDLFADWSKEFGPSMVFRRLWENLGLHTILDGLFNERDLSIDVQEAIFCM
ref|ZP_01372264.1|    SDTLAVVDAAEDLFADWSKEFGPSMVFRRLWENLGLHKIFAGLFNERDLSIDVQEAIFCM
ref|YP_519534.1|      SDTLAVVDAAEDLFADWSKEFGPSMVFRRLWENLGLHKILSGLFNERELSIDVQEAIFCM
RAAC03707             LQHR-TTGSLEDFEAQQVLHFGVPYVVQFLWNQLGLTEAIRDALRAREVTFDVARYVQAM
                       :   ....: **: *:    .:* .*.. ::*    : .  :  *:::** . : .* ref|YP_516922.1|      VLNRLTEPTSKLGVSDWKDSVYRPDF--ETLKLHHFYKAIDFLDENKDTIEEQLFFHHTN
ref|YP_519084.1|      VLNRLTEPTSKLGVSDWKDSVYRPDF--ETLKLHHFYKAIDFLDENKDTIEEQLFFHHTN
ref|ZP_01370818.1|    VLNRLTEPTSKLGVSDWKDSVYRPEF--ESLKLHHFYKAIDFLDENKDTLEEQLFFHHTN
ref|ZP_01372264.1|    VLNRLTEPTSKLGVSDWKDSVYRPEF--ESLKLHHFYRAIDFLDENKDTLEEQLFFHHTN
ref|YP_519534.1|      VLNRLTEPTSKLGVSDWKDSVYRPEF--ESLKLHHFYKAIDFLDENKESIEEQLFFHQTN
RAAC03707             VIHRLVDPSSKLRLFHTLDDLYLPDWGGEPWQLQHFYRALDYLVDIKPQLERVLYARLTD
                      *::**.:*:***      :  .  *.:*  *::    *. :*:***:*:*:*   *   :*.   *:   : *:

ref|YP_516922.1|      LFTQQLDLVFFDTTSTYVEGDAGAFDLLEYGHSKDHRPDRLQVMIGILMSRDGIPIAHHV
ref|YP_519084.1|      LFTQQLDLVFFDTTSTYVEGDACAFDLLEYGHSKDHRPDRLQVMIGILMSRDGIPIAHHV
ref|ZP_01370818.1|    LFTQQLDLVFFDTTSTYVEGDAGAFDLLEYGHSKDHRPDRLQVMTGILMSRDGIPIAHHV
ref|ZP_01372264.1|    LFTQQLDLVFFDTTSTYVQGDAGAFDLLEYGHSKDHRPDRLQVMTGILMSRDGIPIAHHV
ref|YP_519534.1|      LFTQQLDLVFFDTTSTYVEGDAGAFDLLEYGHSKDHRPDRLQVMIGILMSRDGIPIAHHV
RAAC03707             LINFRLSLVLYDLTSTHLHGHA--CPLGEHGYSRTHRPDLEQVELGLLVTPEGIPITHEV
                      *:. :*.**::* ***:.*.*      *  *:*:*:**   *:*:::  :****:*.* ref|YP_516922.1|      FPGNTPDTDAFIEAVSDLKKRFNIQRVIVVGDRGMMGKRTLELLEELQLQYILGVRMRN-
ref|YP_519084.1|      FPGNTPDTDAFIEAVSDLKKRFNIQRVIVVGDRGMMGKRTLELLEELQLQYILGVRMR--
ref|ZP_01370818.1|    FPGNTSDTDAFIEAVSDLKKRFTIQRVIVVGDRGMMGKRTLELLEELQLHYILGVRMRN-
ref|ZP_01372264.1|    FPGNTPDTDAFIEAVSDLKKRFTIQRVIVVGDRGMMGKRTLELLEELQLHYILGVRMRN-
ref|YP_519534.1|      FPGNTPDTDAFIEAVRDLKKRFTIQRVIVVGDRGMMGKRTLELLEELELHYILGVRMRN-
RAAC03707             FAGNVSDKQTVPDILKRLKEDFAVEQCVFVGDRGMVTEKNMALMAEAGFPYIVGFHKRGR
                      *.**..*.::..:  :  **:  * :::  :,****** ::..:  *: *    : **:*.: * ref|YP_516922.1|      --IKAGPDLANSPEPYAFIKDNLKVKEVVHQ---------EKRYIVCLNEEEAKRDQLVR
ref|YP_519084.1|      --------------------------------------------------------
ref|ZP_01370818.1|    --VKAGPELATSPEPYVFTKDNLKVKEVLHQ---------CKRYIVCLNEEEAKRDQWVR
ref|ZP_01372264.1|    --IKAGPELAASAQPYPFVKDNLKVKEVLHQ---------EKRYIVCLNEEEAKRDQLVR
ref|YP_519534.1|      --IKAGPELAASPEPYTFLKDNLKVKEVLHQ---------EKRYIVCLNEEEAKRDRLVR
RAAC03707             IVSDALLEQFADVNAYHELKDNLRYLEVPAASVDDVEKAEGVRYILCYNPEKAKQDAAFR ref|YP_516922.1|      E-------------------------------------------------------
ref|YP_519084.1|      --------------------------------------------------------
ref|ZP_01370818.1|    E-------------------------------------------------------
ref|ZP_01372264.1|    E-------------------------------------------------------
ref|YP_519534.1|      E-------------------------------------------------------
RAAC03707             ESALEEAETGLKALAESLAKPKRGRKPCDKCVMLKVADLLTRKGVEAFFQVDYKDGILTY ref|YP_516922.1|      --------
ref|YP_519084.1|      --------
ref|ZP_01370818.1|    --------
ref|ZP_01372264.1|    --------
ref|YP_519534.1|      --------
RAAC03707             RRDEDAIT
```

FIG. 82

```
ref|ZP_02171383.1|        ----------VYLARGSTDLRKSIDGLAAIVQEGFELDPFSSSLFVFCNRYRDKIKILY
RAAC03173                 MLAFDWTSDHRVYLVCGATDMRKSIDGLAALVQASFQLDPFSPCLFVFCNRQRDKLKILH
ref|YP_431168.1|          ----------RVYLACGATDLRKSIDGLAVLVKEGFELDPFSSCLFVFCNRNRDKLKILH
ref|YP_001212944.1|       ----------RVYLALGATDLRKSIDGLAVLVKEGFELDPFSSCLFVFCNRKCDKLKILH
ref|YP_754944.1|          ....    SNRQVYLACGSTDLRKSIDGLAVLVKEAFELNPFSPCLFVFCNRQRNKLKILQ
ref|YP_754864.1|          -------SNRLVYLACGSTDLRKSIDGLAVLVKESFHLDPFSPCLFVFCNRKRDKLKILQ
                                    ***. *::******.:*: .*.*:*..****  :*:*** ref|ZP_02171383.1|        WDHNGFWLYYRRLEKGRFPWPTSGSDEPMIITERQLRWLLDGLPLDQKGAHR--------
RAAC03173                 WSHNGFWLYYRRLERGRFDWPETGDAKTMVITRRELNWLLDGLPLEQPKAHRAVPVRSAI
ref|YP_431168.1|          WEHNGFWLYYRRLEKGKFVWPQDTTSSTITITRRELRWLLDGLPLKQPQAHPEVKARTIL
ref|YP_001212944.1|       WDHNGFWLHYRRLEKGKFHWPADAGSPTLVISRRELRWLLDGLSLKQPKAHPEVKARTIL
ref|YP_754944.1|          WDHNGFWLYYRRLERGKFEWPA-ADSQVVSISYREFRWLLDGLSLKQKQAHKAVKERTII
ref|YP_754864.1|          WEHNGFWLHYRRLERGKFDWPT-AHTDVVSISYREFRWLLDGLSLKQNQAHKAVKQR---
                          *.******:*****:*:* **         : *: *::.******.*.*   **
```

FIG. 83

```
ref|NP_634718.1|             ------------------------------------MLKTEEWLLIRDLYSQGFSISEIA
ref|NP_616807.1|             ------------------------------------MLKTEEWLSIRDLYSQGFSISEIS
gb|AAR99616.1|               ------------------------------------IKEMYERGMSISDIA
sp|Q45618|TRA6_BACST         ------------------------------------IKEMYERGMSISDIA
ref|YP_074959.1|             -----------------------------------MLRSGETLEIRQMYAGGLSISEIA
RAAC02966                    MRIPQDHRPQFLKIIGMNSPPPCRIVAPVIRSWEVPVMREDERMEIRQLYEAGVSISELA
                                                                   *:::*  *.***:::

ref|NP_634718.1|             KQTGFDRKTVRKYLRLKTLPEPQKRSG-----RKSKLDPFKPYIQEKLKEGPYT------
ref|NP_616807.1|             RRTGYARETVRKYLKKKTAPEPQKRPP-----KPSKLDPFKPYIQEKLKEGPYT------
gb|AAR99616.1|               RELGIDRKTVRKYIHSPNPPSKSKRKQ-----RKSKLDPFKPYLQKRM------------
sp|Q45618|TRA6_BACST         RELGIDRKTVRKYIHSPNPPSKSKRKQ-----RKSKLDPFKPYLQKRM------------
ref|YP_074959.1|             RRTGRDRKTIRKWLRTNTMPKPAKRK------RSSMLDQHEAFTLEQMQKGVTSASK---
RAAC02966                    RRFGYDRKTIRSALNSSLEEKQGERASRGERKKGSKLEPYKDYVKQRMQLGVSTLNEFCE
                             :. *  *:*:*. :.         . :*      : * *: .: :  :::

ref|NP_634718.1|             --------------------
ref|NP_616807.1|             --------------------
gb|AAR99616.1|               --------------------
sp|Q45618|TRA6_BACST         --------------------
ref|YP_074959.1|             --------------------
RAAC02966                    RFGSRAIPAVSPSSVSS
```

FIG. 84

```
ref|YP_148444.1|        MEERLVSGEVLGEETALEPSLRPQYLHEYIGQDKIKENLKVFIEAAKLREETLDHVLLYG
ref|NP_980798.1|        MDERLLSGESAYEDADLEYSLRPQTLRQYIGQDKAKHNLEVFIEAAKMREETLDHVLLYG
sp|Q9KDI8|RUVB_BACHD    MEERMVSAEAQTEEAAVEQGIRPHSFEQYIGQEKVKQNLKVFIEAAKMREEALDHVLLYG
ref|YP_430545.1|        --ERLVAGNLHNEDQELELSLRPRCLAEYIGQEHVKETLGIFIQAARERGEALDHVLLYG
ref|YP_001211577.1|     MKDRLISAVARPEDADVDTSLRPRLLAEYIGQEKVKETISVFIQAARGRGEPLDHVLLFG
RAAC00757               MDERLISAEWMREDAQLDT-IRPRFLDDYIGQRAAVENLRIFIQAAKERGEPLDHVLLYG
                          :*::.    *:  ::  :*    ..: ::**: * *.******:* ref|YP_148444.1|        PPGLGKTTLAVIIANEMGVKLRATSGPALERPGDLAALLTSLEPGDVLFIDEIHRLPRAV
ref|NP_980798.1|        PPGLGKTTLANIIANEMGVNVRTTSGPAIERPGDLAAVLTSLQPGDVLFIDEIHRLHRSI
sp|Q9KDI8|RUVB_BACHD    PPGLGKTTLSTIIANELGVQMRTTSGPAIERPGDLAAILTALEPGDVLFIDEIHRLNRMV
ref|YP_430545.1|        PPGLGKTTLAGIIANELGVQLRVTSGPALERAGDLAAILTNLQPRDVLFIDEIHRLPRQV
ref|YP_001211577.1|     PPGLGKTTLANIIANEMGVSIRTTSGPAVERPGDLAAILTSLSQGDILFIDEIHRLSRTV
RAAC00757               PPGLGKTSLAMTIANELGVQIRVTSGPAIERAGDLAAILTNLQPGDVLFIDEIHRLSPSV
                        *******:*: *****:**..:*.*****:** .*****:** *.  *:*******   :

ref|YP_148444.1|        EEVLYPAMEDYCLDITIGKGPDARTLRLDLPPFTLVGATTRAGALSAPLRDRFGVISRLE
ref|NP_980798.1|        EEVLYPAMEDFCLDIVIGKGPSARSVRLDLPPFTLVGATTRAGALSAPLRDRFGVLSRLE
sp|Q9KDI8|RUVB_BACHD    EEVLYPAMEDYCIDIVIGKGPTARSVRLDLPDFTLVGATTRAGMLSSPLRDRFGVMARLE
ref|YP_430545.1|        EEILYPAMEDFVLDIILGKGPGARSIRLDLPPFTLVGATTRAGLLSSPLRDRFGINSRLE
ref|YP_001211577.1|     EEVLYPAMEDYALDIVIGKGPGARSLRLELPRFTLVGATTRAGLLTSPLRDRFGVISRLE
RAAC00757               EEVLYPAMEDFAIDIVIGKGPSARSVRLDLPPFTLIGATTRAGLLSHPLRDRFGVMLHLD
                        **:*******: :**   **** **:**  ***:***********  *:  *******:   :*:

ref|YP_148444.1|        YYHVDCLAQIIERAAAILQIGIEREAALELARRARGTPRIANRLLRRVRDFAQVRGEGGI
ref|NP_980798.1|        YYTVDCLSEIVERTAEVFEVEIDSLAALETARRARGTPRIANRLLRRVRDFAQVRGNGTV
sp|Q9KDI8|RUVB_BACHD    YYNVEELTTIIERTATIFDTELERDASIEIARRSRGTPRIANRLLRRVRDFAQVSGDMRI
ref|YP_430545.1|        FYQVAELEEIIRRAATILQVAIEPEGAREIARRARGTPRVANRLLKRVRDYAEIRAGGVI
ref|YP_001211577.1|     YYRPEDLVLIVNRSARILGIEITAEGAFEIARRSRGTPRVANRLLKRVRDYAQVRANGVI
RAAC00757               YYPVRDLAEIVKRNARILQLSITEDGCAEIARRARGTPRIANRLLKRVRDIAQVAGWPEI
                        :*  :*  *:.* * ::      :  .. *:***:*****:*****:**** *:: .  :

ref|YP_148444.1|        TLPLAVEALERLQVDRLGLDQIDHKLLSAMTEKFAGGPVGLETLAAVIGEEAQTIEEVYE
ref|NP_980798.1|        TMEITQMALELLQVDKLGLDHLDHKLLLGIIEKFRGGPVGLETVSATIGEESHTIEDVYE
sp|Q9KDI8|RUVB_BACHD    SSSRAIESLERLQVDRLGLDHIDHKLIKGIMTKFNGGPVGLETISATIGEETDTIEEVYE
ref|YP_430545.1|        TREVAREALELLQVDAAGLDSSDRRLLLTLIRKFNGGPVGLETLAAAISEEPDTIEDVYE
ref|YP_001211577.1|     TCEVAVEALKFLEVDPLGLDFADRRLLLTIIQKFGGGPVGLETIATAVNEEPETVEDVYE
RAAC00757               DAARAAEALAQLHVDPLGLDATDKRILEAAMDKFGGGPVGLDTLAAAVGEEPSTLEDVYE
                          :*   *.  *  *::;      *   ****:*::;:..**, *:*:*** ref|YP_148444.1|        PYLMQIGLLQRTPRGRVVTPAAYTHLGMEVP--
ref|NP_980798.1|        PYLLQIGFLQRTPRGRVTPLAYEHFGMEMP--
sp|Q9KDI8|RUVB_BACHD    PYLLQIGFLQRTPRGRVVTPLAYEHFNMEVPN-
ref|YP_430545.1|        PFLLQMGYLQRTPRGRVATPGAYAHLG------
ref|YP_001211577.1|     PYLIQLGMLARTPRGRVTTPLAFRHLG------
RAAC00757               PYLLQIGFLKRTPRGRVVMPSAYRHLGRAVPSG
                        *:*:*:* * ******:. * *:  *:.
```

FIG. 85

```
ref|YP_234498.1|         -------MIGRLRGSIAEKQPPHLVLDVNGVGYEVEVPMTTLYRLPHVGETVTLHTHLVV
ref|YP_275913.1|         -------MIGRLRGSLAEKQPPHLVLDVNGVGYELEVPMTTLYRLPHVGETVTLHTHLVV
ref|NP_793742.1|         -------MIGRLRGAIAEKQPPHLVLDVNGVGYELEVPMTTLYRLPHVGETVTLHTHLVV
ref|YP_001186768.1|      -------VIGRLRGTLAEKQPPHLLLDVNGVGYELEVPMTTLYRLPAVGETLTLHTHQVV
ref|ZP_00991066.1|       -------MIGRLRGTLIEKQPPELLIEVSGVGYEVQMPMSCFYELPNVGEEAIIYTHFVV
RAAC00756                MGTGAFSVIAFLRGRVAFLGPGYVDLDVRDVGYRVIIVCDRTQAAL-NLGDTAFLYTHHHV
                               :*.  ***  :    *   : ::* .***.: :         *  :*:    ::** * ref|YP_234498.1|         REDAHLLYGFYEKRERELFRELIRLNGVGPKLALALMSGLEVDELVRCVQAQDTSALTRI
ref|YP_275913.1|         REDAHLLYGFYEKRERELFRELIRLNGVGPKLALALMSGLEVDELVRCVQAQDTSALTRI
ref|NP_793742.1|         REDAHLLYGFYEKRERELFRELIRLNGVGPKLALALMSGLEVDELVRCVQAQDTSALTRI
ref|YP_001186768.1|      REDAHLLYGFFEKRERELFRELIRLNGVGPKLALALMSGLEVDELVRCVQAQDTAALTKV
ref|ZP_00991066.1|       REDAQLLYGFNTVKERALFREVIKANGVGPKLGLGILSGMTASQFVQSVEREDISTLVKL
RAAC00756                REDGWALYGFETIEERALFERLVAVSGIGPKLALQVIGAAGVGEIVAAILAEDAESLSRL
                         ***. ****   .** **..::  .*:****.* ::..  ...:*  .:   :*   :* ::

ref|YP_234498.1|         PGVGKKTAERLLVELKDRFKAWEALPGTFTLVSNGPNQAEF-VASAESDAVSALISLGYK
ref|YP_275913.1|         PGVGKKTAERLLVELKDRFKAWESLPGTFTLVSNGPNQAEF-VASAESDAVSALISLGYK
ref|NP_793742.1|         PGVGKKTAERLLVELKDRFKAWESLPGTFTLVSNGPNHADF-VASAESDAVSALISLGYK
ref|YP_001186768.1|      PGVGKKTAERLLVELKDRFKAWETMPAIATLVVE-PRLGAT-VSSAENDAVSALISLGYK
ref|ZP_00991066.1|       PGVGKKTAERLVVEMKDRLKGWGAGDLFTPATDAAPMDSMPTVHDAEEEAVSALLALGYK
RAAC00756                PGIGRKLASRLVVELREKLDDIAPAALRAPAPASSPQ------GSAAEDAVSALVALGYR
                         **:*:* *.**:**::::: .   .       *         .* .:*****::***:

ref|YP_234498.1|         PQEASKAVSAIKEKDLSSADLIRRAL-----------------
ref|YP_275913.1|         PQEASKAVSAIKEKDLSSADLIRRAL-----------------
ref|NP_793742.1|         PQEASKAVSATKEKDLSSADLIRRAL-----------------
ref|YP_001186768.1|      PQEASRAVAAVKEDGLSSEDLIRRAL-----------------
ref|ZP_00991066.1|       PTQASKVVAQVAKGGMTSEQLTREAL-----------------
RAAC00756                PREAEEAVSAVGRGRQSVEDTTKAALTYLYARDARTEPLSQP
                         * :*...*: : .    :  : *: **
```

FIG. 86

```
ref|YP_644098.1|       ------------------------ILGIDPGTATMGWGVVRQ-EGSRLRYVQHGAITTP
RAAC00755              --------------------MESLRILGVDPGLARLGFGIIERGPGDSLHHVAHGCIETG
ref|YP_074988.1|       ---------------------MRILGIDPGTARMGYGIVEDAGAGRERAVEYGCLETP
ref|ZP_02848139.1|     ---------------------MRVLGIDPGIAIAGFGFIDK-DGHKLKPVQYGCIQTA
ref|YP_518701.1|       EE-IDENTITIESPSITIVESGAPSILGIDPGTAIMGYGLIEK-KGNRLFPVDYACWRTP
ref|YP_001180347.1|    ---------------------MRVLGIDPGIALTGYGIIESKNGSEFKVIDYGRIETS
                                               ::* * *:*.:    .    : :.    * ref|YP_644098.1|       SGWGMPRRLDRLFAGVTELIRGYRPSAVAVEELFFNTNVTTAIDVGQARGVALLAAYRAG
RAAC00755              ADTPLPERLRHIFQQLTELCRTHRPAVMAVEELFFSRNTTTAFTVGQARGVALLAGAEAG
ref|YP_074988.1|       PDMRPELRLQALYRGLADLMARHRPDALAVEELFFGRNVTTAIHVGQARGVVLLAAADSG
ref|ZP_02848139.1|     AHTPQEERLVQIYDSAVALMDKYKFDTVAVEKLFFNRNVTTAFAVGQARGVIILAAAQRG
ref|YP_518701.1|       AHTPMPERLLMLYHEIEAYIKEKQPHHVAVEELFFNRNTTTAISVGQARGVVLLAAAQCG
ref|YP_001180347.1|    SSLKKSMRLLHLYTELCSTISLYQPDVVAIEELFFSKNSKTAITIGEARGVIILTCIQNN
                          .    **   ::        :*  :*:*:***. * .**: :*:**** :*:    .

ref|YP_644098.1|       VEVFEYTPLQVKQATTSYGRADKRQVQEMVRALLGLRSIPRP------------------
RAAC00755              LAVMEYTPMQVKQAVTGYGRADKRQVQEMVRLLLRLTSVPKPDDAADALAVAIAHAHAGR
ref|YP_074988.1|       VPVREFTPMQVKHAVTGYGRANKAQVQRMVQALLGLPEIPKP------------------
ref|ZP_02848139.1|     LPVAEYTPLQVKQAVVGYGKAEKRQVQEMVKMFLKLSAIPKP------------------
ref|YP_518701.1|       LPVYEYTPLQVKQAVAGYGRADKQQIQQMVRALLGLQEIPKP------------------
ref|YP_001180347.1|    LSIYEYTPLQVKQSITGYGRADKTQIQKMVKSLLGLSEIPKP------------------
                       : : *::*  ::..**:*:* *:*.**: :* *   :*:* ref|YP_644098.1|       ------------------------
RAAC00755              IGELEARLAAGKRTGWVWERGRFR
ref|YP_074988.1|       ------------------------
ref|ZP_02848139.1|     ------------------------
ref|YP_518701.1|       ------------------------
ref|YP_001180347.1|    ------------------------
```

FIG. 87

```
ref|YP_146341.1|      ---------------VFIYLRKSRKDIEEEKKAAESGASYDTLQRHRDNLLAVARKEGHNIL
ref|YP_001373830.1|   ---------------VFIYLRKSRKDLEEEKKAMEHGQHYDTLERHRTQLLELAHKEHHNII
ref|ZP_02261478.1|    ---------------VCIYLRKSRKDVEEERRAIEEGSSYNALERHRKRLFAIAKAENHNII
ref|ZP_02257063.1|    ---------------VCIYLRKSRKDVEEERRAIEEGSSYNALERHRKRLFAIAKAENHNII
ref|YP_001513188.1|   ----------MEKVSIYLRKSRADIEAESRGEGE-----TLAKHRSTLLKVAKEKKLSIV
RAAC01468             MTPVSTFPTGLEHVATYLRKSRADLEAEARGEGE-----TLTKHRRALLELAKQYHYSID
                                    * ******* *:* * :.          :* :** *: :*:     .* ref|YP_146341.1|      GIFEEIVSGESIAERSEIQKLLRELETGVADAVLVMDIDRLGRGDMLDQGILDRAFRYSG
ref|YP_001373830.1|   DIFEEVVSGEYISERPMMQKLLREVETGIADAVLVMDLDRLGRGDMVDQGTIYRVFRYSE
ref|ZP_02261478.1|    DIFEEVASGESIQERPQMQQLLRKLEGNEIDGVLVIDLDRLGRGDMLDAGMIDRAFRYSS
ref|ZP_02257063.1|    DIFEEVASGESIQERPQMQQLLRKLEGNEIDGVLVIDLDRLGRGDMLDAGMIDRAFRYSS
ref|YP_001513188.1|   KIYEEIVSGESLMHRPEMLELLKNVESKKYDAVLVMDVDRLGRGNMQEQGLTLETFKKSC
RAAC01468             HIYEEIVSGELIVDRPEVQRLLHAVREGKYSAVLVMDIDRLGRGNQIDQGIIQQAFKQSG
                       *::.*  : .*. .*. :  :.   .*:*.****** :   *  : ..*: * ref|YP_146341.1|      TKIITPTEVYDPESETWELVFGVKSIVSREELKVITKRLQGGRRDSAAKGRSTSKKPPYG
ref|YP_001373830.1|   TFIITPTEVINPNDENQELTFSIKSLIAREELKTIVKRMQRGRKASAKEGKSISRVPAYC
ref|ZP_02261478.1|    TKIITPTDVYDPDEESWELVFGIKSLISRQELKSITKRLQNGRIDSVKEGKHIGKKPPYG
ref|ZP_02257063.1|    TKIITPTDVYDPDDESWELVFGIKSLISRQELKSITKRLQNGRIDSVKEGKHIGKKPPYG
ref|YP_001513188.1|   TKIITPRKIYNLDDEFDEEYSEFEAFMARKELKMINRRLQNGRVRSIEDGNYISPNPPYG
RAAC01468             TLIITPRKVYNLEDELDEEFSEFEQFMARRELKIITRRMQRGRKLSAKEGKSITPYVPFG
                      * ****  .: : :.*   *     .: ::: *.*** * :*:* **   * .*. *    .:* ref|YP_146341.1|      YLRDEQ---LKLYPDPETSWVVVKIFFMVRDGHGRQAIAAELDRLGVKPPDEKRAFWSPS
ref|YP_001373830.1|   YLRDNN---LKLYPDPEKSWVIPKIFELMANGIGRQAIAQELDRLGTAPPEGE--YWNPS
ref|ZP_02261478.1|    YLKDEN---LRLYPDPEKAWIVKKIFELMCDGKGRQMIAAELDRLGIDPPVTKRGAWDSS
ref|ZP_02257063.1|    YLKDEN---LRLYPDPEKAWIVKKIFELMCDGKGRQMIAAELDRLGIDPPVTKRGAWDSS
ref|YP_001513188.1|   YEIDEGKDYRTLKPHPEQAEVVKMIFEWYVSGLGSGKIANKLNDLGYKSYTGIP--WRSS
RAAC01468             YKRDEN---LKLYPDPETAPIVRQIFEWSAEGLGLGIIKIAKKLNEMGVPAPRSCG--WQRT
                      *  *:     *  *.** : ::  ***   .* *   ** :*:  :*    .        * :

ref|YP_146341.1|      TISAIIKNEVYLGHIIWGKVKYIKQNGRYKRK---KMPRERWYVKENAHAPLVSKELWEA
ref|YP_001373830.1|   TISSIIKNEVYLGHIIWGKTRYTKQNGKYIRK---KVSKERWQRHDNAHPPLVSEELFQK
ref|ZP_02261478.1|    TITSIIKNEVYTGVIVWGKFKHKKRNGKYTRH---KNPQEKWIMYENAHEPIISKELFDA
ref|ZP_02257063.1|    TITSIIKNEVYTGVIVWGKFKHKKRNGKYTRH---KNPQEKWIMYENAHEPIISKELFDA
ref|YP_001513188.1|   SVLNMLKNLVTGKVVWGRKDIKKSTEVGKVRDTVTRPKEEWIIADGKHPALVSEELFEK
RAAC01468             TVQHILKNEVYLGRIVWDKKRDVKTTEG-KYR-SIKRPREEWIVHENAHEPIISQELWDR
                      :: ::**  **  * * ::*.:   *    **:* :*   .  * *  .:::*:**::

ref|YP_146341.1|      ANKAYRSRWRPSTVESKPLANPLAGLLKCEVCGYTMWYQPRKDRPEPLVRCPNPKCKGVQ
ref|YP_001373830.1|   ANTAHSKRWRPPTIKTKKLSNPLAGLLLCELCGHSMLYQPRKDRPNPQVRCVQPSCKGVQ
ref|ZP_02261478.1|    ANEAHSSRHKPAVITSKKLTNPLAGILKCKLCGYTMLIQTRKDRPFNYLRCNNPACKGKQ
ref|ZP_02257063.1|    ANEAHSSRHKPAVITSKKLTNPLAGILKCKLCGYTMLIQTRKDRPHNYLRCNNPACKGKQ
ref|YP_001513188.1|   ACEILNKRYHVPYQLENGITNPLAGLIRCENCGASMVLRPYPDKD-HQVMCYNN-CGNKS
RAAC01468             VVEIRKVNDHR-TKDNYDLKNPFAGILRCKQCGRVMKRQPRPNRNGDTLQCYTTGCPTRE
                         .     .:   :   ::: *:  **   *  :: ::     *     * ref|YP_146341.1|      KGALLPLVEEKILQSLAEFVDQFEVQE---DRKEQRSV------IPLKQKAIEKKEKELRE
ref|YP_001373830.1|   KGASLALVEQRILDGLKQIIESFEIQENMVQQKKRKNN------IHLQQKALEKKEQQMIN
ref|ZP_02261478.1|    KQSVFNLVEEKLLYSLQQIVDEYQACKVEEVEIDDSKL------ISFKEKAIISKEKELKE
ref|ZP_02257063.1|    KQSVFNLVEEKLLYSLQQIVDEYQACKVEEVEIDDSKL------ISFKEKAIISKEKELKE
ref|YP_001513188.1|   --SKLKYVEKEVLAGLAEWCLQYRAQWDIDNKSKRKKSKLTSSIPVLEKAVENLQKELVE
RAAC01468             --VLLSRLEDRVLQSIEEFVQSYAAQSSVKKRADNRQKKLEA----LHRQKKSIQSKLSK
                          :  *..:*  .:    :   . :            .:    . ..::

ref|YP_146341.1|      LHKQKDALHDLLERGVYTIETFLERQQTIVSRIKKTQEEIDQLREEIAKEQLKEKNISEY
ref|YP_001373830.1|   LQKQKNNLHDLLEKGVYDVETFLERQKSIAVRLKTTQKAIEELKHETKKILEKEKHIHEF
ref|ZP_02261478.1|    LQAQKGNLHDLLEQGIYTVEIFLERQKNLVERITSIENDIEVIQKEIETEQIKEHNKTEF
ref|ZP_02257063.1|    LQAQKGNLHDLLEQGIYTVEIFLERQKNLVERITSIENDIEVIQKEIETEQIKEHNKTEF
ref|YP_001513188.1|   LENQKNSLHDFLERGIYDVTYLERSQNLATRIDATKVSLSKAKLVLGQEMQREKAQIDI
RAAC01468             LETQKNRLFDFLEQGIYDVQTFIERSKLVGEQIDQAKEELKICEQAIEREMLQQQHEEEL
                      *. **. *.*:*:*:*  ::  :*..:        :  :  :::        :  ::

ref|YP_146341.1|      VPTVKKVLDAYRLTDDVEKKNRLLKSVLEKATYLRKPEWTKKDQFTIQLYPRI
ref|YP_001373830.1|   VPRIKNVLEAYYATNDIEKKNRLLKSVLEKATYLRKKIWQRKDEFLIELYTRI
ref|ZP_02261478.1|    IPALKTVIESYHKTTNIELKNQLLKTILSTVTYYRHPDWKTN EFEIQVYFKI
ref|ZP_02257063.1|    IPALKTVIESYHKTTNIELKNQLLKTILSTVTYYRHPDWKTN EFEIQVYFKI
ref|YP_001513188.1|   IPRIEKVLDVYPKINDPAHKNELLKSVLDYAAYSKDKSK-RNDDFSLRLF---
RAAC01468             IPAISEAIAMYRTASNAEIKNMALKSVIKEIHYYRPRSWSKSKEFEIDIYFRI
                      :*  :. .:  *    :  ** **::::  :*   *   .:*::  : :
```

FIG. 88

```
ref|YP_753434.1|        ----------------------------------------------------------
ref|YP_753226.1|        EFYPHYPTHETICALPRTEINSWLSYNTRPHMNASWLFEISUBSPWLFEISTRGETTING
ref|YP_752864.1|        ----------------------------------------------------------
ref|ZP_01665148.1|      ----------------------------------------------------------
ref|YP_001111903.1|     ----------------------------------------------------------
RAAC03178               ---------------------------------------------------------- ref|YP_753434.1|        ----------------------------------------------------------
ref|YP_753226.1|        ENGBABIHYPTHETICALPRTEINSWLSYNTRPHMNASWLFEISUBSPWLFEISTRGETT
ref|YP_752864.1|        ----------------------------------------------------------
ref|ZP_01665148.1|      ----------------------------------------------------------
ref|YP_001111903.1|     ----------------------------------------------------------
RAAC03178               ---------------------------------------------------------- ref|YP_753434.1|        ----------------------------------------------------------
ref|YP_753226.1|        INGENGBABIHYPTHETICALPRTEINSWLSYNTRPHMNASWLFEISUBSPWLFEISTRG
ref|YP_752864.1|        ----------------------------------------------------------
ref|ZP_01665148.1|      ----------------------------------------------------------
ref|YP_001111903.1|     ----------------------------------------------------------
RAAC03178               ---------------------------------------------------------- ref|YP_753434.1|        ----------------------------------------------------------
ref|YP_753226.1|        ETTINGENGBABIHYPTHETICALPRTEINSWLSYNTRPHMNASWLFEISUBSPWLFEIS
ref|YP_752864.1|        ----------------------------------------------------------
ref|ZP_01665148.1|      ----------------------------------------------------------
ref|YP_001111903.1|     ----------------------------------------------------------
RAAC03178               ---------------------------------------------------------- ref|YP_753434.1|        ----------------------------------------------------------
ref|YP_753226.1|        TRGETTINGENGBABIHYPTHETICALPRTEINSWLSYNTRPHMNASWLFEISUBSPWLF
ref|YP_752864.1|        ----------------------------------------------------------
ref|ZP_01665148.1|      ----------------------------------------------------------
ref|YP_001111903.1|     ----------------------------------------------------------
RAAC03178               ---------------------------------------------------------- ref|YP_753434.1|        ----------------------------------------------------------
ref|YP_753226.1|        EISTRGETTINGENGBABIHYPTHETICALPRTEINSWLSYNTRPHMNASWLFEISUBSP
ref|YP_752864.1|        ----------------------------------------------------------
ref|ZP_01665148.1|      EAXTRANSPSASEISFAMILYP--------RTEINTHERMSINU---------------
ref|YP_001111903.1|     ----------------------------------------------------------
RAAC03178               ---------------------------------------------------------- ref|YP_753434.1|        -------------------IHYPTHETICALPRTEINSWLSYNTRPHMNASWLFEISU
ref|YP_753226.1|        WLFEISTRGETTINGENGBABIHYPTHETICALPRTEINSWLSYNTRPHMNASWLFEISU
ref|YP_752864.1|        ----------------------------------------------------------
ref|ZP_01665148.1|      ------SCARBXYDIVRANSNRGBEAXTRANSPSASEISFAMILYPRTEINTHERMSINU
ref|YP_001111903.1|     ----------------------------------------------------------
RAAC03178               --------------MLLSNGTTYMQERVHWGVHHIAPVNCMHLHNIKFFRSESTRFPKNref|YP_753434.1|        BSPWLFEISTRGETTINGENSCRESIGNIFICANCEE-IDENTITIESPSITIVESGAP-
ref|YP_753226.1|        BSPWLFEISTRGETTINGENSCRESIGNIFICANCEE-IDENTITIESPSITIVESGAP-
ref|YP_752864.1|        ----------------------------------------------------------
ref|ZP_01665148.1|      ----SCARBXYDIVRANSNRSCRESIGNIFICANCEE-IDENTITIESPSITIVESGAPS
ref|YP_001111903.1|     ----------------------------------------------------------
RAAC03178               ------FVRYLNEPFAESRVLVRQG------FFEHKEGLHPNLRERKWYPANHFKGAKSN
``` continued →

FIG. 88 continued

```
ref|YP_753434.1|    -SIRQNCIFSFEDALKIQPKSRLEKIINTLDLKPVLCKLDKPGEIRVGPKPYPAYAMLNA
ref|YP_753226.1|    -SIRQNCIFSFEDALKIQPKSRLEKIINTLDLKPVLCKLDKPGEIRVGPKPYPAYAMLNA
ref|YP_752864.1|    --IRQGYVFSFEDAINLQPRSRLEIVLATLDFDDVITVLDKENKQHRGPTGYPFESKLNA
ref|ZP_01665148.1|  MYIRQKPLFSFDTLMQYQPKTRLAMVFESIDLHPLLKTLPIKS--IRGPKGYSSAALIKA
ref|YP_001111903.1| MYLLQPNLFSFEELLKFEPETKLQKVLSVLDLSPALNVVKRAV---LGPKGHCVGNMIRA
RAAC03178           VYVRQAWLFSFDEWMEMSPCERRELFFSTLDLSPYAAKLRSSTP--QGAKPISREAILRA
                     : *  :***:   :: .*  :    .: :*:       :    *..     :.* ref|YP_753434.1|    LIAMRLENMGTFTQLVERLTYDPHLRYVCGFEPFGTAPSKSCFSRFYSKLAQS-------
ref|YP_753226.1|    LIAMRLENMGTFTQLVERLTYDPHLRYVCGFEPFGTAPSKSCFSRFYSKLAQS-------
ref|YP_752864.1|    LIAMRVYNMATFTELVERLTHDPVLRYNCGFDVFGKVPSIATFSRFYERLTQS-------
ref|ZP_01665148.1|  FLAMRLCSIPTVTLLVERLKTDLVFRYECGFSLEQPVPSLATFSRFFQKIAET-------
ref|YP_001111903.1| LVAKQLEQIPTVAALVKRLSNDIRFRFQCGFSLSKPIPSESTFSRLIQKLAATDETNKTE
RAAC03178           FLAAPLEGISTFTQLHRRLESDLRFRYQCGFSLHESIPSVSTLSRVFQAIVDK-------
                    ::*    :  : *.: * .**  *  *:*: ***.   ** : :**. . :.

ref|YP_753434.1|    GCLETLFTSLVKQAEEMGLLDLSSVAIDATKVEAYEKSVPRKNIIQDGNVADWGIKSDTN
ref|YP_753226.1|    GCLETLFTSLVKQAEEMGLLDLSSVAIDATKVEAYEKSVPRKNIIQDGNAADWGIKSDTN
ref|YP_752864.1|    EVLRELFKKQVTTAESMGLIDTSSIAIDASKVDANEKSVPRKNIKDDGQSANWGSKLDTN
ref|ZP_01665148.1|  DSLQVLFSALVDTAIQDKVISGEVVAIDASAIDSYEKPVPKKELNSNGDSATWGAKLDTH
ref|YP_001111903.1| SVMKQIFDNLVKSAKDMGLIDSNCVAIDSSKIDAYEKSKPKKDLQGD-KTANWGAKRDTH
RAAC03178           GVAATLFAELVRQCRDEGLIEGEHVAIDSTAIHAYERKHPRSGVQPS-NRANWGAKFDAF
                     :*    *   . . ::. .:***::  :.: *: *:.     . . *  ** * *:

ref|YP_753434.1|    GNPIKWFGYKLHIGTDVKSGLPIAMKVTPANYSDSSVALELVEKCCANTQS--KIVYFLM
ref|YP_753226.1|    GNPIKWFGYKLHIGTDVRSGLPIAMKVTPANCSDSSVALELVEKCCANTQS--KIVYFLM
ref|YP_752864.1|    GNQITWFGYKLHIATDVKSELPVALSITPASTNDGIMAESILEECSNNLNS--KPQYYLM
ref|ZP_01665148.1|  GNQHVWFGYKLHLAVDTKSELPIAVKVTPANRNDVTQAIPLMDEIKH------QPKYYCM
ref|YP_001111903.1| GNQISWFGYKAHVAVDCHSELPIAIMVTPANTHDAKMAIPLIELVNKALEDSKKPKYYTM
RAAC03178           GNKLAWFGYKVHLAVDAKSELPMALTVTPANVYDGEMAIPLMEELHHHDWR---IRFVLM
                       ***  ::..*  :* **:*: :***.     *    * :::         : * ref|YP_753434.1|    DAGYDHREIYSVIRDKYHAQAIIALNKRGAKQPPEGFDWDGTPICSARYRMVYWGSY--Q
ref|YP_753226.1|    DAGYDHREIYSVIRDKYHAQAIIALNKRGAKQPPEGFDWDGTPICSARYRMVYWGSY--Q
ref|YP_752864.1|    DAGYDQKSIYELIRDKYKAQAIIPLNHRGAKEPPEGLDWDATPICSAGYRMAYWGGS--N
ref|ZP_01665148.1|  DMGYDAKDVYQAAYER-QAQAIIPLNRRKEKLPPEGMDENRTPTCSMGYPMVYWGCEREK
ref|YP_001111903.1| DMGYDSKDIYSVVMNDFNAQAIIPINSRGSKDHPEGCDFDGTPICSMGQRMVFWGSDAKA
RAAC03178           DAGYDQTKNYEAARAL-GAQAIIPMNRRNEKEPPEGMDFDGTPRCTMGYRMTYWGVH--N
                    * ***    .*.        ****.:* *  * ***  *   :  **  *. :**

ref|YP_753434.1|    GVNKFRCPHIMGKCDCPFGSAWCSDSNYGMVVKTKVKDDPRLFSSPHRGSANWQKQYNLR
ref|YP_753226.1|    GVNKFRCPHIMGKCDCPFGSAWCSDSNYGMVVKTKVKDDPRLFSSPHRGSANWQKQYNLR
ref|YP_752864.1|    GVNKFRCPHVMGKCDCPFGSSWCSDSNYGMVVKTRAQDSRLFIVPHRGTSNWKLLYNKR
ref|ZP_01665148.1|  GILKFRCPHVCGKVNCPNGSAWCSPSNYGLVIKKKVEDDPRSFCTPHRGTREWEKLYAER
ref|YP_001111903.1| GTNKYRCPHVMGKCDCPYGSAWCSPSSYGLVVKTKVKDDPRMNCIPARGTKNWQSLYNKR
RAAC03178           AWLKFRCPHATGQVDCPLGMAACSASNYGMVVKKHLDEDVRRYANPHRGSRTWKMLYDER
                    .  :****    *: :**  * . *.**:*:*.:  :*  *    *  *:    * ref|YP_753434.1|    TYSERCFSRFKENLGLEDGLNVRKITKVETHAYLCAITMIAAVIAINQ--------
ref|YP_753226.1|    TYSERCFSRFKENLGLEDGLNVRKITKVETHAYLCAITMIAAVIAINQ--------
ref|YP_752864.1|    TSVERCFGRLKEHLGLETGLNVRGIKKVKTHAYLSVITMIASVIAINKDKSSTDIA
ref|ZP_01665148.1|  TSVERAFSRLKEQLGANT-VRVQGIKKVTAHLMLCCIALLAGTIAVNR--------
ref|YP_001111903.1| TSVERCFGRLKQHLGANS-IRTRGLEKVTLHITLSCIALLAGSIAVAKTKRIEQAA
RAAC03178           TAVERCFARLKEWLTLDG-VHVRGIEKVTVHAYIHAIVLLASALMHRTNRIEQVA
                    *  **.*.*:*: *  :  .. : : **   * .::: :  : :  :   :
```

FIG. 89

```
ref|YP_001126744.1|    ------------------------------------------------------------
gb|AAB52611.1|         ------------------------------------------------------------
sp|P52026|DPO1_BACST   ------------------------------------------------------------
gb|ABM97416.1|         ------------------------------------------------------------
dbj|BAF33373.1|        ------------------------------MNFVNIIINSLKCVNSACVPLGVRPFSC
RAAC01937              MNFHPRHGPVRTFHWLSAPPRRTYSLLHGLRSMNFVNIIINSLKCVNSACVPLGVRPFSC ref|YP_001126744.1|    ---------------------------------KLVLIDGNSVAYRAFFALPLLHNDKG
gb|AAB52611.1|         ---------------------------------KLVLIDGNSVAYRAFFALPLLHNDKG
sp|P52026|DPO1_BACST   --------------------------------NKLVLIDGNSVAYRAFFALPLLHNDKG
gb|ABM97416.1|         --------------------------------NKLVLIDGNSVAYRAFFALPLLHNDKG
dbj|BAF33373.1|        RHKTTRADKGNVIEWSGTTVRQTARSLGWPMPASKLVLIDGNSILYRAFFALPPLTARDG
RAAC01937              RHKTTRADKGNVIEWSGTTVRQTARSLGWPMPASKLVLIDGNSILYRAFFALPPLTARDG
                                                        *******: ***** *   .* ref|YP_001126744.1|    IHTNAVYGFTMMLNKILAEEQPTHLLVAFDAGKTTFRHETFQEYKGGRQQTPPELSEQFP
gb|AAB52611.1|         IHTNAVYGFTMMLNKILAEEQPTHLLVAFDAGKTTFRHETFQEYKGGRQQTPPELSEQFP
sp|P52026|DPO1_BACST   IHTNAVYGFTMMLNKILAEEQPTHILVAFDAGKTTFRHETFQDYKGGRQQTPPELSEQFP
gb|ABM97416.1|         IHTNAVYGFTMMLNKILAEEEPTHMLVAFDAGKTTFRHEAFQEYKGGRQQTPPELSEQFP
dbj|BAF33373.1|        TPTNAVYGFTTMILRLMSDEKPTHLAVAFDKSKTTFRHADFAAYKGTRQETPDELVQQFP
RAAC01937              TPTNAVYGFTTMILRLMSDEKPTHLAVAFDKSKTTFRHADFAAYKGTRQETPDELVQQFP
                        ******** *:  :::::*:*:   .**  *   * :  :*** ref|YP_001126744.1|    LLRELLKAYRIPAYELDHYEADDIIGTLAARAEQEGFEVKIISGDRDLTQLASRHVTVDI
gb|AAB52611.1|         LLRELLKAYRIPAYELDHYEADDIIGTLAARAEQEGFEVKIISGDRDLTQLASRHVTVDI
sp|P52026|DPO1_BACST   LLRELLKAYRIPAYELDHYEADDIIGTMAARAEREGFAVKVISGDRDLTQLASPQVTVEI
gb|ABM97416.1|         LLRELLRAYRIPAYELENYEADDIIGTLAARAEQEGFEVKVISGDRDLTQLASPHVTVDI
dbj|BAF33373.1|        LARRTLEALSIPMVEIDQYEADDVIGTLAKRAAEAGFDVRVVSGDKDLLQLVDDRIHVLL
RAAC01937              LARRTLEALSIPMVEIDQYEADDVIGTLAKRAAEAGFDVRVVSGDKDLLQLVDDRIHVLL
                       * *. *.*  ** *:::*****:***:* **  ** *:::***:** **.. :: * :

ref|YP_001126744.1|    TKKGITDIEPYTPETVREKY-GLTPEQIVDLKGLMGDKSDNIPGVPGIGEKTAVKLLKQF
gb|AAB52611.1|         TKKGITDIEPYTPETVREKY-GLTPEQIVDLKGLMGDKSDNIPGVPGIGEKTAVKLLKQF
sp|P52026|DPO1_BACST   TKKGITDIESYTPETVVEKY-GLTPEQIVDLKGLMGDKSDNIPGVPGIGEKTAVKLLKQF
gb|ABM97416.1|         TKKGITDIEPYTPETVREKY-GLTPEQIVDLKGLMGDKSDNIPGVPGIGEKTAVKLLRQF
dbj|BAF33373.1|        TRKGITEMEHFDEQAVARRYPGLKPAQVIDLKGLMGDPSDNIPGVPGVGEKTALKLLASF
RAAC01937              TRKGITEMEHFDEQAVARRYPGLKPAQVIDLKGLMGDPSDNIPGVPGVGEKTALKLLASF
                       *:****::*   :  ::* ..:* **.* *::***** ******.*:**:* .* ref|YP_001126744.1|    GTVENVLASIDEVKGEKLKENLRQHRDLALLSKQLASICRDAPVELSLDDIVYEGQDREK
gb|AAB52611.1|         GTVENVLASIDEVKGEKLKENLRQHRDLALLSKQLASICRDAPVELSLDDIVYEGQDREK
sp|P52026|DPO1_BACST   GTVENVLASIDEIKGEKLKENLRQYRDLALLSKQLAAICRDAPVELTLDDIVYKGEDREK
gb|ABM97416.1|         GTVENVLASIDEIKGEKLKETLRQHREMALLSKKLAAIRRDAPVELSLDDIAYQGEDREK
dbj|BAF33373.1|        GTVEGVYDHLDEVQGQKLRERLEQHREDAFLSKRLATIACDAPIEVDLETLRYEGPDPAR
RAAC01937              GTVEGVYDHLDEVQGQKLRERLEQHREDAFLSKRLATIACDAPIEVDLETLRYEGPDPAR
                       ****.*    :**::*:**:* *.*:*: *:***:**:* ***:*: *  : **  *   :

ref|YP_001126744.1|    VIALFKELGFQSFLEKMAAPAAEGEKP------------LEEMEFAIVDVI-----TEE
gb|AAB52611.1|         VIALFKELGFQSFLEKMAAPAAEGEKP------------LEEMEFAIVDVI-----TEE
sp|P52026|DPO1_BACST   VVALFQELGFQSFLDKMAVQTDEGEKP------------LAGMDFAIADSV-----TDE
gb|ABM97416.1|         VVALFKELGFQSFLEKMESPSSEEEKP------------LAKMAFTLADRV-----TEE
dbj|BAF33373.1|        AIAWFRELDFRSLVDKISEEMSHDSTPTPSPAAASGASSEWSSFAYGLIEDAGAWQEAIS
RAAC01937              AIAWFRELDFRSLVDKISEEMSHDSTPTPSPAAASGASSEWSSFAYGLIEDAGAWQEAIS
                        .:* *:**.*:*:::*:         . ...*          : : : :   : .

ref|YP_001126744.1|    MLADKAALVVEVMEENYHDAPIVGIALVNEHGRFFMRPETALADSQFLAWLADETKKKSM
gb|AAB52611.1|         MLADKAALVVEVMEENYHDAPIVGIALVNEHGRFFMRPETALADSQFLAWLADETKKKSM
sp|P52026|DPO1_BACST   MLADKAALVVEVVGDNYHHAPIVGIALANERGRFFLRPETALADPKFLAWLGDETKKKTM
gb|ABM97416.1|         MLADKAALVVEVVEENYHDAPIVGIAVVNEHGRFFLRPETALADPQFVAWLGDETKKKSM
dbj|BAF33373.1|        SFSEPVGVMMDLADPDYHRAEIRGMAVATPKRAYYVRFGERLELSDVRPWLVSD-RPKVA
RAAC01937              SFSEPVGVMMDLADPDYHRAEIRGMAVATPKRAYYVRFGERLELSDVRPWLVSD-RPKVA
                       ::: ..::::::    :**  * * *:*:..  : :::*    *  ...** .: : *
``` continued →

FIG. 89 continued

```
ref|YP_001126744.1|   FDAKRAVVALKWKGIELRGVA--FDLLLAAYLLNPAQDAGDIAAVAKMKQYEAVRSDEAV
gb|AAB52611.1|         FDAKRAVVALKWKGIELRGVA--FDLLLAAYLLNPAQDAGDIAAVAKMKQYEAVRSDEAV
sp|P52026|DPO1_BACST   FDSKRAAVALKWKGIELRGVV--FDLLLAAYLLDPAQAAGDVAAVAKMHQYEAVRSDEAV
gb|ABM97416.1|         FDSKRAAVALKWKGIELCGVS--FDLLLAAYLLDPAQGVDDVAAAAKMKQYEAVRSDEAV
dbj|BAF33373.1|        FDLKSMAFALDAHGIGLTSECGWQDVKLAAYLLNPQDG-------------EVELSDVFA
RAAC01937              FDLKSMAFALDAHGIGLTSECGWQDVKLAAYLLNPQDG-------------EVELSDVFA
                       ** *  ..**.:** *      *: ******:*  :              *. **  .

ref|YP_001126744.1|    YGKGVKRSLPDEQTLAEHLVRKAAAIWALEQPFMDDLRNNEQDQLLTKLEQPLAAILAEM
gb|AAB52611.1|         YGKGVKRSLPDEQTLAEHLVRKAAAIWALEQPFMDDLRNNEQDQLLTKLEQPLAAILAEM
sp|P52026|DPO1_BACST   YGKGAKRTVPDEPTLAEHLVRKAAAIWALEEPLMDELRRNEQDRLLTELEQPLAGILANM
gb|ABM97416.1|         YGKGAKRAVPDEPVLAEHLVRKAAAIWALERPFLDELRRNEQDRLLVELEQPLSSILAEM
dbj|BAF33373.1|        RERGQELPAWEEGEREKWLAYTASQLPPLFESLAYTIRMQEMERLYQEVELPLAFVLAKM
RAAC01937              RERGQELPAWEEGEREKWLAYTASQLPPLFESLAYTIRMQEMERLYQEVELPLAFVLAKM
                        :*  :  .:*    : *. .*:  .*  ..:   :*  :* ::*    ::*  ::* ref|YP_001126744.1|    EFTGVNVDTKRLEQMGSELAEQLRAIEQRIYELAGQEFNINSPKQLGVILFEKLQLPVLK
gb|AAB52611.1|         EFTGVNVDTKRLEQMGSELAEQLRAIEQRIYELAGQEFNINSPKQLGVILFEKLQLPVLK
sp|P52026|DPO1_BACST   EFTGVKVDTKRLEQMGAELTEQLQAVERRIYELAGQEFNINSPKQLGTVLFDKLQLPVLK
gb|ABM97416.1|         EFAGVKVDTKRLEQMGEELAEQLRTVEQRIYELAGQEFNINSPKQLGVILFEKLQLPILK
dbj|BAF33373.1|        EITGFYVNREKLVAFGQELTERIKRITQEIYDLAGTSFNLNSPKQLGEILFDKLGLPALK
RAAC01937              EITGFYVNREKLVAFGQELTERIKRITQEIYDLAGTSFNLNSPKQLGEILFDKLGLPALK
                       *::*.  *:  ::*  :* **:*:::  :  :.**:***  .**:****** :**:** ** **

ref|YP_001126744.1|    KTKTGYSTSADVLEKLAPHHEIVENILHYRQLGKLQSTYIEGLLKVVRPDTGKVHTMFNQ
gb|AAB52611.1|         KTKTGYSTSADVLEKLAPHHEIVENILHYRQLGKLQSTYIEGLLKVVRPDTGKVHTMFNQ
sp|P52026|DPO1_BACST   KTKTGYSTSADVLEKLAPHHEIVEHILHYRQLGKLQSTYIEGLLKVVHPVTGKVHTMFNQ
gb|ABM97416.1|         KTKTGYSTSADVLEKLAPYHEIVENILHYRQLGKLQSTYIEGLLKVVRPDTKKVHTIFNQ
dbj|BAF33373.1|        KTKTGYSTSADVLEKLAPMHEIVQKILDYRLLAKLQSTYVEGLLKVIRKETGRVHTRFHQ
RAAC01937              KTKTGYSTSADVLEKLAPMHEIVQKILDYRLLAKLQSTYVEGLLKVIRKETGRVHTRFHQ
                       **************** ::.** *.****:****::*  * :*** *:* ref|YP_001126744.1|    ALTQTGRLSSAEPNLQNIPIRLEEGRKIRQAFVPSEPDWLIFAADYSQIELRVLAHIADD
gb|AAB52611.1|         ALTQTGRLSSAEPNLQNIPIRLEEGRKIRQAFVPSEPDWLIFAADYSQIELRVLAHIADD
sp|P52026|DPO1_BACST   ALTQTGRLSSVEPNLQNIPIRLEEGRKIRQAFVPSEPDWLIFAADYSQIELRVLAHIAED
gb|ABM97416.1|         ALTQTGRLSSTEPNLQNIPIRLEEGRKIRQAFVPSESDWLIFAADYSQIELRVLAHIAED
dbj|BAF33373.1|        TLTATGRLSSSEPNLQNIPIRLEEGRRLRQVFEPTYKDWVIFAADYSQIELRILAHLSGD
RAAC01937              TLTATGRLSSSEPNLQNIPIRLEEGRRLRQVFEPTYKDWVIFAADYSQIELRILAHLSGD
                       : ** ***********::.* *:   :*******:*:: * ref|YP_001126744.1|    DNLIEAFQRDLDIHTKTAMDIFHVSEEEVTANMRRQAKAVNFGIVYGISDYGLAQNLNIT
gb|AAB52611.1|         DNLIEAFQRDLDIHTKTAMDIFHVSEEEVTANMRRQAKAVNFGIVYGISDYGLAQNLNIT
sp|P52026|DPO1_BACST   DNLIEAFRRGLDIHTKTAMDIFHVSEEDVTANMRRQAKAVNFGIVYGISDYGLAQNLNIT
gb|ABM97416.1|         DNLMEAFRRDLDIHTKTAMDIFQVSEDEVTPNMRRQAKAVNFGIVYGISDYGLAQNLNIS
dbj|BAF33373.1|        EALIDAFRRDMDIHTRTAADVFEVPPEQVTSLMRRQAKAVNFGIVYGISDFGLAQNLNIP
RAAC01937              EALIDAFRRDMDIHTRTAADVFEVPPEQVTSLMRRQAKAVNFGIVYGISDFGLAQNLNIP
                       : *::**:*.:****:** *:* *.*  :*.. ::**. ******************:*******.

ref|YP_001126744.1|    RKEAAEFIERYFASFPGVKQYMENIVQEAKQKGYVTTLLHRRRYLPDITSRNFNVRSFAE
gb|AAB52611.1|         RKEAAEFIERYFASFPGVKQYMENIVQEAKQKGYVTTLLHRRRYLPDITSRNFNVRSFAE
sp|P52026|DPO1_BACST   RKEAAEFIERYFASFPGVKQYMDNIVQEAKQKGYVTTLLHRRRYLPDITSRNFNVRSFAE
gb|ABM97416.1|         RKEAAEFIERYFESFPGVKRYMENIVQEAKQKGYVTTLLHRRRYLPDITSRNFNVRSFAE
dbj|BAF33373.1|        QKEAKRFIESYFEKFPGVKRYMDEIVKQARERGYVTTLMNRRRYLPDIHSRNYQLRSFAE
RAAC01937              QKEAKRFIESYFEKFPGVKRYMDEIVKQARERGYVTTLMNRRRYLPDIHSRNYQLRSFAE
                       :*  *  * :::**:*:*:*:  :*****:: ** *:::***** ref|YP_001126744.1|    RTAMNTPIQGSAADIIKKAMIDLAARLKEEQLQARLLLQVHDELILEAPKEEIERLCELV
gb|AAB52611.1|         RTAMNTPIQGSAADIIKKAMIDLAARLKEEQLQARLLLQVHDELILEAPKEEIERLCELV
sp|P52026|DPO1_BACST   RTAMNTPIQGSAADIIKKAMIDLSVRLREERLQARLLLQVHDELILEAPKEEIERLCRLV
gb|ABM97416.1|         RMAMNTPIQGSAADIIKKAMIDLNARLKEERLQARLLLQVHDELILEAPKEEMERLCRLV
dbj|BAF33373.1|        RTAMNTPIQGSAADLIKLAMVRIDRAMRDAQMDARMLLQVHDELIFECPKDELAALEVLV
RAAC01937              RTAMNTPIQGSAADLIKLAMVRIDRAMRDAQMDARMLLQVHDELIFECPKDELAALEVLV
                       * ************:** ** :   :::: ::***:*********:**:* * ** :

ref|YP_001126744.1|    PEVMEQAVTLRVPLKVDYHYGPTWYDAK
gb|AAB52611.1|         PEVMEQAVTLRVPLKVDYHYGPTWYDAK
sp|P52026|DPO1_BACST   PEVMEQAVTLRVPLKVDYHYGPTWYDAK
gb|ABM97416.1|         PEVMEQAVTLRVPLKVDYHYGPTWYDAK
dbj|BAF33373.1|        RDNMENAMTLSVPLKVDTAYGPTWYDAK
RAAC01937              RDNMENAMTLSVPLKVDTAYGPTWYDAK
                       : **:*:** ****** *********
```

FIG. 90

```
ref|ZP_00651175.1|      -----AHRIALDPNNVQATHLSRVAGVARFAYNWALAEWRHQYEACTLDSALPKPSQHSL
gb|ACA11657.1|          -----AHRIALDPNNVQATHLSRVAGVARFAYNWALAEWRHQYEACTLDSALPKPSQHSL
ref|YP_001681573.1|     MKINRAYRYELKPNVAQRILLAQHAGTARFAYNWGLARRITLYEAEKKS-----TNAIAQ
RAAC01372               MKIHRAYRYELAPNRMQRVMLAKHAGVARFAYNWGLARRIALHEEAGQS-----TNAIEQ
ref|YP_473713.1|        ------------NNRQKTLAAQHAGVARHAYNWGLAICKQAVESKQKL-----PTAIDL
ref|YP_475384.1|        ------------NNRQKTLAAQHAGVARHAYNWGLAICKQAVESKQKL-----PTAIDL
                                  ::  **.**.****.**     *         ..

ref|ZP_00651175.1|      RRQLNAIKREQFPWMGEVTKNAPQMAIIQLGQAFQNFFAG-----RAKYPKFRKKGAHDR
gb|ACA11657.1|          RRQLNAIKREQFPWMGEVTKNAPQMAIIQLGQAFQNFFTG-----RAKYPKFRKKGAHDR
ref|YP_001681573.1|     HRELNQLKQTEFPWMYEVSKCAPQEALRDLDKAFKNFFRGLKLGQKVGFPRFKKKGQDDS
RAAC01372               HRELNRLKKTDFPWMYEVSKCAPQEALRDLDRAFQHFFRGLNEGRKVGFPRFKKKGRDDS
ref|YP_473713.1|        HKRLVAEVKKENPWYYQVSKCAPQQALRNLECAFKRWRSG-----LGKFPRFKRKGVRDS
ref|YP_475384.1|        HKRLVAEVKKENPWYYQVSKCAPQQALRNLECAFKRWRSG-----LGKFPRFKRKGVRDS
                        ::.*     : :** :*:* ***  *: :* :**:..  *         :*:*::*** * ref|ZP_00651175.1|      FTLTNDQFDLDASRIRIPRLGWVRMRETLRFAGRIMSATVSRVAARWFVSITVDVPDPSH
gb|ACA11657.1|          FTLTNDQFDLNASRIRIPRLGWVRMRETLRFAGRIMSATVSRVAARWFVSITVDVPDPSH
ref|YP_001681573.1|     FRLT-GAIKVNGKAVQLPRLGVIRLKEEPWIRGRILSATVSREADRWFVSLACEVEIPDP
RAAC01372               FRLT-GSIRVLDNAVQLPRLGRIRLKEKPYVEGRILSATVKREADRWYVSLATETEIPDP
ref|YP_473713.1|        FYLE-CSIRISGDRIKVPILGWLRCAELLPTA-TPKNVVISLRAGHWYVSFKYEAPAP-Q
ref|YP_475384.1|        FYLE-GSIRISGDRTKVPTLGWLRCAELLPTA-TPKNVVISLRAGHWYVSFKYEAPAP-Q
                        * *    .  :  .   ::* ** :*   *       ..:.  * :*:**:  :.  * ref|ZP_00651175.1|      LPQAENQGVVGVDLGVLALATLSTGETICGPRPHRALLGRVRRLSRSVSRKVKDSANRHK
gb|ACA11657.1|          LPQAENQGAVGVDLGVLALATLSTGETICGPRPHRALLGRVRRLSRSVSRKVKDSANRHK
ref|YP_001681573.1|     APVLGP--IVGIDVGLNHFAVLSDGTKVEAPKPLDKFLKRLRRLSKKHSRKQKGSTNRKK
RAAC01372               VPPSGE--PVGVDLGVSWFLTLSDGTKIKAPKPLRRYLRRLERLSKRHSRKKPGSRNRRK
ref|YP_473713.1|        VEKTGE--VVGVDLGINRLATCSDGEVFENPKPYYKAKKRLARLQRRLSRKQKGSANRKK
ref|YP_475384.1|        VEKTGE--VVGVDLGINRLATCSDGEVFENPKPYYKAKKRLARLQRRLSRKQKGSANRKK
                          **:*:*:    :  .  * * .   *:*    *: . * .* *.*:* ref|ZP_00651175.1|      AKATLAHLHARIAAIRLDALHKLTSDLTRRFHTIGIENLNVKGMVKNRHLARSIADMGFF
gb|ACA11657.1|          AKATLAHLHARIAATRLDALHKLTSDLTRRFHTIGTENLNVKGMVKNRHLARSIADMGFF
ref|YP_001681573.1|     SALALARLHRRIRNIRQDFTHKLTTNLAKTKSEIVMEDINVRGMMRNCSLARHIADVGWG
RAAC01372               SALALARLHRKIRNIRQDFLHKVTTELAKTKRAIVMEDLHVRGMVQNRALARAISDMGFG
ref|YP_473713.1|        AVAQLAKAHKRVADIRQDNLHKLTTYLAKKYRVVVIEDLQVKNLLKNHKLAGALSDCGFY
ref|YP_475384.1|        AVAQLAKAHKRVAGIRQDNLHKLTTYLAKKYRVVVIEDLQVKNLLKNHKLAGALSDCGFY
                        :   **: *  ::   **  *  ***:*:   *::         : :*:*:*:..::::::* ** :: *:

ref|ZP_00651175.1|      EFRRQLEYKAAMRGGQVVVADRFFASSKMCSTCGHTLKELPLSVRQWACLGCGTRHDRDV
gb|ACA11657.1|          EFRRQLEYKAAMRGGQVVVADRFFASSKMCSTCGHTLKELPLSVRQWACLGCGTRHDRDV
ref|YP_001681573.1|     EFRRQLGYKTAWYGSKLTLVHRFYPSSKTCSACGYVREELPLSVREWDCPSCGVHHDRDH
RAAC01372               EFRRMLTYKCAWYGSELIIAPRFYASSKTCSACGYVISELPLSVREWTCPACSTRHDRDI
ref|YP_473713.1|        EFRRQLEYKARLYGCQVVVADRFYPSSQLCSRCCHR-QKMPLQFRMFCCPCCGLELDRDL
ref|YP_475384.1|        EFRRQLEYKARLYGCQVVVADRFYPSSQLCSRCCHR-QKMPLQERMFCCPCCGLELDRDL
                        ****  *  **    *  ::  :.:   :   .::**. *  *   .  *** ref|ZP_00651175.1|      NAAVNLKNMA--VSSTVS--ACGEEGTG-----
gb|ACA11657.1|          NAAVNLKNMA--VSSTVS--ACGEEGTG-----
ref|YP_001681573.1|     NAAKNL---------------------------
RAAC01372               NAAKNLLRIG--TASSAGSDACGDPSGGAALGC
ref|YP_473713.1|        NAALNLLRWYRTTSSSGGSDACGDPSGG-----
ref|YP_475384.1|        NAALNLLRWYRTTSSSGGSDACGDPSGG-----
                        *** **
```

FIG. 91

```
ref|ZP_01695687.1|    ---------------VGPSQLLSKLCDEIELEKTINDLVKWDSVRCHISPGTRIKALVLN
ref|ZP_01695982.1|    ---------------VGPSQLLSKLCDEIELEKTINDLVKWDSVRCHISPGTRIKALVLN
ref|ZP_01695971.1|    ---------------VGPSQLLSKLCDEIELEKTINNLVKWDSVRCHISPGTRIKALVLN
ref|ZP_01695655.1|    -------------------PQSCKLCDEIELEKTINNLVKWDSVRCHISPGTRIKALVLN
ref|YP_430569.1|      ----------MRFFRAGPAALISRLCDVLKIAEIIDAVVDWDPAQCHLSPGNRVKALIIN
RAAC00062             MREAFQLFGPVRSYVMGPAPVLARLIDELKWVEIIDEFVPRP--DSKLSVGLRTKALLVN
                                   .:*  *  ::    :  *: .*      .::*  *  * ***::* ref|ZP_01695687.1|    ILCSGKPLYKVHEFYQNLDSEMLF--DTSVSPDQLNDDALGRALDYLYEA-EAWKVYSTL
ref|ZP_01695982.1|    ILCSGKPLYKVHEFYQNLDSEMLF--DTSVSPDQLNDDALGRALDYLYEA-EAWKVYSTL
ref|ZP_01695971.1|    ILCSGKPLYKVHEFYQNLDSEMLF--DTSISPDQLNDDALGRALDYLYKA-EAWKVYSTL
ref|ZP_01695655.1|    ILCSGKPLYKVHEFYQNLDSEMLF--DTSISPDQLNDDALGRALDYLYKA-EAWKVYSTL
ref|YP_430569.1|      LLVDREALYHVERFYENQDLEVLFGAEQQVRPEDFNDDALGRALDKLFTSGQLKKLFSSI
RAAC00062             IGTNREALYRVEEFYAQRDVEVLLG--SGVSADDLHDDALARALDALYDA-GLEALYARI
                      :   . :.**:*..**  : * *:*:    .:::****.**** *:     :::  :

ref|ZP_01695687.1|    ALKTLKKLNLP-----IGILHNDTTSISVYGEYKQPKEDGLQITYGYSKAHRPDLKQIVL
ref|ZP_01695982.1|    ALKALKKLNLP-----IGILHNDTTSISVYGEYKQPKEDGLQITYGYSKAHRPDLKQIVL
ref|ZP_01695971.1|    ALKALKKLNLP-----IGVLHNDTTSISVYGEYKQPKEDGLQITYGYSKAHRPDLKQIVL
ref|ZP_01695655.1|    ALKALKKLNLP-----IGVLHNDTTSISVYGEYKQPKEDGLQITYGYSKAHRPDLKQIVL
ref|YP_430569.1|      ALTAAATHNVS-----IAGIHVDTTSISVQGAYDG--EGDLDITFGFSKDHRPDLKQFLI
RAAC00062             ALHTLRRLRVLSDSNELIPIHADTTSLSMTGEYLD--QTAFRIDRGFSKDHRPDLKQIVF
                      **  :     .:        :  * ****:*: *  *    :  * *:** *******:::

ref|ZP_01695687.1|    GMGVTPERIPILAKVENGNTSDKSWNVEFIQKMRKILSHEDWKNLIYQADSALITTENLA
ref|ZP_01695982.1|    GMGVTPERIPILAKVENGNTSDKSWNVEFIQKMRKILSHEDWKNLIYQADSALITTENLA
ref|ZP_01695971.1|    GMGVTPERIPILAKVENGNTSDKSWNVEFIQKMRKILSHEDWKNLIYQADSALITTENLA
ref|ZP_01695655.1|    GMGVTPERIPILAKVENGNTSDKSWNVEFIQKMRKILSHEDWKNLIYQADSALITTENLA
ref|YP_430569.1|      GLTVNRDGLPILAQSLDGNSSDKSWYPQVIEELVQTFKPEKLKEVIFVADCALVTKDNLA
RAAC00062             GL-CTVHGLGLCANVNPGNLDDHTWNFENIQQLLSQLDEETRKRSVYVADAALVTKDNLE
                      *:    .  .  : *:   **  .*:*    * *::     . :. *   *:   ::  **.**:*.:**

ref|ZP_01695687.1|    EIQQQN-----LSFISRLPDTFGLSTELKKEAWLLNN-WERVGSLSNKKDAAIYQIQAFE
ref|ZP_01695982.1|    EIQQQN-----LSFISRLPDTFGLSTELKKEAWLLNN-WERVGSLSNKKDAAIYQIQAFE
ref|ZP_01695971.1|    EIQQQN-----LSFISRLPDTFGLSTELKKEAWLLNN-WERVGSLSNKKDAAIYQIQAFE
ref|ZP_01695655.1|    EIQQQN-----LSFISRLPDTFGLSTELKKEAWLLNN-WERVGSLSNKKDAAIYQIQAFE
ref|YP_430569.1|      LLVQEEGNKPALQFISLLPENFGLNKEIKAEAFRTGT-WQEIGKLSPKKDAACYKSQSFV
RAAC00062             LLAEED------FHFISRLPGTYKLSEDLKRAAWEKENSWKEVGRLAEAEDSAHYRIQAFR
                      : :::       : *   .: *. ::*  *:     . *::* *:   :*:* *:* *:* ref|ZP_01695687.1|    RQIQNLPYRFLVVHSNNLDQRKEKTLNRAIEKEEIQLKKEIEKLSKVIFHCKEDALEAIQ
ref|ZP_01695982.1|    RQIQNLPYRFLVVHSNNLDQRKEKTLNRAIEKEEIQLKKEIEKLSKVIFHCKEDALEAIQ
ref|ZP_01695971.1|    RQIQNLPYRFLVVHSNNLDQRKEKTLNRAIEKEEIKLKKEIEKLSKVIFHCKEDALEAIQ
ref|ZP_01695655.1|    RQIQNLPYRFLVVHSNNLDQRKEKTLNRAIEKEEIQLKKEIEKLSRVIFHCKEDALEAIQ
ref|YP_430569.1|      REIDGRDYRLIVVTTLDKRKENSLLKKWAKQREVLEKAAKDLSRRPFACKADARKAIE
RAAC00062             RTLYGRTYRFVVVRSSSLDTRKERKLKEVLKREKAALEKAAKAMSQNVYSCEQDAQMAMQ
                      *  :     **::**:*..** ***..*        ::.    *:*   :*:   *: **  *::

ref|ZP_01695687.1|    SFKKKQKASYFCYKLNVQMSDQPIKRKKRGRPKKDEQTK-REQIYQIQLESFEKDHDFIE
ref|ZP_01695982.1|    SFKKKQKASYFCYKLNVQMSDQPIKRKKRGRPKKDEQTK-REQIYQIQLESFEKDHDFIE
ref|ZP_01695971.1|    SFKKKQKASYFCYKLNVQMSDQPIKRKKRGRPKKDEQTK-REQIYQIQLESFEKDHDFIE
ref|ZP_01695655.1|    SFKKKQKASYFCYKLNVQMSDQPIKRKKRGRPKKDEQTK-REQIYQIQLESFEKDHDFIE
ref|YP_430569.1|      LFLREYR-----------------------------------------------------
RAAC00062             TFMHEHRATLHPISARICAEQVQAKRARRGRPRKDDPPPPVHTQYRVEVAILPPSEERVQ
                      * ::  :

ref|ZP_01695687.1|    NKKKMLSTFVLITNKLDEETLSNQEVLRVYKGQSAAETRFRLIKDSQMIDAIYLKTPERV
ref|ZP_01695982.1|    NKKKMLSTFVLITNKLDEETLSNQEVLRVYKGQSAAETRFRLIKDSQMIDAIYLKTPERV
ref|ZP_01695971.1|    NKKRMLSTFVLITNKLDEETLSNQEVLRVYKGQSAVETRFRLIKDSQMIDAIYLKTPERV
ref|ZP_01695655.1|    NKKKMLSTFVLITNKLDEETLSNQEVLRVYKGQSAAETRFRLIKDSQMIDAIYLKTPERV
ref|YP_430569.1|      ------------------------------------------------------------
RAAC00062             QWREKEATFVLITDIRDDQRVSDEQILRLYKEQHEVEARFRYLKSPYHVGPIYLHKPTRV
``` continued →

FIG. 91 continued

```
ref|ZP_01695687.1|    EALGIVYVMALLIYGILEYRVRKELKEKNLSLILKGKRKLYQPTGQALLEQLEDITVILI
ref|ZP_01695982.1|    EALGIVYVMALLIYGILEYRVRKELKEKNLSLILKGKRKLSQPTGQALLEQLEDITVILI
ref|ZP_01695971.1|    EALGIVYVMALLIYGILEYRVRKELKEKNLSLILKGKRKLYQPTGQALLEQLEDITVILI
ref|ZP_01695655.1|    EALGIVYVMALLIYGILEYRVRKELKEKNLSLILKGKRKLYQPTGQALLEQLEDITVILI
ref|YP_430569.1|      ------------------------------------------------------------
RAAC00062             KAFGFVMLLSLLLYSVLEYLIREKMKRETEPLMLPGNRKSFRPTGLAILEMLDGVTTVHM ref|ZP_01695687.1|    NQNQQKIRLLPDNIDSQAKKIIELCGYDLSIY-------
ref|ZP_01695982.1|    NQNQQKIRLLPDNIDSQAKKIIELCGYDLSIY-------
ref|ZP_01695971.1|    NQNRQKLRLLPDNIDSQAKKIIELCGYDLSIY-------
ref|ZP_01695655.1|    NQNRQKLRLLPDNIDSQAKKIIELCGYDLSIY-------
ref|YP_430569.1|      ---------------------------------------
RAAC00062             QVGDTWQRVPATPHNPQIMRVLKLLNMDLSIYTEAQKTA
```

FIG. 92

```
ref|ZP_01665148.1|    ------------------------------------------------------------
RAAC02377             ------------------------------------------------------------
ref|YP_754667.1|      ------------------------------------------------------------
ref|YP_753226.1|      EFYPHYPTHETICALPRTEINSWLSYNTRPHMNASWLFEISUBSPWLFEISTRGETTING
ref|YP_752864.1|      ------------------------------------------------------------
ref|YP_001111903.1|   ------------------------------------------------------------ ref|ZP_01665148.1|    ------------------------------------------------------------
RAAC02377             ------------------------------------------------------------
ref|YP_754667.1|      ------------------------------------------------------------
ref|YP_753226.1|      ENGBABIHYPTHETICALPRTEINSWLSYNTRPHMNASWLFEISUBSPWLFEISTRGETT
ref|YP_752864.1|      ------------------------------------------------------------
ref|YP_001111903.1|   ------------------------------------------------------------ ref|ZP_01665148.1|    ------------------------------------------------------------
RAAC02377             ------------------------------------------------------------
ref|YP_754667.1|      ------------------------------------------------------------
ref|YP_753226.1|      INGENGBABIHYPTHETICALPRTEINSWLSYNTRPHMNASWLFEISUBSPWLFEISTRG
ref|YP_752864.1|      ------------------------------------------------------------
ref|YP_001111903.1|   ------------------------------------------------------------ ref|ZP_01665148.1|    ------------------------------------------------------------
RAAC02377             ------------------------------------------------------------
ref|YP_754667.1|      ------------------------------------------------------------
ref|YP_753226.1|      ETTINGENGBABIHYPTHETICALPRTEINSWLSYNTRPHMNASWLFEISUBSPWLFEIS
ref|YP_752864.1|      ------------------------------------------------------------
ref|YP_001111903.1|   ------------------------------------------------------------ ref|ZP_01665148.1|    ------------------------------------------------------------
RAAC02377             ------------------------------------------------------------
ref|YP_754667.1|      ------------------------------------------------------------
ref|YP_753226.1|      TRGETTINGENGBABIHYPTHETICALPRTEINSWLSYNTRPHMNASWLFEISUBSPWLF
ref|YP_752864.1|      ------------------------------------------------------------
ref|YP_001111903.1|   ------------------------------------------------------------ ref|ZP_01665148.1|    --------------------EAXTRANSPSASEISFAMILYPRTEINTHERMSINUSCA
RAAC02377             ------------------------------------------------------------
ref|YP_754667.1|      ------------------------------------------------------------
ref|YP_753226.1|      EISTRGETTINGENGBABIHYPTHETICALPRTEINSWLSYNTRPHMNASWLFEISUBSP
ref|YP_752864.1|      ------------------------------------------------------------
ref|YP_001111903.1|   ------------------------------------------------------------ ref|ZP_01665148.1|    RBXYDIVRANSNRGBEAX---------TRANSPSASEISFAMILYPRTEINTHERMSINU
RAAC02377             ------------------------------------------------------------
ref|YP_754667.1|      ------------------------------------------------------------
ref|YP_753226.1|      WLFEISTRGETTINGENGBABIHYPTHETICALPRTEINSWLSYNTRPHMNASWLFEISU
ref|YP_752864.1|      ------------------------------------------------------------
ref|YP_001111903.1|   ------------------------------------------------------------ ref|ZP_01665148.1|    ----SCARBXYDIVRANSNRSCRESIGNIFICANCEE-IDENTITIESPSITIVESG-AP
RAAC02377             -----------------------------------------------------------M
ref|YP_754667.1|      ------------------------------------------------------------
ref|YP_753226.1|      BSPWLFEISTRGETTINGENSCRESIGNIFICANCEE-IDENTITIESPSITIVESGAPS
ref|YP_752864.1|      ------------------------------------------------------------
ref|YP_001111903.1|   ------------------------------------------------------------
``` continued →

FIG. 92 continued

```
ref|ZP_01665148.1|      SMDMGYDAKDVYQAAY-ERQAQAIIPLNRRKEKLPPEGMDENRTPTCSMGYPMVYWGCER
RAAC02377               LMDAGYDQTKNYEAAR-ALGAQAIIPMNRRNEKEPPEGMDFDGTPRCTMGYRMTYWGAEG
ref|YP_754667.1|        LMDAGYDHREIYSVIRDKYHAQAIIALNKRGAKQPPEGFDWDGTPICSARYRMVYWGS--
ref|YP_753226.1|        LMDAGYDHREIYSVIRDKYHAQAIIALNKRGAKQPPEGFDWDGTPICSARYRMVYWGS--
ref|YP_752864.1|        LMDAGYDQKSIYELIRKDYKAQAIIPLNHRGAKEPPEGLDWDATPICSAGYRMAYWGG--
ref|YP_001111903.1|     -MDMGYDSKDIYSVVMNDFNAQAIIPINSRGSKDHPEGCDFDGTPICSMGQRMVFWGSDA
                         ** ***    . *.          *****.:*  *  *  *** *   : ** *:    *.:**

ref|ZP_01665148.1|      EKGILKFRCPHVCGKVNCPNGSAWCSPSNYGLVIKKKVEDDPRSFCTPHRGTREWEKLYA
RAAC02377               D--WLKFRCPHATGQVDCPLGMAACSASNYGMVVKKRLDEDVRRYANPHRGSRTWKMLYD
ref|YP_754667.1|        YQGVNKFRCPHIMGKCDCPFGSAWCSDSNYGMVVKTKVKDDPRLFSSPHRGSANWQKQYN
ref|YP_753226.1|        YQGVNKFRCPHIMGKCDCPFGSAWCSDSNYGMVVKTKVKDDPRLFSSPHRGSANWQKQYN
ref|YP_752864.1|        SNGVNKFRCPHVMGKCDCPFGSSWCSDSNYGMVVKTRARQDSRLFIVPHRGTSNWKLLYN
ref|YP_001111903.1|     KAGTNKYRCPHVMGKCDCPYGSAWCSPSSYGLVVKTKVKDDPRMNCIPARGTKNWQSLYN
                         *:****  *: :** *  : ** *.**:*:*.:   :*  *     * **:  *:  * ref|ZP_01665148.1|      ERTSVERAFSRLKEQLGANT-VRVQGIKKVTAHLMLCCIALLAGTIAVNR--------
RAAC02377               ERTAVERCFARLKEWLTLDG-VHVRGIEKVTAHAYINASVLLASALAMHRTNRIEQVA
ref|YP_754667.1|        LRTYSERCFSRFKENLGLEDGLNVRKITKVETHAYLCAITMIAAVIAINQ--------
ref|YP_753226.1|        LRTYSERCFSRFKENLGLEDGLNVRKITKVETHAYLCAITMIAAVIAINQ--------
ref|YP_752864.1|        KRTSVERCFGRLKEHLGLETGLNVRGIKKVKTHAYLSVITMIASVIAINKDKSSTDIA
ref|YP_001111903.1|     KRTSVERCFGRLKQHLGANS-IRTRGLEKVTLHITLSCIALLAGSIAVAKTKRIEQAA
                         **  **.*.*:*:.*   :    :...:   :  **    *   :  .::*. :*: :
```

FIG. 93

```
ref|YP_754865.1|       ANCEE-IDENTITIESPSITIVESGAPSEEQYRLSRQKQFGTSSEKTTPEQIN-------
ref|YP_754943.1|       ----------------------------EEQFRLSRQKQFGASSEKTTPEQIN-------
ref|YP_431166.1|       ------------------------------------------------------------
RAAC03117              --------------------------MEEQIHLLRHRLFGTSSEKRRKPQTDPDSIQLP
ref|ZP_02171171.1|     -----------------------------MQKKKFGTSSEKTDERFEQGS-----
ref|YP_001318017.1|    ----------------------------EEQFRLSQAQKYGSSSEKTDPDQMS------- ref|YP_754865.1|       LFNEAEDIVDPEIKEPDIE-------------TITYERKKKQPGQKADKLKDL--PVEVI
ref|YP_754943.1|       LFNEAEDITDPKLEEPSLE-------------TVTYQRKKKQAGQREDKLKDL--PVEII
ref|YP_431166.1|       ------------------------------------------------------------
RAAC03117              LFNEAEVEADAQASEETVEGNAEATSEGVTETETITYERRKPRAARERDAWLYQGEADEVV
ref|ZP_02171171.1|     LFNESEKEQDAAEEEPTVE-------------AITYERKKKRKARKD---LTENLYTETV
ref|YP_001318017.1|    IFNEAEKFSVKLDEEPEAE-----------EVLTKRRTGKSKSKKK----YEDLPIEEV ref|YP_754865.1|       EYRLLEHEQVCPCCQGSLHEMSTQIRQEIKVIPAQVKVVQHVQYIYSCRQCEKENITT--
ref|YP_754943.1|       EYRLEKHEQICPCCQGELHEMSIQVRHEIKIIPAQAISVKHVQYIYACRRCEKENITT--
ref|YP_431166.1|       -------------------MSTEVRQELKIIPAQVKVVKHIRYVYACRHCEREELTT--
RAAC03117              EYRLSDDERVCSKCAGELHEMSREITRRVKIIPAQMKKVEYVRYVYTCRHCEAQDVET--
ref|ZP_02171171.1|     TYTLPVEDQVCSCCNGELHIMKTQVKDELEIIPAEVKVKRYETTIYSCRHCERTGTRN--
ref|YP_001318017.1|    HYTLSDEERQCPKCDHTLHEMKTEVRKELKIIPAQVKVVHHIKQVYACRGCDAIDSDNGG
                                          *.  ::  .:::***:   .:    :*:** *:    .

ref|YP_754865.1|       PIIKAQMPNPILPGSLASPSILAYIMDQKYTNSMPLYRQEQQLSRLGIELSRQTMANWVL
ref|YP_754943.1|       PIIKAEMPKPILPGSLASPSILAYIMDQKYTNSLPLYRQEQQFSRLGIELSRQTMANWLL
ref|YP_431166.1|       PVVTAPMPAPVLPGSPVSPLLAYVMHQKYGEGLPLYRQEQQFKSLGLELSRQTLANWVL
RAAC03117              PVVRAPMPKPVQAKSLATPEAVAYVMAKKFVDGMPLYRQEQQFARHGYPLSRQTLANWVV
ref|ZP_02171171.1|     PIVKAPSPERPFPGSLASPSIVSYMINQKFVQGVPLYRQEQEFKRMDVPISRQTMSNWII
ref|YP_001318017.1|    TIITAPMPKPVLPGSMVSPSVLAFIMENKYNQALPLYRQEASFVNYGIDLSRQNMASWII
                       .:: *   *       . * .:*.  :::: :*: :.:****** .:    :***.::.*::

ref|YP_754865.1|       NVADPWLKIIYDRLHVELLDRDILHADETTLQVLKEPGRSAETKSYMWLYRTGRD-GPPI
ref|YP_754943.1|       AAADPWLKIIYDRLHEQLLEKDILHADETTLQVLKEPGRRAESKSYMWLYRTGRD-GPPI
ref|YP_431166.1|       HGANTWLTHIYDRLHEYLLKRDILHADETTLQVLREPGREAATKSFLWLYRTGRD-GPSI
RAAC03117              HAAETWLEPLYAKLRQVLLAQRYLHADETTLQVLHEAGRAAQTQSYMWVYRSSMN-GPPL
ref|ZP_02171171.1|     EASEQMLEPIWDLMIRILTSLDVLHADETTVQVLKEDGKEAAAKSYMWLYRSGSH-DVPI
ref|YP_001318017.1|    QGAEKWLSPLYDRMHTHLKQSPVIHADESPLKVLDEKDK---SQSYMWLYATAETSEYPI
                       ::   *  ::   :   *      :****:.::** * .:    ::*::*:* :.    .:

ref|YP_754865.1|       VLYEYQTTRASKHPDRFLSGFKGYLQTDGYSAYGKLT-GITLVGCWAHARRKFTEALKAL
ref|YP_754943.1|       VLYDYQTTRASKHPDSFLSGFKGYLQTDGYSGYGSLT-SVTLAGCWAHARRKFTEALKAL
ref|YP_431166.1|       VLYDYQTTRASKHPCRFLAGFKGYLHVDGYAGYNELP-DVTLVGCWAHARRKFDEALKAL
RAAC03117              VLYDYQETRSAEHPRRFLAGFQGYLHVDGYAGYEGLP-DVTLVGCWAHARRKFDEALKAV
ref|ZP_02171171.1|     VIYDYQPGRASKYPRRFLEGFTGYLHVDGYGGYHALKPKVELVGCWAHARRKFFDAVQTL
ref|YP_001318017.1|    YLYEYQPSRAKKHPKQFLEGFTGFLQTDGYAGYNGVE-NVVQVGCLAHARRKYTDAIKAL
                       :*:** *: ::*  ** ** *:*:.*..**  :        .** ******: :*::::

ref|YP_754865.1|       PAAQKDKPVAASVGLEYCNRLFAIERQLKD--VSDKERYDKRLEKSKPLLDEFYIWLKKQ
ref|YP_754943.1|       PAEQKDKPVAASIGLGYCNKLFAIERQLKD--MSCQERYEKRLELTRPLLNEFYAWLKRQ
ref|YP_431166.1|       PEDKRNAAVAAREGLEFCNRLFTIERDLKD--KTPEERYQLRQVRSKPVLDAFLAWLKTQ
RAAC03117              PSKERKGKTAAEEGLSYCNALYAVEKKLKN--ASAEERQRVRMAKSKPILDAFLAWLEKQ
ref|ZP_02171171.1|     PDDRDSTTSAAKKGLNAIDELYRIEREIQNEYKTPEEFYEARKERIEPPLEAFSAWVESM
ref|YP_001318017.1|    PEGSDVSLTKANEGLSLLRKIYRLEKSFKE--MEPEVRYEARIEQTQPVLDAYKTWLEVE
                       *       *  **  ::  :*:.::::       :    *    .* *:  : *::

ref|YP_754865.1|       KQQTLPKSTFGQAITYCLNQWDCLNSFLLDGRLEIDNNRAERSIKPFVIGRKNWLFTNTP
ref|YP_754943.1|       RQQTLPKSMFGQAITYCLNQWDALNTFLLDGRLEIDNNRAERSIKPFVIGRKNFLFSNTP
ref|YP_431166.1|       KSRVLPKSSFGQAINYCLGQWDKLTAFLQDGRLELDNNRSERSIKPFVIGRKNWLFANTP
RAAC03117              EQQVLPKSALGRAVSYVLKQWPKLIRYVENGYLEIDNNRCERSLKPFVIGRKNWLFANTP
ref|ZP_02171171.1|     KPKILSKSLLGKAVIYASNQMEHLRTFLKQWDKLAAFMKDGRIAIDNNLAERGIKPFVIGRKNWIFSNTP
ref|YP_001318017.1|    EKRTLPKSKLGQAIYSYSLKQWDKLAAFMKDGRIAIDNNLAERGIKPFVLGRKNYLFAKSP
                       . : *.**  *:*:*: *      *     :: :*  :*** .**.:****:****::*:::*
``` continued →

FIG. 93 continued

```
ref|YP_754865.1|       RGARGSAIIYSVIETAKENNLKPYNYMFYLFEQLPNVDTGDQAAIDRLLPWSDTLPE---
ref|YP_754943.1|       RGARGSAIIYSIIETAKENNLKPYDYLVYLFEQLPNVDTSDQTAVDRLMPWSDTLPEGCR
ref|YP_431166.1|       RGAKASAITYSIIETAKDNGLNPFQYLIYLFERLPNLDLKDKDALDQLLPWSASLP----
RAAC03117              RGARASAVTYSIVETAKENGLNPTAYLTYLFERMPNIDLKDEAAFEALLPWSEGLPEGIR
ref|ZP_02171171.1|     RGAKSSSIIYSMIETAKENQLKPQAYLNYLFENLP---SSKQSEMEQFLPWSDSLPRMIF
ref|YP_001318017.1|    KGATASALCYSIIETAKANKLIPFQYLTYLFEQLPNLDIEDPEALDAMLPWAESLPNEVR
                       :**  .*::  **::****  *   *   *:  ****.:*       .   .:  ::;**:   **

ref|YP_754865.1|       ---
ref|YP_754943.1|       I--
ref|YP_431166.1|       ---
RAAC03117              VRK
ref|ZP_02171171.1|     V--
ref|YP_001318017.1|    ---
```

FIG. 94

```
ref|NP_780819.1|        ----IQIFQNYSVFIVLGLIIATIILFFIVVQAKAINRLEKRYRKFMRGVDNKNLEELI
ref|YP_699899.1|        ----LNILTQYSTYITIGLIVLVLIQFILLIVALRSLSKVENKFRKIMRGVNNKNLEELI
ref|YP_001514390.1|     MAFITNILEEYRDILFIASLGLNILTIIFLIINMGISSNLKEKYRKLVRGTDGKQIESIL
ref|YP_077153.1|        ------LLQQDPLLVAFTALGFCIVAIVIMLIVLVRQSILLRRYRSLLRGNTNASLEDLL
RAAC00037               MAMGLSILQPYALDIALFSGILAIICLVIASVALSRSARLKRKFNRLKEVTSAADLERVF
ref|YP_001663996.1|     ----LDIISQNATLIILFLSVLSIIELIFILIINGKFLRLNRTYNKIIKTLEKGDVFDIF
                           ::      : :    :: :.:  :     :  . :. :  .    .: ::

ref|NP_780819.1|        NTYLDKVDKASEECQYAKELYKSLEDRLNICVQKIAIIRYRAFEDVGSDLSFSVALLDYK
ref|YP_699899.1|        NSYLDKVEEVKKDSEETLETNKMLKAQIEKCTQKVSVIRYKAFEDVGSDLSFSVALLDGE
ref|YP_001514390.1|     FEHLDKIEDVHQRLNQFEGKLEIFNNRLSFCVQRVGIIRYNAFDDTGSDLSYSIALLDEN
ref|YP_077153.1|        IQQQQATADLRAAQESIRRRLSDLESASQKYLQRIGIVRYNAFPDVGADLSFSCALLDGE
RAAC00037               EETKDAVRKLEMKLREAEEHLRIVEEALQSKVSTPAILRYNAFAEVGSDLSYSVALIDGK
ref|YP_001663996.1|     SRILTENEEIKNKLDKLRMDLNSLCKETKTAIKKVGIVRYNAFSDVGSDLSFSIALLDSN
                                              .      ..  .  .:;**.**..*;***;* **;*  :

ref|NP_780819.1|        DSGIIITGIYGRNESTTYAKPIDKGISRYELSEEE----NHVLKEAM---------
ref|YP_699899.1|        NNGVILTGIYGRDYSTTYAKPIDKGISRYDLSEFE----LHVLNAAM---------
ref|YP_001514390.1|     NDGIIITGIYGRIETVSYAKPVKNGVSNYSLSVEE----LQALERA----------
ref|YP_077153.1|        DNGVVVTSLYGRSECRTYAKPIRGGSSSYALTDEE----KQALRLA----------
RAAC00037               GDGVVITSIYGREDSVTYGKPVQGGDSPYMLTEEERAVIEEALRGAPRRRTTAQIS
ref|YP_001663996.1|     DNGTVLSGIYGRNETATFAKPIERGQSKYPLSAEE----VQAIERAKRKA------
                        ..*::::.:***       ::.**:   * * *:  **    ..:. *
```

FIG. 95

```
ref|NP_387885.1|         MYIQNLELTSYRNYDHAELQFENKVNVIIGENAQGKTNLMEAIYVLSMAKSHRTSNDKEL
ref|YP_001419683.1|      MYIQNLELTSYRNYERAELQFENKVNVIIGENAQGKTNLMEAIYVLSMAKSHRTSNDKEL
ref|YP_077286.1|         MYIQNLTLSSYRNYERLDLQFENKVNVIIGENAQGKTNLMEAIYVLAMAKSHRTSNDKEL
ref|ZP_02326643.1|       MFLQRLTLHHYRNYQHVELVTDRNVNIFVGPNAQGKTNLLESIYVLALTKSHRTHHDKEL
ref|YP_803557.1|         MYLKTLELHNFRNYADLVVEFGSGINVLLGENAQGKTNLLESIYFLALTRSHRTNSDRDL
RAAC00054                MDIRRVELHDFRNYAKAEIELSPGVNVLVGENGQGKTNALEAMLLIAVGKSHRAHRDRDL
                         *  ::   :    *  :        :    *  :::*  *.*****  :*: :  .::: :***:   *::* ref|NP_387885.1|         IRWDKDYAKIEGRVMKQNGAIPMQLVISKKGKKGKVNHIEQQKLSQYVGALNTIMFAPED
ref|YP_001419683.1|      IRWDEDYAKIEGRVMKRNGDIPMQLVISKKGKKGKVNHIEQQKLSQYVGALNTIMFAPED
ref|YP_077286.1|         IRWDEDYAKIEGRVIKKNGSVPIQLVISKKGKKGKVNHIEQQKLSQYVGAVNTIMFAPED
ref|ZP_02326643.1|       IQWEGESALLQGDVEKKYGSYSLDLAISKKGKKAKINGLEQKKLSQFIGALNVVLFAPED
ref|YP_803557.1|         ISWKTKAARVSGSVQKEHTVTPLFINLSSKGKNAKVNHLEQSRLSQYVGQLNVTILFAPED
RAAC00054                IRWEQDRARILLEASTRYGDRRLTLELGPEGRRAFANGVQVGRMIEFVGQVQVVLFAPED
                         * *..*:    .   :.::    :     *::..    *  ::   :::::*  ::.::***** ref|NP_387885.1|         LNLVKGSPQVRRRFLDMEIGQVSPVYLHDLSLYQKILSQRNHFLKQLQ-TRKQTDRTMLD
ref|YP_001419683.1|      LNLVKGSPQVRRRFLDMEIGQVSAVYLYDLSLYQKILSQRNHFLKQLQ-SRKQTDRTMLD
ref|YP_077286.1|         LNLVKGSPQVRRRFLDMEIGQVSPVYLHDLSLYQKILSQRNHFLKQLQ-TRKQTDQTMLD
ref|ZP_02326643.1|       LELIKGNPGIRRRFLDMEIGQVYPGYLYDLSQYQKVLAQRNNMLKKAFPAPSAEHAAMLD
ref|YP_803557.1|         LSIVKCSPAVRRKFIDMEFGQMSSKYLYNSAQYKSVLKQRNQYIKQLQFNPKG-DQVYLD
RAAC00054                LDLVKGSPRVRRRFLDTELGQMEPLYHHLSLYNRALLQRNRWLKTAP----LSPDDDVLA
                         *.::**.*  :**:*:* *:.  .:. :*.  *.***.:*           .     * ref|NP_387885.1|         VLTDQLVEVAAKVVVKRLQFTAQLEKWAQPIHAGISRGLEELTLKYHTALD-VSDPLDLS
ref|YP_001419683.1|      VLTDQLIEAAAKVVAKRLQFTAQLEKWAQPIHSGISRGLEELTLKYHTALD-VSDPKDLS
ref|YP_077286.1|         VLTEQLTEFAAKVVMKRLQFDQLEKWAQPIHSGISRGLEELTLKYHTSLH-VSDSPDLS
ref|ZP_02326643.1|       IWNEQLAQFGVKIMKKRQNFIKKLQNWAEQTHDGHTNGGEELTIRYQPSFA-VQDFEDET
ref|YP_803557.1|         VLSDQLAAHGAEIIFQRIQFLKKLEKWSQEVHKEISQGKEKLSFQYVSPIS-SDQADTTE
RAAC00054                TFDRQIAFHGAHVIHRRLRFLARLRAYAARIYSDIASGREEFALAYRSSVSGVEEGMSVE
                         *:    ...::  :*  .*   :*.    ::      *: *   *:::: *    ... .:

ref|NP_387885.1|         KIGDSYQEAFSKLREKEIERGVTLSGPHRDDVLFYVNGRDVQTYGSQGQQRTTALSLKLA
ref|YP_001419683.1|      KIGNSYQESFSKLKEKEIERGVTLFGPHRDDVLFYVNGRDVQTYGSQGQQRTTALSLKLA
ref|YP_077286.1|         KMTNSYQETFSKLRDKEIERGVSLSGPHRDDVLFYVNGRDVQTYGSQGQQRTTALSLKLA
ref|ZP_02326643.1|       VLMEQFMIKLSQIKDQEIRRGVSLAGPHRDDLLFYINDKEVQTYCSQCQQRTTALSLKLA
ref|YP_803557.1|         KIYAALQALFQKQREKELQCGKTLVGFHLDDVRFMVNDKNVSTFGSGQGQRTTALSVKLA
RAAC00054                EMADTVQRALEKNRAQDLRFGTTSAGPHRDDILLFLDGREVHTAASQGQQRTIALSLRLA
                         :       :. :  : :::  * :    ***  **:   : :. :* * .*******  ***::**

ref|NP_387885.1|         EIDLIHEEIGEYPILLLDDVLSELDDYRQSHLLHTIQGRVQTFVTTSVDGIDHETLRQA
ref|YP_001419683.1|      EIDLIHEEIGEYPILLLDDVLSELDDYRQSHLLHTIQGRVQTFVTTSVDGIDHDTLHQA
ref|YP_077286.1|         EIDLIQEEIGEYPILLLDDVLSELDDYRQSHLLHTTQGRVQTFVTTSVDGIDHKTLNEA
ref|ZP_02326643.1|       EIELIHSEVGEYPILLLDDVLSELDEYRQTQLIQTFQKKVQTFITTTCLESVHLDQLEDA
ref|YP_803557.1|         EIDLMKEETGEYPVLLLDDVLSELDDSRQTHLLTAIQNKVQTFITTTSLSGVAQQLINEP
RAAC00054                EIDFMHEELGEYPVLLLDDVLSELDDLRQRNLVLGMSRKVQTVITTTSLNRLG-QELDDF
                         **:::.:.*  ****.*********** ** :*:  :   :.::**.:***  :: . . :

ref|NP_387885.1|         GMFRVQNGALVK---
ref|YP_001419683.1|      GMFRVENGTLVK---
ref|YP_077286.1|         EIFRVENGTLSD---
ref|ZP_02326643.1|       SVFRV-------
ref|YP_803557.1|         HVFNIDHGVLMQSK-
RAAC00054                RLFRVCSGIIAEERV
                          :*..:
```

FIG. 96

```
gb|AAR99616.1|       --------------------------------------------IKEMYERGMSISDIA
sp|Q45618|TRA6_BACST --------------------------------------------IKEMYERGMSISDIA
ref|YP_074959.1|     -------------------------------MLRSGETLEIRQMYAGGLSISEIA
ref|YP_075129.1|     ---------------------------------------MYAAGLSISEIA
RAAC03102            MRIPQDHRPTFLKIIGMNSPPPCRIVAPVIRSWEVPVMREDERMEIRQLYEAGVSISELA
ref|YP_359963.1|     --------------------------------------LHELQARGKSIRAIA
                                                             :   * ** :* gb|AAR99616.1|       RELGIDRKTVRKYIHSPNPPSKSKR-----KQRKSKLDPFKPYLQKRMLEDGVFNSEKLF
sp|Q45618|TRA6_BACST RELGIDRKTVRKYIHSPNPPSKSKR-----KQRKSKLDPFKPYLQKRMLEDGVFNSEKLF
ref|YP_074959.1|     RRTGRDRKTIRKWLRTNTMPKPAK------RKRSSMLDQHEAFTLEQMQK-GVTSASKML
ref|YP_075129.1|     RRTGRDRKTIRKWLRTNAMPKPAK------RKRSSMLDQHKAFILEQMQK-GVTNASKML
RAAC03102            RRFGYDRKTIRNALNSSVEEKQGERASRGERKRGSKLEPYKDYVKQRMQL-GVLNAERIL
ref|YP_359963.1|     RETGHSRNTVRKYLRAEGIPERKPR-----PKRGSKLDPYKDTIQELMNL-GIFNCEVIY
                     *.  *  .*:*:*:  :.:          :* *  *: .:    :   *   *: ... :

gb|AAR99616.1|       FEIRQQGYTGGKTILKDYMKPFRETAKKKYTVRYETLPGEQMQVD---------------
sp|Q45618|TRA6_BACST FEIRQQGYTGGKTILKDYMKPFRETAKKKYTVRYETLPGEQMQVD---------------
ref|YP_074959.1|     YLLQQRGFKGKIRIVRAFMAPYRFMAKAAATVRFETPPGKQAQVDWADFGYIEVDGRR--
ref|YP_075129.1|     YLLQQRGFKGKIRIVRAFMAPYRFMAKAAATVRFETPPGKQAQVDWADFGYIEVDGRR--
RAAC03102            REIRFQGYTGGITVLREFMKPLRPVVSAKATERYESDPGEQAQIDLGAFPYYDSHGQRRT
ref|YP_359963.1|     ERIKEEGYTGGRTILRDYVRQFRPPKQVPAVCRYETKPGQQAQVDWGEYTYID-------
                     ::: .*:.*    ::: ::   *      .   *:*: **:*  *:* gb|AAR99616.1|       -
sp|Q45618|TRA6_BACST -
ref|YP_074959.1|     -
ref|YP_075129.1|     -
RAAC03102            I
ref|YP_359963.1|     -
```

FIG. 97

```
ref|YP_074959.1|      MVLAYSRAMYLEFVTATDMKTFMRCHINAFKFFGGVPHEILYDNVKTVVKDRD-------
ref|YP_594046.1|      MVLGWSRALYVEFIRKADTASFIRCHLNAFAYFGGMTQSILYDNTKQVVLERDETG----
ref|ZP_02516401.1|    -VLGYSRMLYIEFTDNMRYDTLETCHRNAFRFFGGVPREVLYDNMKTVVLQRD-------
ref|ZP_02335796.1|    -VLGYSRMLYIEFTDNMRYDTLETCHRNAFRFFGGVPREVLYDNMKTVVLQRD-------
ref|ZP_02563000.1|    -VLGYSRMLYIEFTDNMRYDTLETCHRNAFRFFGGVPREVLYDNMKTVVLQRD-------
RAAC03103             MVLAYSRMLYVEFIKAADQLHILQALRNALEFFGGVPRVMLSDNCSPLVVANDGQGEVDC
                      .: :*:          :  .  : :***:.: :* ** . :*  .* ref|YP_074959.1|      ------------------------------
ref|YP_594046.1|      ------------------------------
ref|ZP_02516401.1|    ------------------------------
ref|ZP_02335796.1|    ------------------------------
ref|ZP_02563000.1|    ------------------------------
RAAC03103             NRLISILPSSTDSCPRHVGLAGAAPRAR
```

FIG. 98

```
ref|YP_001039349.1|     ------------------------------------------------------------
ref|YP_001036724.1|     TRANSPSASEMUTATRTYPECLSTRIDIUMTHERMCELLUMATCCGBABNTRANSPSASE
ref|YP_076075.1|        ------------------------------------------------------------
ref|YP_074958.1|        ------------------------------------------------------------
ref|YP_076118.1|        ------------------------------------------------------------
RAAC03341               ------------------------------------------------------------ ref|YP_001039349.1|     ------------------------------------------------------------
ref|YP_001036724.1|     MUTATRTYPECLSTRIDIUMTHERMCELLUMATCCGBABNTRANSPSASEMUTATRTYPE
ref|YP_076075.1|        ------------------------------------------------------------
ref|YP_074958.1|        ------------------------------------------------------------
ref|YP_076118.1|        ------------------------------------------------------------
RAAC03341               ------------------------------------------------------------ ref|YP_001039349.1|     ------------------------------------------------------------
ref|YP_001036724.1|     CLSTRIDIUMTHERMCELLUMATCCGBABNTRANSPSASEMUTATRTYPECLSTRIDIUM
ref|YP_076075.1|        ------------------------------------------------------------
ref|YP_074958.1|        ------------------------------------------------------------
ref|YP_076118.1|        ------------------------------------------------------------
RAAC03341               ------------------------------------------------------------ ref|YP_001039349.1|     ------------------------------------------------------------
ref|YP_001036724.1|     THERMCELLUMATCCGBABNTRANSPSASEMUTATRTYPECLSTRIDIUMTHERMCELLU
ref|YP_076075.1|        ------------------------------------------------------------
ref|YP_074958.1|        ------------------------------------------------------------
ref|YP_076118.1|        ------------------------------------------------------------
RAAC03341               ------------------------------------------------------------ ref|YP_001039349.1|     ------------------------------------------------------------
ref|YP_001036724.1|     MATCCGBABNTRANSPSASEMUTATRTYPECLSTRIDIUMTHERMCELLUMATCCGBABN
ref|YP_076075.1|        ------------------------------------------------------------
ref|YP_074958.1|        ------------------------------------------------------------
ref|YP_076118.1|        ------------------------------------------------------------
RAAC03341               ------------------------------------------------------------ ref|YP_001039349.1|     ------------------------------------------------------------
ref|YP_001036724.1|     TRANSPSASEMUTATRTYPECLSTRIDIUMTHERMCELLUMATCCGBABNTRANSPSASE
ref|YP_076075.1|        ------------------------------------------------------------
ref|YP_074958.1|        ------------------------------------------------------------
ref|YP_076118.1|        ------------------------------------------------------------
RAAC03341               ------------------------------------------------------------ ref|YP_001039349.1|     ------------------------------------------------------------
ref|YP_001036724.1|     MUTATRTYPECLSTRIDIUMTHERMCELLUMATCCSCRESIGNIFICANCEE-IDENTIT
ref|YP_076075.1|        ------------------------------------------------------------
ref|YP_074958.1|        ------------------------------------------------------------
ref|YP_076118.1|        ------------------------------------------------------------
RAAC03341               ------------------------------------------------------------ ref|YP_001039349.1|     ---------------MATNNRMALLEQLSKYVVEKDKDFLKFALTLLINALMDAEVTSII
ref|YP_001036724.1|     IESPSITIVESGAPSMATNNRMALLEQLSKYVVEKDKDFLKEALTLLINALMDAEVTSII
ref|YP_076075.1|        ---------SRRRIPQVTTFRIALEELLRKTGVD-DFDFLREGLRVLAQGLMELEVSQRI
ref|YP_074958.1|        ------------------LEELLRKTGVD-DFDFLREGLRVLAQGLMELEVSQRI
ref|YP_076118.1|        ------SNTSQRGNPQVTNFRIALEELLRKSGVD-DVDFLREGVRVLAQGLMELEVSQQI
RAAC03341               ----MTNTKSRRHATMASLNSFAVLEWIRKMQDVEQIDFLRELMQLVTQFLIDAEAAEKI
                                            :  :  *          :  ***:*  :  : :    *:: *.:. * ref|YP_001039349.1|     GAEKYERNNNRNNYRNGYRLREWDTRVGTLQLSIPKLRHGSYFPSLLEPRK
ref|YP_001036724.1|     GAEKYERNNNRNNYRNGYRLREWDTRVGTLQLSIPKLRHGSYFPSLLEPRK
ref|YP_076075.1|        GADRYERSAERSTYRNGYRERQWDTRVGTIDLQIPKLRKGSYMPSFLEPRR
ref|YP_074958.1|        GADRYERSAERSTYRNGYRERQWDTRVGTIDLQIPKLRKGSYMPSFLEPRR
ref|YP_076118.1|        GAERYERSSERSNYRNGYRERQWDTRVGTIDLQTPKLRKGSYMPSWLEPRR
RAAC03341               GAERYERTESRVTQRNGYRSRAWDTRLGTVDLKIPKLRQGSFFPSILEPRR
                        **::***. .*   .***** : ****:**::*:.****:**::**:****:
```

FIG. 99

```
ref|YP_001125185.1|    ----------------MSDYLVIVESPTKAKTIERYLGKKYTVKASMGHVRDLPKSQMG
ref|YP_147064.1|       ----------------MSDYLVIVESPTKAKTIERYLGKKYTVKASMGHVRDLPKSQMG
ref|NP_389494.1|       ----------------MSDYLVIVESPAKAKTIERYLGKKYKVKASMGHVRDLPKSQMG
ref|YP_091420.1|       ----------------MSEYLVIVESPAKAKTIERYLGKKYKVKASMGHVRDLPKSQMG
ref|YP_001486753.1|    ----------------MADYLVIVESPAKAKTIERYLGKKYKVKASMGHIRDLPKSQLG
RAAC02852              MNQGQGLPRLRRMEDRGVSDYLVIVESPAKAKTIGKYLGSKYTVKASMGHVRDLPKSQLG
                                       ::*****:*.:*..**:*****.* ref|YP_001125185.1|    VDINDGYTPKYITIRGKGQVIKELKTAAKKAKKVFLAADPDREGEAIAWHLANMLDLDIH
ref|YP_147064.1|       VDIDHGYEPKYITIRGKGQVIKELKTAAKKAKKVFLAADPDREGEAIAWHLAHMLDLDIH
ref|NP_389494.1|       VDIEQNFEPKYITIRGKGPVLKELKTAAKKAKKVYLAADPDREGEAIAWHLAHSLDLDLN
ref|YP_091420.1|       VDIEQNFEPKYITIRGKGPVLKELKTAAKKAKKVYLAADPDREGEAIAWHLAHSLDLDLN
ref|YP_001486753.1|    VDTEHDFEPRYITIRGKGPVLKELKTAAKKAKKVYLAADPDREGEAIAWHLAHSLDLDLS
RAAC02852              VDVEHGFEPKYITIRGKGDVIKALREASKKAKKVYLAADPDREGEAIAWHLQHLLDLNPD
                       **  ::.: *:******* *:* *:  *:*****:************** .  ***:

ref|YP_001125185.1|    SDCRVVFHEITKDAIKQSFQQPRSINMNLVDAQQARRVLDRLVGYNISPLLWKKVKKGLS
ref|YP_147064.1|       SDCRVVFHEITKDAIQQSFQQPRAINMNLVDAQQARRVLDRLVGYNISPLLWKKVKKGLS
ref|NP_389494.1|       SDCRVVFNEITKDAIKESFKHPRMINMDLVDAQQARRILDRLVGYKISPILWKKVKKGLS
ref|YP_091420.1|       SDCRVVFNEITKDAIKESFKHPRMINMDLVDAQQARRILDRLVGYKISPILWKKVKKGLS
ref|YP_001486753.1|    SDCRVVFNEITKDAIKDSFKHPRMINMDLVDAQQARRILDRLVGYKISPILWKKVKKGLS
RAAC02852              DDCRVVFHEITKDAVKQAFQHPRKINLDLVNAQQTRRILDRLVGYKLSPLLWRKVKKGLS
                       .****:***:::*::  :::*:*:******:.::***** ref|YP_001125185.1|    AGRVQSVALRLIIDREKEIRQFQPEEYWTIQAKFQKGKEAFAASFYGVDGEKLELKTEAD
ref|YP_147064.1|       AGRVQSVALRLIIDRERIEREFQPEEYWTIQATFQKEGETFAASFYSIDGQKRDLKTEAD
ref|NP_389494.1|       AGRVQSVALRLIIDREKEINDFKPEEYWTIDGTFLKGQETFEASFFGKNGKKLPLNSEAD
ref|YP_091420.1|       AGRVQSVALRLIIDREKEINDFIPEEYWTIEGSFLKGKETFEASFFGINGEKHQLKSEDD
ref|YP_001486753.1|    AGRVQSVALRLIIDRENEINEFKPEEYWTIDGTFLKGKESFEASFFGVNGKKHPLKTKED
RAAC02852              AGRVQSVALRLIVDRENEIRTFQPEEYWTVDAHGQVHGKKLVARFYGYGEEKTPLPNEAA
                       ************:***.**.*  *.******::.    : :  * *:.   .  :*  *  .:

ref|YP_001125185.1|    VKEVLARLNGRAFTVKTVTKRERRRSPVPPFTTSSLQQEAARKLNFRTKKTMMVAQQLYE
ref|YP_147064.1|       VKAVLDRLNGTAFAVKTVTKRERKRSPVPPFTTSSLQQEAARKLNFRTKKTMMIAQQLYE
ref|NP_389494.1|       VKEILSQLKGNQYTVEKVTKKERKRNPALPFTTSTLQQEAARKLNFRAKKTMMIAQQLYE
ref|YP_091420.1|       VKQILSRIKGNKFEVKKVTKKERKRNPALPFTTSTLQQEAARKLNFRAKKTMMIAQQLYE
ref|YP_001486753.1|    VKEILSKLKGSKFSVEKVTKKERKRNPAVPFTTSTLQQEAARKLNFRAKKTMMIAQQLYE
RAAC02852              VRELLSRVEGHSLVVRRVKKSERKRNPAAPFTTSSLQQEAARKLGFRAYKTMQIAQQLYE
                       *:  :*  :::*     *.  *.* **:*.*.  ***:*****.. * :**** ref|YP_001125185.1|    GIDLGGEGTVGLITYMRTDSTRIAETAQQEAAAYIEATFGAQYVHQEKRKEKKSTNAQDA
ref|YP_147064.1|       GIDLGSEGTVGLITYMRTDSTRVAETAQQEAAAYIEATFGAMYVNQEKRKEKKSTNAQDA
ref|NP_389494.1|       GIDLGREGTVGLITYMRTDSTRISNTAVDEAAAFIDQTYGKEFLGGKRKPAKKNENAQDA
ref|YP_091420.1|       GIDLGKEGTVGLITYMRTDSTRISNTAQEEAASFIGEQYGKEFLGSKRKPAKKNENAQDA
ref|YP_001486753.1|    GIDLGKEGTVGLITYMRTDSTRISNTAIEEVSAFIDQTYGKNFLNTTKRTVKKNENAQDA
RAAC02852              GLDVPGEGTVGLITYMRTDSTRIAQSAQEEARAYIRQSFGDYVPDRPRQYAKNEDAQDA
                       *:*:  *****************:::.: *  :*. .::*   :  ::    *.:**** ref|YP_001125185.1|    HEAIRPTSAFRDPDKVKPYLTRDQFRLYKLIWERFIASQMAAAVLDTMSVELENNGVLFR
ref|YP_147064.1|       HEAIRPTSAFRDPDKVKPYLTRDQFRLYKLIWERFIASQMAAAVLDTMSVELENNGVVFR
ref|NP_389494.1|       HEAIRPTSVLRKPSELKAVLGRDQMRLYKLIWERFVASQMAPAVLDTMSVDLTNNGLTFR
ref|YP_091420.1|       HEAIRPTSVLRKPSDLKAVLGRDQLRLYKLIWERFVASQMAPATLDTMSVDLENNGLTFR
ref|YP_001486753.1|    HEAIRPTSTLRKPADVKHVLSRDQLRLYKLIWERFVASQMAPAVLDTMSVDLDNNGLTFR
RAAC02852              HEAIRPTSVMRHPDRLKDHLSRDQYRLYKLIWERFVASQMESAVLDTTSVDLEANGAWFR
                       ********.:*.*   :*   * * ******:**  .*.* ref|YP_001125185.1|    ASGSKVKFPGFMKVYIEGTDDQTEEQD-RLLPDLEEGEAVESEMIEPKQHFTQPPPRYTE
ref|YP_147064.1|       ASGSKVKFPGFMKVYIEGTDDQTEEQD-RILPDLEEEETVRSETIESKQHFTQPPPRYTE
ref|NP_389494.1|       ANGSKVKFSGFMKVYVEGKDDQMEEKD-RMLPDLQEGDTVLSKDIEPEQHFTQPPPRYTE
ref|YP_091420.1|       ANGSKVKFSGFMKVYVEGKDDQMEEKN-KMLPDLAEGDTVLSKDIEPEQHFTQPPPRYTE
ref|YP_001486753.1|    ANGSKVKFPGFMKVYVEGKDDQLEEKD-KMLPDLKEGDTVLSKDIEPEQHFTQPPPRYTE
RAAC02852              ATGSVVRFPGFMALYTEGRDDDADEEEGKLLPPLQEGDVVQVKTWKPEQHFTQPPPRYTE
                       *.** *:*.***  :*  :  :*:  :*::  ::** * * ..:  : ::************ continued →
```

FIG. 99 continued

```
ref|YP_001125185.1|    ARLVKTLEELGIGRPSTYAPTLDTIQKRNYVVLENKRFVPTELGEIVVELILEFFPEIID
ref|YP_147064.1|       ARLVKTLEELGIGRPSTYAPTLDTIQKRNYVVLENKRFVPTELGEIVVELMLEFFPEIID
ref|NP_389494.1|       ARLVKTLEERGIGRPSTYAPTLDTIQRRGYVALDNKRFVPTELGQIVLDLIMEFFPEIIN
ref|YP_091420.1|       ARLVKTLEELGIGRPSTYAPTLDTIQKRGYVALDNKRFIPTELGEIVLDLIMEFFPEIIN
ref|YP_001486753.1|    ARLVKTLEELGIGRPSTYAPTLDTIQKRGYVALDNKRFIPTELGEIVLNLIIEFFPEIIN
RAAC02852              STLVKAMEELGIGRPSTYAPTIDILLKRGYVTLDQKRFVPTELGEIVVNILKEHFPQLID
                       : ***::** *********** *   : :*.**.*::***:*****:**:::: *.**:*:

ref|YP_001125185.1|    VEFTAKMEKELDEIEEGKVEWIKVVDEFYREFEKRLKVAEKEMREVEIKDEPAGIDCDVC
ref|YP_147064.1|       VEFTAKMEKELDEIEEGKVEWIKVVDEFYREFEKRLKVAEKEMRAVEIKDEPAGIDCEVC
ref|NP_389494.1|       VEFTAKMERDLDHVEEGNTEWVKIIDNFYTDFEKRVKKAESEMKEVEIEPEYAGEDCELC
ref|YP_091420.1|       VEFTAKMEKELDDVEDGNIQWVQIIDSFYKDFEKRVEKAEAEMQEVEIEPEYAGVDCEAC
ref|YP_001486753.1|    VEFTAKMEKELDSVEEGTIEWVRIIDSFYQDFAKRVEKAEAEMQEVEIEPEYAGVDCEEC
RAAC02852              VSFTADMESRLDKVEEGNANWIELLDQFYHDFEKDLKKAESALGHVELKDEVSDVRCEKC
                       *.**.  **  :*:*. :*:.::*.** :* *  ::     :  :: * :. *: * ref|YP_001125185.1|    GSPMVYKMGRFGKFIACSNFPECRHTKPIVKEIGVKCPKCHEGNIVERNSKRKRVFYGCD
ref|YP_147064.1|       GSPMVYKMGRFGKFIACSNFPECRHTKPIVKEIGVKCPKCREGNIVERSTKRKRVFYGCD
ref|NP_389494.1|       SSPMVYKMGRYGKFLACSNFPDCRNTKPIVKQIGVKCPSCGEGNIVERKSKKKRVFYGCD
ref|YP_091420.1|       GHPMVYKMGRYGKFMACSNFPDCRNTKPIVKEIGVKCPSCKTGNIVERKSKKRRIFYGCD
ref|YP_001486753.1|    GHPMVYKMGRYGKFMACSNFPDCRNTKPIVKDIGVKCPTCHEGNIVERKSKKRRIFYGCD
RAAC02852              GRLMVYKTGRYGKFLACPGFPECRNTKPILKEIPVSCPKCGKP-LVERKGKSRKVFYGCS
                       .  **** **:***:**..**:**:****:*:* *.**.*    :***. *  ::*.****.

ref|YP_001125185.1|    RFPECDFVSWDKPLARPCPKCGGLLVEKKLKKGVQVQCT---------------
ref|YP_147064.1|       RFPDCDFVSWDKPLARPCPKCAGLLVEKVLKKGVQVQCT---------------
ref|NP_389494.1|       RYPDCEFVSWDKPIERKCPKCGKMLVEKKLKKGIQVQC----------------
ref|YP_091420.1|       RYPECEFVSWDKPLERKCPKCEDMLVEKKLKKGVQVQCVN--------------
ref|YP_001486753.1|    RFPECEFVSWDKPIERKCPKCENMLVEKKLKKGMQVQCVN--------------
RAAC02852              GYPECDYVLWQRPTGQTCPVCGHPMIEKGGKGKTVVVCSNEKAHPMVATEAQAK
                       :*:*::* *::*    : ** *   ::**   *      * *
```

FIG. 100

```
ref|YP_001125186.1|      -----ALQLFLEYLCIEKNYSQYTIVCYRRDIEQFLQFMNEEGIDEL-NEVAYSDVRLYL
ref|NP_243331.1|         ------------------SPHTIVNYELDLRHFRDFMEQQSIPSF-AAVSYAFVRHYL
ref|YP_175772.1|         ------------------TIDHYRKDVQQFAAFMSAAGIAEI-KDVKHQDVRLFI
ref|ZP_01775043.1|       ------------------SPHTLAAYRSDLEQFLSFLAREREAPRAEEVDHLAIRRYL
ref|YP_740910.1|         ------------------ SPHTLQAYQRDLTRFHHWCAENGLADR-DAVSAHDIRRFA
RAAC02854                MTQSVGDAVKVFLDDAALRFSERTVRSYGQDLEAFRQWLDDRGVYDL-DALSTRDVRMHA
                              *:    *   *:  *   :              :     :* .

ref|YP_001125186.1|      TKLYGQQLASRSVARKISSLRSFYKFLLREGWTAENPFALAALPKKEQKIPNFLYREELE
ref|NP_243331.1|         TVLYEQEYARSTVSRKLSTLRSFYQFLVREKWVMENPFLLAHTPKGVKKLPSFLYEEEME
ref|YP_175772.1|         SELVDKKYARKSIARKLSALRSFGKFLMEEGHISENPFLHTHLPKQKTRLPTFLYEEEME
ref|ZP_01775043.1|       AQLH-KGCAKSSIGRKLSAIRALFRYLMREGKLEKNPAELVSTPKKEKRLPFHLNIDQVS
ref|YP_740910.1|         AARHRQCLAPGSVQRTLSSLRSLFRYLVREGRLTGNPAEGVAAPRRPRRLPGVLSPDEAA
RAAC02854                SDLLAKGAAKSSVARRLSCLRTFLRFCAERGWVRQVMAKNVRLPKRDRRLPRYLHEEEVA
                           :        *  ::  *  :*  :*::  ::  ..      .  *:    ::* *   ::

ref|YP_001125186.1|      ALFRVNDGNTAVGQRNAALLELLYATGARVSECCHIRLSDLDFAASTVLIHGKGNKQRYV
ref|NP_243331.1|         QLLDALNGDSPLQLRNRALFETIYASGLRVSECCGLKLQDVDLSIGTVFVFGKGRKERYV
ref|YP_175772.1|         HWLLALPANKPLEKRDKAIIELLYATGMRVSECSMLALDQWDRVSETVRVFGKGRKERYV
ref|ZP_01775043.1|       ALVTAPAGSSGLPLRDRAVLETLYSCGIRVSELTGMNVGDMDLAAGLARVMGKGCKERLV
ref|YP_740910.1|         RLLEGSPEDDPLALRDDRALYELIYSSGLRLAEAVGLDLGRLDLTEGLVEVVGKGAKTRRV
RAAC02854                ALTIDHVGGDDFVALRDRALLEFLYATGVRVSECVHLDIGDLDLSAGFARVLGKGGRERYV
                          .      :   *: *:  *  :*: *  *::*  ::   :     *     . : *** : * * ref|YP_001125186.1|      PFGRPAREALERYIGGGRRELVGKLPADHR--YLFVNARGNPLTPRGVRYILDRIVETAA
ref|NP_243331.1|         PIGSFACDAIQEYIENGREKLLKKSKSVDLPGDLFLNYRGGPLTERGVRKILHQALDQAA
ref|YP_175772.1|         PVGKMAVSAVESYIHEARPKLLR---ANDPTSHLFLNYRGGALSDRSIRKIVEKRLDEAA
ref|ZP_01775043.1|       PVGSCARSALAAYLAER-------ADPGPAEPLILN-ARGGRLTRRSVARIVDAHMLLIA
ref|YP_740910.1|         PVGGKAREALQAWLAVRP------ALAGADEPAVFVSQRGGRLSARSVQARLARLATLSG
RAAC02854                MVGRRAVDALRRYLPLR--------DRMARCSAVFINRRGGRLTDRSVRRVLERRIQEVP
                          .*   *  .*: ::          ::     **. *:  *.:   :

ref|YP_001125186.1|      LTQNISPHVLRHTFATHLLNEGADLRSVQELLGHAHLSSTQVYTHVTKDRL---------
ref|NP_243331.1|         LSTRVSPHSLRHSFATHLLNNGADLRVVQDLLGHENLSTTQVYTHVTKDRL---------
ref|YP_175772.1|         MQKKISPHAIRHSFATHLLNAGADLRAVQELLGHQSLKTTQVYTHVSKERL---------
ref|ZP_01775043.1|       AMRKVSPHTLRHTFATHLLEGGADLRAIQELLGHASLSTTQKYTHVSIDKL---------
ref|YP_740910.1|         VGRPVHPHMLRHSFASHLLESSGDLRAVQELLGHADIATTQVYTHLDFQHL---------
RAAC02854                GLRSIHVGLRHSFATHMLNGGADLRSVQELLGHASLSSTQIYTHTSREQLARAYYAAHP
                            :  *  ;::*:*:  ..*** :*:**   ;  ; ***     ::* ref|YP_001125186.1|      ------------------
ref|NP_243331.1|         ------------------
ref|YP_175772.1|         ------------------
ref|ZP_01775043.1|       ------------------
ref|YP_740910.1|         ------------------
RAAC02854                RARRGTQGRESSEDGV
```

FIG. 101

```
ref|ZP_01666445.1|      ------------------------------------------------------------
ref|ZP_01665334.1|      ------------------------------------------------------------
ref|YP_001211938.1|     DINACTIVATEDDERIVATIVESPELTMACULUMTHERMPRPINICUMSIDBBAFTRANS
dbj|BAD22831.1|         ------------------------------------------------------------
RAAC03166               ------------------------------------------------------------
gb|EAY56013.1|          ------------------------------------------------------------ ref|ZP_01666445.1|      ------------------------------------------------------------
ref|ZP_01665334.1|      ------------------------------------------------------------
ref|YP_001211938.1|     PSASEANDINACTIVATEDDERIVATIVESPELTMACULUMTHERMPRPINICUMSIDBB
dbj|BAD22831.1|         ------------------------------------------------------------
RAAC03166               ------------------------------------------------------------
gb|EAY56013.1|          ------------------------------------------------------------ ref|ZP_01666445.1|      ------------------------------------------------------------
ref|ZP_01665334.1|      ------------------------------------------------------------
ref|YP_001211938.1|     AFTRANSPSASEANDINACTIVATEDDERIVATIVESPELTMACULUMTHERMPRPINIC
dbj|BAD22831.1|         ------------------------------------------------------------
RAAC03166               ------------------------------------------------------------
gb|EAY56013.1|          ------------------------------------------------------------ ref|ZP_01666445.1|      --------------------------------------------MAQYQINIDSKILHQL
ref|ZP_01665334.1|      ------------------------------------------------------------
ref|YP_001211938.1|     UMSISCRESIGNIFICANCEE-IDENTITIESPSITIVESGAPSMAQYQITVNQELLHQL
dbj|BAD22831.1|         --------------------------------------------MAQYQITLDSQLLHQL
RAAC03166               --------------------------MVECETEKKPLHQEG-YRMAQYQITVDDEILEGL
gb|EAY56013.1|          --------------------------------------------MAELNLTLNPDLLPNL ref|ZP_01666445.1|      FLSNAKDAAMASFLEEVLNQILQAQATEQLRAERYERTDERQGYRNGVYPHRLTTRVGTI
ref|ZP_01665334.1|      ------------------------------------------------------------
ref|YP_001211938.1|     FLSNNKDSGIAALLESVLNQILQAQATEQLQAGPYERTDERKGYRNGTYPHQLTTRVGTI
dbj|BAD22831.1|         FLSNAHDAGVAKLLESVLNQVLQAQATEQLGAEPYERTEERQGYRNGTYPHQLTTRVGTI
RAAC03166               FQ---RDGGVAKLVESVVNQILQAQVQEQLKAAPYERTKERQGYRNGTVTRTLTTRVGRL
gb|EAY56013.1|          LTE--GGDGLKKLVESVLNQVLEAQMTEHLGADRHERTEERAGYRNGVRERTLTTRVGTV ref|ZP_01666445.1|      TLKVPRFRDGKFSTEMFARYQRSEQALVLTLMEMVVNGVSTRKVAQITEELCGSEFSKST
ref|ZP_01665334.1|      ---------------MFARYQRSEQALVLTLMEMVVNGVSTRKVAQITEELCGSEFSKST
ref|YP_001211938.1|     TLRVPRFRNGQFSTEMFARYQRSEQALVLTLMEMVINGVSTRKISQITEELCGAEFSKST
dbj|BAD22831.1|         TLRVPRIRNGKFSTELFARYQRSEQALVLALMEMVVNGVSTRKVAQITEELCGTEFSKST
RAAC03166               VLRVPRVRNGQFSTELFARYQRSEQAFIIALMEMVVNGVSTRDVAKITEQLCGTTFSKST
gb|EAY56013.1|          ILRVPQTRDGSFSTDLFKRYQRSEQALVLSMMEMVVQGVSTRKVANITEELCGTRFSKST
                                       :* ********::::****::*****.:::***:***:  ***** ref|ZP_01666445.1|      VSDLCKRLDPIVHAWNERPLKDQKYPFVMVDAMVIKVREEERVRSRGVMIAVGINAEGYR
ref|ZP_01665334.1|      VSDLCKRLDPIVHAWNERPLKDQKYPFVMVDAMVIKVREEERVRSRGVMIAVGINAEGYR
ref|YP_001211938.1|     VSDLCKKLDPLVISWNNRDLREMRYPFILVDALVLKVREDGRVRSRGVMIAIGLNTEGYR
dbj|BAD22831.1|         VSELCKRLDPVVTAWNNRPLDDHPFPFVIVDALVLKVREESRVRSRGALIGIGVNTDGYR
RAAC03166               VSELCKRLDPIGQGWNHRSLAEHRYPFLLVDALVLRIREEGRDRSRAAMIAVGINEEGYR
gb|EAY56013.1|          VSQLSTGLSARVQAWKNRKLSS-PYPFVLIDALVIRVRKNESVSPMAALIATGITAEGQR
                        **:*.. *..    .*:.* *  .  :**:::**:*:::*::     . ..:*. *:. :* * ref|ZP_01666445.1|      EVLGIMLGDSESEASWSEFFSWLKRRGLCGVDLIISDHHGGLIRAIRQYFQGVTWQRCQT
ref|ZP_01665334.1|      EVLGIMLGDSESEASWSEFFSWLKRRGLCGVDLIISDHHGGLIRAIRQYFQGVTWQRCQT
ref|YP_001211938.1|     EVLGIMLGDSESEASWSEFFSWLKNRNLRGVDLVVSDDHSGLVKAVRNHFQGVTWQRCQT
dbj|BAD22831.1|         EVLGLMLGDSESEASWSEFFGWLKSRGLQGVDLIVSDDHGGLIRAIRRHFQGVTWQRCQT
RAAC03166               GILGLMLGDSESEASWREFFAWLKNRGLRGVDVVVSDSHGGLVKALHTEFQGCTWQRCQT
gb|EAY56013.1|          EILGLTLGDSENEASWDDMLRDLKHRGLSGVDLIVSDDHKGLKNAAWKHFQGVRWQRCQV
                         :**: *****.**** :::   ** *.* ***:::** * ** .*    ***  *****.
``` continued →

FIG. 101 continued

```
ref|ZP_01666445.1|        HFIRNILDATPKSLQPEILARVRAILAAPDRETAVMLLNETLAAYETKAPKAMAILEAGF
ref|ZP_01665334.1|        HFIRNILDATPKSLQPEILARVRAILAAPDRETAVMLLNETLAAYETKAPKAMAILEAGF
ref|YP_001211938.1|       HFMRNIMDSAPKSVKEELYPRLRAILDAPDIGSARLLLNQTLEAFEKKAPRAMRVLEMGF
dbj|BAD22831.1|           HFIRNILDATPKELQDEVHSWVRAILDAPDLDTARLLLNQVLETYETKAPKAMAILEAGF
RAAC03166                 HFMRNLLDATPKALQEEVYQQVRAVLDAPDLKTARLLKDAFVEAYAEKAPKAVQVLEDGF
gb|EAY56013.1|            HFLRNILGHAPASQRGPLAQALSRLFRSETMEEARMVRNEILRTFEKKAPKAMECLEEGF
                          **:**::. :*     :     :     : ::  :       *  :: :   : ::   ***:*:   ** **

ref|ZP_01666445.1|        DDAIAVLALPEKYRKRLRTTNGVERLNEEVRRRERVIRIFPNRASALRLIGALLMEIDDK
ref|ZP_01665334.1|        DDAIAVLALPEKYRKRLRTTNGVERLNEEVRRRERVIRIFPNRASALRLIGALLMEIDDK
ref|YP_001211938.1|       DDATAVLVLPEKYRLRLRTTNGVERLIEEVRRRERVIRIFPNRESVVRLIGALLMEIDDK
dbj|BAD22831.1|           EDATAVLLLPEKYRKRLRTTNALERLNEEIRRRERVIRIFPNRESAMRLIGALLMEID--
RAAC03166                 DDVTAVLVLPERYRRRLRTTNGVERLNEEIRRRERVIRIFPNRESAIRLLGALLMEIDEE
gb|EAY56013.1|            DETLNILTFPKKYRVRLRSTNSQERLNEEIRRRERVIRIFPNEESAIRLIGALLSEFHEQ
                          ::.   :* :*::** ***:**. *** **:************. *.:**:**** *:.

ref|ZP_01666445.1|        WASGKKYLDMTDYWDWRERQ--------------
ref|ZP_01665334.1|        WASGKKYLDMTDYWDWRERQ--------------
ref|YP_001211938.1|       WAAGKKYLDMAEYLQWQKEQKHDR----------
dbj|BAD22831.1|           ----------------------------------
RAAC03166                 WTTGRKYLNMDEYEAWKKAQEASRGSTQACAATA
gb|EAY56013.1|            WSTGKKYLDMTEYHEWKKQESFKTSSTLA-----
```

FIG. 102

```
ref|ZP_02327778.1|    MDELKIHKHEWKKE--KLFVGDKWRGGDKQYVFHAGFGKPLYHTYPTQWWGEFIKRHNLK
ref|ZP_02327484.1|    MDELKVHEYEWKKE--KLSVGDKWRGGDRQYVFHAGFGKPFHHTYPTEWWNGFTKRHNLK
ref|ZP_02330756.1|    MVELKEYEREWKKE--KLSVGDKWIGGDRRYVFHAGLGKPYFYSYPSEWWSKFIKRHDLK
ref|ZP_02330395.1|    MQELKVHEREWKKE--KLFMGDKWLGCDRCYVFHAGYGKPFFHTTPTKWWRSFISRNKLK
ref|ZP_02326400.1|    -DELSKFEIIWNEE--KETAGQKWEERKHSFIFHNCLGKPFYRTVPSQRWLQFIRANNLP
RAAC02961             MNELSKYREIWIKERWHLQQSGKWQGGEKQFLFHNGFGEKYYPSTPSLHWRRFLDKEGLP
                       *. .. * :*  :   .    .: :: * *:   . : *:   *    : * ref|ZP_02327778.1|    RVRFHDLRHSSATLLIEAGASMKAIQERLGHSKHQTTADIYAHITKKVSRETAEKFDKFA
ref|ZP_02327484.1|    RVRFHDLRHSSATLLIEAGASMKAVQQRLGHSKHQTTADIYAHVTKKVSRDTAEKFNKFA
ref|ZP_02330756.1|    RVRFHDLRHSSATLLIEAGASMKAIQQRLGHSKHQTTADVYAHVTKKVSRETAEKFDKFA
ref|ZP_02330395.1|    YIRLHDLRHSSATLLIEAGAPMKAIQKRLGHSKHQTTADIYAHVTKKVSRDTAEKFDKFA
ref|ZP_02326400.1|    HIRLHDLRHTVATLLLEEGVRLKVIQERHGHANYQTTADIYSHVTKRLTEDAVDKFEKFG
RAAC02961             RIRLHDLRHTTATILREDGADLKSIQERLRHTRLSITADLYTHETEAVSRETADRLEKLN
                      :*:***** ** * *, :* :*:*  *:. . ***:*:* *: ::.::.:::*:

ref|ZP_02327778.1|    P--------
ref|ZP_02327484.1|    PNNIRPQSV
ref|ZP_02330756.1|    PDSIRPQSV
ref|ZP_02330395.1|    PNNIRPQSV
ref|ZP_02326400.1|    P--------
RAAC02961             PFRSRSQSI
                      *
```

FIG. 103

```
ref|YP_146129.1|        ------------------------------------------------------------
sp|O87703|DNLJ_BACST    ------------------------------------------------------------
gb|ABN05294.1|          ------------------------------------------------------------
ref|YP_001124385.1|     ------------------------------------------------------------
ref|ZP_01169975.1|      ------------------------------------------------------------
RAAC02202               MGARRDRRQVGRGRIAGTRRALRRPHRREAAVCQVRADSQGGSLSGFKHPMQCVIRSVMR ref|YP_146129.1|        ----------QQAERRAAELRELLHRYGYEYYVLDRPSVPDAEYDRLMQELMAIEEQYPE
sp|O87703|DNLJ_BACST    ----------QQAERRAAELRELLNRYGYEYYVLDRPSVPDAEYDRLMQELIAIEEQYPE
gb|ABN05294.1|          ----------QQAERRAAELRELLHRYGYEYYVLGRPSVPDAEYDRLMQELMAIEEQYPE
ref|YP_001124385.1|     ----------QQAKRRAAELRELLNRYGYEYYVLDRPSVPDAEYDRLMQELIAIEKQYPE
ref|ZP_01169975.1|      -------MDLQNAEARVKELHNLLNQYGYEYYVLDKPSVPDSEYDRLLKELMELENEHPQ
RAAC02202               VVDAKSALSLEEARARAKVLREQIEYHNRKYYLEDNPEISDAEWDALMRDLIELERKYPE
                                  ::*. *.  *:: :. :.  :**: ..*.::.*:*:* *:::*: :*.::*:

ref|YP_146129.1|        LKTSDSPTQRIGGPPLEAFRKVTHVVPMMSLANAFDEGDLRDFDRRVRQEVGE-AAYVCE
sp|O87703|DNLJ_BACST    LKTSDSPTQRIGGPPLEAFRKVAHRVPMMSLANAFGEGDLRDFDRRVRQEVGE-AAYVCE
gb|ABN05294.1|          LKTSDSPTQRIGGPPLEAFRKVTHVVPMMSLANAFDEGDLRDFDRRVRQEVGE-AAYVCE
ref|YP_001124385.1|     LKTSDSPTQRIGGPPLEAFRKVTHRVPMMSLANAFNEGDLRDFDRRVRQEVGE-AAYVCE
ref|ZP_01169975.1|      LKTADSPTQRVGGEILDMFEKVEHQTPMLSLGNAFNEEDLRSFDRRVRQTAGENLSYVCE
RAAC02202               LVDPASPTQRVGAPALEGFAKVVHEVPMLSLANAYSTEDLLDWDRRVRQAVGDDVRYVCE
                        *  . ****:*.   *:  *   .:.:.    .:**** .*:    **** ref|YP_146129.1|        LKIDGLAVSVRYEDGYFVQGATRGDGTTGEDITENLRTIRSLPLRLKEPVSLEARGEAFM
sp|O87703|DNLJ_BACST    LKIDGLAVSVRYEDGYFVQGATRGDGTTGEDITENLKTIRSLPLRLKEPVSLEARGEAFM
gb|ABN05294.1|          LKIDGLAVSVRYEDGYFVQGATRGDGTTGEDITENLRTIRSLPLRLKEPVSLEARGEAFM
ref|YP_001124385.1|     LKIDGLAVSVRYEDGYFVQGATRGDGTTGEDITENLKTIRSLPLRLNEPVSLEARGEAFM
ref|ZP_01169975.1|      LKIDGLAVALKYEDGLFIQGATRGDGTIGEDITVNLRTIRSIPLRLSEPVSIEVRGEAFM
RAAC02202               LKVDGLAVALRYQDGRLVLGATRGDGSVGEDITANIRTIRNVPLELSEPVSLEVRGEAYM
                        :***::.:*:   :: ***: *** *::*...*.****:*.****:* ref|YP_146129.1|        PKASFLRLNEERKARGEELFANPRNAAAGSLRQLDPKVAASRQLDLFVYGLANAEELGIE
sp|O87703|DNLJ_BACST    PKASFLRLNEERKARGEELFANPRNAAAGSLRQLDPKVAASRQLDLFVYGLADAEALGIA
gb|ABN05294.1|          PKASFLRLNEERKARGEELFANPRNAAAGSLRQLDPKVAASRQLDLFVYGLANAEELGIE
ref|YP_001124385.1|     PKASFLRLNEERQARGEELFANPRNAAAGSLRQLDPKVAASRQLDLFVYGLANAEELGIE
ref|ZP_01169975.1|      PGRSFEALNKGKEERGEEPFANPRNAAAGSLRQLDPRIAASRNLDIFLYGISNTGDTGVE
RAAC02202               PKREFMRLNELREQQGEPLFANPRNAAAGSLRQLDPAVAASRRLGVIVYQLVRAEAHGCE
                        *  .*  :: :: : **************  :**.*.::::*  :    * ref|YP_146129.1|        SHSEALDYLQALGFKVNPERRRCANIDEVIAFVNEWHEKRPQLPYEIDGIVIKVDSFAQQ
sp|O87703|DNLJ_BACST    SHSEALDYLQALGFKVNPERRRCANIDEVIAFVSEWHDKRPQLPYEIDGIVIKVDSFAQQ
gb|ABN05294.1|          SHSEALDYLQALGFKVNPERRRCANIDEVIAFVNEWHEKRPQLPYEIDGIVIKVDSFAQQ
ref|YP_001124385.1|     SHSAALSYLQSLGFKVNPERRRCATIDEVIAFVNEWKEKRPQLPYEIDGIVIKVDSFAQQ
ref|ZP_01169975.1|      SHSAGLDYLETLGFKNKERRKCASIEEVIEYVSSWTEKRPNLDYDIDGIVIKVDSLALQ
RAAC02202               THSQALDYVARLGLPAHRERHVCANIEDVIAYIEAWADKRHELPYATDGMVVKVDSLALQ
                        :**  .*.*:   :  .:   : **.*:: **  . * :**  :*    **:*.:****:* * ref|YP_146129.1|        RELGATAKSPRWAIAYKFPAEEVVTTLGIEVNVGRTGVVTPTAILEPVRVAGTTVQRAT
sp|O87703|DNLJ_BACST    RALGATAKSPRWAIAYKFPAEEVVTTLGIEVNVGRTGVVTPTAILEPVRVAGTTVQRAT
gb|ABN05294.1|          RELGATAKSPRWAIAYKFPAEEVVTTLGIEVNVGRTGVVTPTAILEPVRVAGTTVQRAT
ref|YP_001124385.1|     RQLGATAKSPRWAIAYKFPAEEVVTTLGIEVNVGRTGVVTPTAVLEPVRVAGTTVQRAT
ref|ZP_01169975.1|      EELGATAKSPRWAIAYKFPAEEVVTLRDIELSVGRTGVVTPTALLEPVRVAGTTVQRAS
RAAC02202               ARLGATAKSPRWAIAYKYAAEEAETTLRAIELNVGRTGVVTPTAVFDPVQLAGTTVSRAS
                          **************:.**:. ***   **:.*****.*****::**:.******.**:

ref|YP_146129.1|        LHNEDFIREKDIRIGDAVIIKKAGDIIPEVVGVVVDRRDGDETPFAMPTHCPECESELVR
sp|O87703|DNLJ_BACST    LHNEDFIREKDIRIGDAVIIKKAGDIIPEVVGVVVDRRDGDETPFAMPTHCPECESELVR
gb|ABN05294.1|          LHNEDFIREKDIRIGDAVIIKKAGDIIPEVVGVVVDRRDGDETPFVMPTHCPECESELVR
ref|YP_001124385.1|     LHNEDFIREKDIRIGDAVIIKKAGDIIPEVVGVVVDRRDGDEVPFTMPTHCPECESELVR
ref|ZP_01169975.1|      LHNEDLIREKDIKIGDKVVVKKAGDIIPEVVNVLAEQRTGEEREFIMPTHCPECGSELVR
RAAC02202               LHNEDLVREKDIRVGDVIVVQKAGDIIPEVIRSLPERRTEPLPEFRMPETCPQCGSRLVR
                        *****::****:.** :::.:*******. :  :* **.*  *  **  *:*.* **
``` continued →

FIG. 103 continued

```
ref|YP_146129.1|       LEGEVALRCLNPNCPAQLRERLIHFASRAAMNIEGLGEKVVTQLFNAGLVRDVADLYRLT
sp|O87703|DNLJ_BACST   LEGEVALRCLNPNCPAQLRERLIHFASRAAMNIEGLGEKVVTQLFNAGLVRDVADLYCLT
gb|ABN05294.1|         LDGEVALRCLNPKCPAQLRERLIHFASRAAMNIEGLGEKVVTQLFNAGLVHDVADLYRLT
ref|YP_001124385.1|    LDGEVALRCLNPKCPAQLRERLIHFASRSAMNIEGLGEKVVTQLFNAGLVHDVADLYQLT
ref|ZP_01169975.1|     LEGEVALRCINPKCPAQIREGLIHFVSRNAMNIDGLGEKVVSQLFAKELIKDVADLYKLT
RAAC02202              LDGEVAWRCINPDCPALLREGLIHFCSRDAMNIEGLGEQWITVLLDRGLVRTHADLYRLR
                       *:**.:.*.:...**:**:..:..*:....*::.****.* ref|YP_146129.1|       KEQLIGLERMGEKSATNLLAAIEASKQNSLERLLFGLGIRYVGAKAAQLLAEHFETMERL
sp|O87703|DNLJ_BACST   KEQLVGLERMGEKSAANLLAAIEASKQNSLERLLFGLGIRYVGAKAAQLLAEHFETMERL
gb|ABN05294.1|         KEQLIGLERMGEKSATNLLAAIEASKQNSLERLLFGLGIRYVGAKAAQLLAEHFETMERL
ref|YP_001124385.1|    KEQLVGLERMGEKSAANLLAAIEASKQNSLERLLFGLGIRYVGAKAAQLLAEHFETMERL
ref|ZP_01169975.1|     HEALIGMERMGEKSVNNLVQAIEASKQNSLEKLLFGLGIRHVGAKAAKTLAQHFSSMDNL
RAAC02202              KADLVQLDRMGDKLADKLLHNIQESKRNSLERLLFGLGIRHVGEKAAKTLAEHFVTIDAL
                       :..*:.::****:*...:*:..*:.::****:.*:::**.:::.* ref|YP_146129.1|       ERATKEELMAVPEIGEKMADAITAFFAQPEATELLQELRAYGVNMAYKGPKRSAEAPADS
sp|O87703|DNLJ_BACST   ERATKEELMAVPEIGEKMADAITAFFAQPEATELLQELRAYGVNMAYKGPKRSAEAPADS
gb|ABN05294.1|         EKATKEELMAVPEIGEKMAGSIIAFFSQPEAAELLHELRLYGVNMAYKGPKRAAEAPADS
ref|YP_001124385.1|    EAATKDELMAVPEIGEKMADSITTYFSQPEAVELLNELRTYGVNMAYKGRKRTAETPASS
ref|ZP_01169975.1|     MAASEDDLTAINEIGGKMAGAIVAFFEQEEAKELIRELKESGVNMEYKGPKPVAAEDSDS
RAAC02202              MSASEEDLMAVPDIGPKVAQSIRQYFDTPRVRQLIQELKDLGVNMTYLGPQKVSDGP---
                       ..::::*..*:..**..*:*....:*......:..:*:.**:.****.*.*...:...:.

ref|YP_146129.1|       AFAGKTVVLTGKLASMSRNEAKEEIERLGGRVTGSVSRSTDLVIAGEDAGSKLEKAQQLG
sp|O87703|DNLJ_BACST   AFAGKTVVLTGKLASMSRNEAKEQIERLGGRVTGSVSRSTDLVIAGEDAGSKLEKAQQLG
gb|ABN05294.1|         AFAGKTVVLTGKLASMSRNEAKEEIERLGGRVTGSVSRSTDIVIAGEDAGSKLEKAQQLG
ref|YP_001124385.1|    VLAGKTVVLTGKLASMSRNEAKEQIERLGGRVTGSVSRSTDIVIAGEDAGSKLDKAQQLG
ref|ZP_01169975.1|     FFAGKTIVLTGKLSILSRNEAKEKIEALGGNVSGSVSKKTDLLIAGEDAGSKLAKAQDLG
RAAC02202              -LAGKTVVLTGVLQAADRKQATAWIEQMGGKVASSVSAKTDVLIAGDKAGSKLAKAQEIL
                       .:****:****.*...*:*...**.:.**.*:.:***.:.**:.:***:*****.***::

ref|YP_146129.1|       -------IEIWDESRFLQEIN-----
sp|O87703|DNLJ_BACST   -------IEIWDESRFLQEIN-----
gb|ABN05294.1|         -------IEIWDESRFLQEIN-----
ref|YP_001124385.1|    -------IEIWDETRFLQ--------
ref|ZP_01169975.1|     -------IDIWNEEQLVEE-------
RAAC02202              RNHPDAKLEIWDEAAFLRLVDEAGLR
                              ::**:*...::.
```

FIG. 104

```
ref|ZP_01695687.1|   ---------VGPSQLLSKLCDEIELEKTINDLVKWDSVRCHISPGTRIKALVLNILCSGK
ref|ZP_01695982.1|   ---------VGPSQLLSKLCDEIELEKTINDLVKWDSVRCHISPGTRIKALVLNILCSGK
ref|ZP_01695971.1|   ---------VGPSQLLSKLCDEIELEKTINNLVKWDSVRCHISPGTRIKALVLNILCSGK
ref|ZP_01695655.1|   -------------PQSCKLCDEIELEKTINNLVKWDSVRCHISPGTRIKALVLNILCSGK
ref|YP_430569.1|     ----MRFFRAGPAALISRLCDVLKIAEIIDAVVDWDPAQCHLSPGNRVKALIINLLVDRE
RAAC03682            MFGPVRSYVMGPAPVLARLIDELKWVEIIDEFVPRP--DSKLSVGLRTKALLVNIGTNRE
                         .:*  *  ::  :  *: .*       .. ::*  *  ***::*:    .  :

ref|ZP_01695687.1|   PLYKVHEFYQNLDSEMLF--DTSVSPDQLNDDALGRALDYLYEA-EAWKVYSTLALKTLK
ref|ZP_01695982.1|   PLYKVHEFYQNLDSEMLF--DTSVSPDQLNDDALGRALDYLYEA-EAWKVYSTLALKALK
ref|ZP_01695971.1|   PLYKVHEFYQNLDSEMLF--DTSISPDQLNDDALGRALDYLYKA-EAWKVYSTLALKALK
ref|ZP_01695655.1|   PLYKVHEFYQNLDSEMLF--DTSISPDQLNDDALGRALDYLYKA-EAWKVYSTLALKALK
ref|YP_430569.1|     ALYHVERFYENQDLEVLFGAEQQVRPEDFNDDALGRALDKLFTSGQLKKLFSSIALTAAA
RAAC03682            ALYRVEEFYAQRDVEVLLG--SGVSADDLHDDALARALDALYDA-GLEALYARIALHTLR
                      .**:*..**  : *  *:*:      :  .:::.:****.**** *: :   ::: :** :

ref|ZP_01695687.1|   KLNLP-----IGILHNDTTSISVYGEYKQPKEDGLQITYGYSKAHRPDLKQIVLGMGVTP
ref|ZP_01695982.1|   KLNLP-----IGILHNDTTSISVYGEYKQPKEDGLQITYGYSKAHRPDLKQIVLGMGVTP
ref|ZP_01695971.1|   KLNLP-----IGVLHNDTTSISVYGEYKQPKEDGLQITYGYSKAHRPDLKQIVLGMGVTP
ref|ZP_01695655.1|   KLNLP-----IGVLHNDTTSISVYGEYKQPKEDGLQITYGYSKAHRPDLKQIVLGMGVTP
ref|YP_430569.1|     THNVS-----IAGIHVDTTSISVQGAYDG--EGDLDITFGFSKDHRPDLKQFLIGLTVNR
RAAC03682            RLRVLSDSNELIPIHADTTSLSMTGEYLD--QTAFRIDRGFSKDHRPDLKQIVFGL-CTV
                       .:       :  :* ****:*:  *  *    :  :   *   *:**  *******:::*.  .

ref|ZP_01695687.1|   ERIPILAKVENGNTSDKSWNVEFIQKMRKILSHEDWKNLIYQADSALITTENLAEIQQQN
ref|ZP_01695982.1|   ERIPILAKVENGNTSDKSWNVEFIQKMRKILSHEDWKNLIYQADSALITTENLAEIQQQN
ref|ZP_01695971.1|   ERIPILAKVENGNTSDKSWNVEFIQKMRKILSHEDWKNLIYQADSALITTENLAEIQQQN
ref|ZP_01695655.1|   ERIPILAKVENGNTSDKSWNVEFIQKMRKILSHEDWKNLIYQADSALITTENLAEIQQQN
ref|YP_430569.1|     DGLPILAQSLDGNSSDKSWYPQVIEELVQTFKPEKLKEVIFVADCALVTKDNLALLVQEE
RAAC03682            HGLGLCANVNPGNLDDHTWNFENIQQLLSQLDEETRKRSVYVADAALVTKDNLELLAEED
                     . :  : *:    **  .*::*   :  *:::  .  :.  * .  *:.  **.**:*..** :   :::

ref|ZP_01695687.1|   -----LSFISRLPDTFGLSTELKKEAWLLNN-WERVGSLSNKKDAAIYQIQAFERQIQNL
ref|ZP_01695982.1|   -----LSFISRLPDTFGLSTELKKEAWLLNN-WERVGSLSNKKDAAIYQIQAFERQIQNL
ref|ZP_01695971.1|   -----LSFISRLPDTFGLSTELKKEAWLLNN-WERVGSLSNKKDAAIYQIQAFERQIQNL
ref|ZP_01695655.1|   -----LSFISRLPDTFGLSTELKKEAWLLNN-WERVGSLSNKKDAAIYQIQAFERQIQNL
ref|YP_430569.1|     GNKPALQFISLLPENFGLNKEIKAEAFRTGT-WQEIGKLSPKKDAACYKSQSFVREIDGR
RAAC03682            -----FHFISRLPGTYKLSEDLKRAAWEKENSWKEVGRLAEAEDSAHYRIQAFRRTLYGR
                          : *** **  .: *.  ::*  *:      .  *::.:*  *:   :*:* *: *:* *  :  .

ref|ZP_01695687.1|   PYRFLVVHSNNLDQRKEKTLNRAIEKEEIQLKKEIEKLSKVIFHCKEDALEAIQSFKKKQ
ref|ZP_01695982.1|   PYRFLVVHSNNLDQRKEKTLNRAIEKEEIQLKKEIEKLSKVIFHCKEDALEAIQSFKKKQ
ref|ZP_01695971.1|   PYRFLVVHSNNLDQRKEKTLNRAIEKEEIKLKKEIEKLSKVIFHCKEDALEAIQSFKKKQ
ref|ZP_01695655.1|   PYRFLVVHSNNLDQRKEKTLNRAIEKEEIQLKKEIEKLSKVIFHCKEDALEAIQSFKKKQ
ref|YP_430569.1|     DYRLIVVHSTTLDKRKENSLLKKWAKQREVLEKAAKDLSRRPFACKADARKAIELFLREY
RAAC03682            TYRFVVVRSSSLDTRKERKLKEVLKREKAALEKAAKAMSQNVYSCEQDAQMAMQTFMHEH
                     **::**:*..** ***..*    .   ::.   *:*     : :*:    : *: ** *:: *  ::

ref|ZP_01695687.1|   KASYFCYKLNVQMSDQPIKRKKRGRPKKDEQTK-REQIYQIQLESFEKDHDFIENKKKML
ref|ZP_01695982.1|   KASYFCYKLNVQMSDQPIKRKKRGRPKKDEQTK-REQIYQIQLESFEKDHDFIENKKKML
ref|ZP_01695971.1|   KASYFCYKLNVQMSDQPIKRKKRGRPKKDEQTK-REQIYQIQLESFEKDHDFIENKKRML
ref|ZP_01695655.1|   KASYFCYKLNVQMSDQPIKRKKRGRPKKDEQTK-REQIYQIQLESFEKDHDFIENKKKML
ref|YP_430569.1|     R-----------------------------------------------------------
RAAC03682            RATLHPISARICAEQVQAKRARRGRPRKDDPPPPVHTQYRVEVAILPPSEERVQQWREKE
                                                                                 :

ref|ZP_01695687.1|   STFVLITNKLDEETLSNQEVLRVYKGQSAAETRFRLIKDSQMIDAIYLKTPERVEALGIV
ref|ZP_01695982.1|   STFVLITNKLDEETLSNQEVLRVYKGQSAAETRFRLIKDSQMIDAIYLKTPERVEALGIV
ref|ZP_01695971.1|   STFVLITNKLDEETLSNQEVLRVYKGQSAVETRFRLIKDSQMIDAIYLKTPERVEALGIV
ref|ZP_01695655.1|   STFVLITNKLDEETLSNQEVLRVYKGQSAAETRFRLIKDSQMIDAIYLKTPERVEALGIV
ref|YP_430569.1|     ------------------------------------------------------------
RAAC03682            ATFVLITDIRDDQRVSDEQILRLYKEQHEVEARFRYLKSPYHVGPIYLHKPTRVKAFGFV
``` continued →

FIG. 104 continued

```
ref|ZP_01695687.1|        YVMALLIYGILEYRVRKELKEKNLSLILKGKRKLYQPTGQALLEQLEDITVILINQNQQK
ref|ZP_01695982.1|        YVMALLIYGILEYRVRKELKEKNLSLILKGKRKLSQPTGQALLEQLEDITVILINQNQQK
ref|ZP_01695971.1|        YVMALLIYGILEYRVRKELKEKNLSLILKGKRKLYQPTGQALLEQLEDITVILINQNRQK
ref|ZP_01695655.1|        YVMALLIYGILEYRVRKELKEKNLSLILKGKRKLYQPTGQALLEQLEDITVILINQNRQK
ref|YP_430569.1|          ------------------------------------------------------------
RAAC03682                 MLLSLLLYSVLEYLIREKMKRETEPLMLPGNRKSFRPTGLAILEMLDGVTTVHRQVGDTW ref|ZP_01695687.1|        IRLLPDNIDSQAKKIIELCGYDLSIY-------
ref|ZP_01695982.1|        IRLLPDNIDSQAKKIIELCGYDLSIY-------
ref|ZP_01695971.1|        LRLLPDNIDSQAKKIIELCGYDLSIY-------
ref|ZP_01695655.1|        LRLLPDNIDSQAKKIIELCGYDLSIY-------
ref|YP_430569.1|          ---------------------------------
RAAC03682                 QRVPATPHNPQIMRVLKLLNMDLSIYTEAQKTA
```

FIG. 105

```
ref|ZP_01695687.1|    ---------VGPSQLLSKLCDEIELEKTINDLVKWDSVRCHISPGTRIKALVLNILCSGK
ref|ZP_01695982.1|    ---------VGPSQLLSKLCDEIELEKTINDLVKWDSVRCHISPGTRIKALVLNILCSGK
ref|ZP_01695971.1|    ---------VGPSQLLSKLCDEIELEKTINNLVKWDSVRCHISPGTRIKALVLNILCSGK
ref|ZP_01695655.1|    -------------PQSCKLCDEIELEKTINNLVKWDSVRCHISPGTRIKALVLNILCSGK
ref|YP_430569.1|      ----MRFFRAGPAALISRLCDVLKIAEIIDAVVDWDPAQCHLSPGNRVKALIINLLVDRE
RAAC03770             MFGPVRSYVMGPAPVLARLIDELKWVEIIDEFVPRP--DSKLSVGLRTKALLVNIGTNRE
                                      .:* *  ::   : *:  .*     .::* * * ***::*:   . :

ref|ZP_01695687.1|    PLYKVHEFYQNLDSEMLF--DTSVSPDQLNDDALGRALDYLYEA-EAWKVYSTLALKTLK
ref|ZP_01695982.1|    PLYKVHEFYQNLDSEMLF--DTSVSPDQLNDDALGRALDYLYEA-EAWKVYSTLALKALK
ref|ZP_01695971.1|    PLYKVHEFYQNLDSEMLF--DTSISPDQLNDDALGRALDYLYKA-EAWKVYSTLALKALK
ref|ZP_01695655.1|    PLYKVHEFYQNLDSEMLF--DTSISPDQLNDDALGRALDYLYKA-EAWKVYSTLALKALK
ref|YP_430569.1|      ALYHVERFYENQDLEVLFGAEQQVRPEDFNDDALGRALDKLFTSGQLKKLFSSIALTAAA
RAAC03770             ALYRVEEFYAQRDVEVLLG--SGVSADDLHDDALARALDALYDA-GLEALYARIALHTLR
                       .**:*..**  : * *:*:       : .:::****.**** *: :      :::  :**  :

ref|ZP_01695687.1|    KLNLP-----IGILHNDTTSISVYGEYKQPKEDGLQITYGYSKAHRPDLKQIVLGMGVTP
ref|ZP_01695982.1|    KLNLP-----IGILHNDTTSISVYGEYKQPKEDGLQITYGYSKAHRPDLKQIVLGMGVTP
ref|ZP_01695971.1|    KLNLP-----IGVLHNDTTSISVYGEYKQPKEDGLQITYGYSKAHRPDLKQIVLGMGVTP
ref|ZP_01695655.1|    KLNLP-----IGVLHNDTTSISVYGEYKQPKEDGLQITYGYSKAHRPDLKQIVLGMGVTP
ref|YP_430569.1|      THNVS-----IAGIHVDTTSISVQGAYDG--EGDLDITFGFSKDHRPDLKQFLIGLTVNR
RAAC03770             RLRVLSDSNELIPIHADTTSLSMTGEYLD--QTAFRIDRGFSKDHRPDLKQIVFGL-CTV
                             .:        :   :* ****:*: * *    :   : *   *:** ******:::*:  .

ref|ZP_01695687.1|    ERIPILAKVENGNTSDKSWNVEFIQKMRKILSHEDWKNLIYQADSALITTENLAEIQQQN
ref|ZP_01695982.1|    ERIPILAKVENGNTSDKSWNVEFIQKMRKILSHEDWKNLIYQADSALITTENLAEIQQQN
ref|ZP_01695971.1|    ERIPILAKVENGNTSDKSWNVEFIQKMRKILSHEDWKNLIYQADSALITTENLAEIQQQN
ref|ZP_01695655.1|    ERIPILAKVENGNTSDKSWNVEFIQKMRKILSHEDWKNLIYQADSALITTENLAEIQQQN
ref|YP_430569.1|      DGLPILAQSLDGNSSDKSWYPQVIEELVQTFKPEKLKEVIFVADCALVTKDNLALLVQEE
RAAC03770             HGLGLCANVNPGNLDDHTWNFENIQQLLSQLDEETRKRSVYVADAALVTKDNLELLAEED
                       .  : : *:    ** .*:;* :  *:::  . :. *  *. :: **.**:*.:**   :  :::

ref|ZP_01695687.1|    -----LSFISRLPDTFGLSTELKKEAWLLNN-WERVGSLSNKKDAAIYQIQAFERQIQNL
ref|ZP_01695982.1|    -----LSFISRLPDTFGLSTELKKEAWLLNN-WERVGSLSNKKDAAIYQIQAFERQIQNL
ref|ZP_01695971.1|    -----LSFISRLPDTFGLSTELKKEAWLLNN-WERVGSLSNKKDAAIYQIQAFERQIQNL
ref|ZP_01695655.1|    -----LSFISRLPDTFGLSTELKKEAWLLNN-WERVGSLSNKKDAAIYQIQAFERQIQNL
ref|YP_430569.1|      GNKPALQFISLLPENFGLNKEIKAEAFRTGT-WQEIGKLSPKKDAACYKSQSFVREIDGR
RAAC03770             -----FHFISRLPGTYKLSEDLKRAAWEKENSWKEVGRLAEAEDSAHYRIQAFRRTLYGR
                                : *** **  .: *. ::*   *:     . *:.:* *:   :*:* *:  *;* *  : .

ref|ZP_01695687.1|    PYRFLVVHSNNLDQRKEKTLNRAIEKEEIQLKKEIEKLSKVIFHCKEDALEAIQSFKKKQ
ref|ZP_01695982.1|    PYRFLVVHSNNLDQRKEKTLNRAIEKEEIQLKKEIEKLSKVIFHCKEDALEAIQSFKKKQ
ref|ZP_01695971.1|    PYRFLVVHSNNLDQRKEKTLNRAIEKEEIKLKKEIEKLSKVIFHCKEDALEAIQSFKKKQ
ref|ZP_01695655.1|    PYRFLVVHSNNLDQRKEKTLNRAIEKEEIQLKKEIEKLSKVIFHCKEDALEAIQSFKKKQ
ref|YP_430569.1|      DYRLIVVHSTTLDKRKENSLLKKWAKQREVLEKAAKDLSRRPFACKADARKAIELFLREY
RAAC03770             TYRFVVVRSSSLDTRKERKLKEVLKREKAALEKAAKAMSQNVYSCEQDAQMAMQTFMHEH
                       **:;**:*..** ***..*    . ::.   *:*    :  :*:   *: **  *::  *  ::

ref|ZP_01695687.1|    KASYFCYKLNVQMSDQPIKRKKRGRPKKDEQTK-REQIYQIQLESFEKDHDFIENKKKML
ref|ZP_01695982.1|    KASYFCYKLNVQMSDQPIKRKKRGRPKKDEQTK-REQIYQIQLESFEKDHDFIENKKKML
ref|ZP_01695971.1|    KASYFCYKLNVQMSDQPIKRKKRGRPKKDEQTK-REQIYQIQLESFEKDHDFIENKKRML
ref|ZP_01695655.1|    KASYFCYKLNVQMSDQPIKRKKRGRPKKDEQTK-REQIYQIQLESFEKDHDFIENKKKML
ref|YP_430569.1|      R-----------------------------------------------------------
RAAC03770             RATLHPISARICAEQVQAKRARRGRPRKDDPPPPVHTQYRVEVAILPPSEERVQQWREKE
                       :

ref|ZP_01695687.1|    STFVLITNKLDEETLSNQEVLRVYKGQSAAETRFRLIKDSQMIDAIYLKTPERVEALGIV
ref|ZP_01695982.1|    STFVLITNKLDEETLSNQEVLRVYKGQSAAETRFRLIKDSQMIDAIYLKTPERVEALGIV
ref|ZP_01695971.1|    STFVLITNKLDEETLSNQEVLRVYKGQSAVETRFRLIKDSQMIDAIYLKTPERVEALGIV
ref|ZP_01695655.1|    STFVLITNKLDEETLSNQEVLRVYKGQSAAETRFRLIKDSQMIDAIYLKTPERVEALGIV
ref|YP_430569.1|      ------------------------------------------------------------
RAAC03770             ATFVLITDIRDDQRVSDEQILRLYKEQHEVEARFRYLKSPYHVGPIYLHKPTRVKAFGFV
``` continued →

FIG. 105 continued

```
ref|ZP_01695687.1|    YVMALLIYGILEYRVRKELKEKNLSLILKGKRKLYQPTGQALLEQLEDITVILINQNQQK
ref|ZP_01695982.1|    YVMALLIYGILEYRVRKELKEKNLSLILKGKRKLSQPTGQALLEQLEDITVILINQNQQK
ref|ZP_01695971.1|    YVMALLIYGILEYRVRKELKEKNLSLILKGKRKLYQPTGQALLEQLEDITVILINQNRQK
ref|ZP_01695655.1|    YVMALLIYGILEYRVRKELKEKNLSLILKGKRKLYQPTGQALLEQLEDITVILINQNRQK
ref|YP_430569.1|      ------------------------------------------------------------
RAAC03770             MLLSLLLYSVLEYLIREKMKRETEPLMLPGNRKSFRPTGLAILEMLDGVTTVHMQVGDTW ref|ZP_01695687.1|    IRLLPDNIDSQAKKIIELCGYDLSIY-------
ref|ZP_01695982.1|    IRLLPDNIDSQAKKIIELCGYDLSIY-------
ref|ZP_01695971.1|    LRLLPDNIDSQAKKIIELCGYDLSIY-------
ref|ZP_01695655.1|    LRLLPDNIDSQAKKIIELCGYDLSIY-------
ref|YP_430569.1|      ---------------------------------
RAAC03770             QRVPATPHNPQIMRVLKLLNMDLSIYTEAQKTA
```

FIG. 106

```
ref|YP_001666203.1|     ------------------------------------------------------------
ref|YP_001512589.1|     ------------------------------------------------------------
ref|NP_842969.1|        EINTEGRASEFAMILYBACILLUSANTHRACISSTRAREFZPPRPHAGELAMBDABASIT
ref|ZP_02596019.1|      ------------------------------------------------------------
ref|YP_430640.1|        ------------------------------------------------------------
RAAC02738               ------------------------------------------------------------ ref|YP_001666203.1|     ------------------------------------------------------------
ref|YP_001512589.1|     ------------------------------------------------------------
ref|NP_842969.1|        E-SPECIFICRECMBINASEPHAGEINTEGRASEFAMILYBACILLUSANTHRACISSTR
ref|ZP_02596019.1|      ------------------------------------------------------------
ref|YP_430640.1|        ------------------------------------------------------------
RAAC02738               ------------------------------------------------------------ ref|YP_001666203.1|     ------------------------------------------------------------
ref|YP_001512589.1|     ------------------------------------------------------------
ref|NP_842969.1|        AREFZPPRPHAGELAMBDABASITE-SPECIFICRECMBINASEPHAGEINTEGRASEFA
ref|ZP_02596019.1|      ------------------------------------------------------------
ref|YP_430640.1|        ------------------------------------------------------------
RAAC02738               ------------------------------------------------------------ ref|YP_001666203.1|     ------------------------------------------------------------
ref|YP_001512589.1|     ------------------------------------------------------------
ref|NP_842969.1|        MILYBACILLUSANTHRACISSTRAREFZPPRPHAGELAMBDABASITE-SPECIFICRE
ref|ZP_02596019.1|      ------------------------------------------------------------
ref|YP_430640.1|        ------------------------------------------------------------
RAAC02738               ------------------------------------------------------------ ref|YP_001666203.1|     ------------------------------------------------------------
ref|YP_001512589.1|     ------------------------------------------------------------
ref|NP_842969.1|        CMBINASEPHAGEINTEGRASEFAMILYPRTEINBACILLUSANTHRACISTSIANKVSK
ref|ZP_02596019.1|      ------------------------------------------------------------
ref|YP_430640.1|        ------------------------------------------------------------
RAAC02738               ------------------------------------------------------------ ref|YP_001666203.1|     ------------------------------------------------------------
ref|YP_001512589.1|     ------------------------------------------------------------
ref|NP_842969.1|        II-IGBAAPPRPHAGELAMBDABASITE-SPECIFICRECMBINASEPHAGEINTEGRAS
ref|ZP_02596019.1|      ------------------------------------------------------------
ref|YP_430640.1|        ------------------------------------------------------------
RAAC02738               ------------------------------------------------------------ ref|YP_001666203.1|     ------------------------------------------------------------
ref|YP_001512589.1|     ------------------------------------------------------------
ref|NP_842969.1|        EFAMILYBACILLUSANTHRACISSTRAMESGBAATPRPHAGELAMBDABASITE-SPEC
ref|ZP_02596019.1|      ------------------------------------------------------------
ref|YP_430640.1|        ------------------------------------------------------------
RAAC02738               ------------------------------------------------------------ ref|YP_001666203.1|     ------------------------------------------------------------
ref|YP_001512589.1|     ------------------------------------------------------------
ref|NP_842969.1|        IFICRECMBINASEPHAGEINTEGRASEFAMILYBACILLUSANTHRACISSTRAMESAN
ref|ZP_02596019.1|      ------------------------------------------------------------
ref|YP_430640.1|        ------------------------------------------------------------
RAAC02738               ------------------------------------------------------------
``` continued →

FIG. 106 continued

```
ref|YP_001666203.1|     ------------------------------------------------------------
ref|YP_001512589.1|     ------------------------------------------------------------
ref|NP_842969.1|        CESTRGBAATPRPHAGELAMBDABASITE-SPECIFICRECMBINASEPHAGEINTEGRA
ref|ZP_02596019.1|      ------------------------------------------------------------
ref|YP_430640.1|        ------------------------------------------------------------
RAAC02738               ------------------------------------------------------------ ref|YP_001666203.1|     ------------------------------------------------------------
ref|YP_001512589.1|     ------------------------------------------------------------
ref|NP_842969.1|        SEFAMILYBACILLUSANTHRACISSTRSTERNEGBEDRPRPHAGELAMBDABASITE-S
ref|ZP_02596019.1|      ------------------------------------------------------------
ref|YP_430640.1|        ------------------------------------------------------------
RAAC02738               ------------------------------------------------------------ ref|YP_001666203.1|     ------------------------------------------------------------
ref|YP_001512589.1|     ------------------------------------------------------------
ref|NP_842969.1|        PECIFICRECMBINASEPHAGEINTEGRASEFAMILYBACILLUSANTHRACISSTRAGB
ref|ZP_02596019.1|      ------------------------------------------------------------
ref|YP_430640.1|        ------------------------------------------------------------
RAAC02738               ------------------------------------------------------------ ref|YP_001666203.1|     ------------------------------------------------------------
ref|YP_001512589.1|     ------------------------------------------------------------
ref|NP_842969.1|        EDRPRPHAGELAMBDABASITE-SPECIFICRECMBINASEPHAGEINTEGRASEFAMIL
ref|ZP_02596019.1|      ------------------------------------------------------------
ref|YP_430640.1|        ------------------------------------------------------------
RAAC02738               ------------------------------------------------------------ ref|YP_001666203.1|     ------------------------------------------------------------
ref|YP_001512589.1|     ------------------------------------------------------------
ref|NP_842969.1|        YBACILLUSANTHRACISSTRAGBEDRPRPHAGELAMBDABASITE-SPECIFICRECMB
ref|ZP_02596019.1|      ------------------------------------------------------------
ref|YP_430640.1|        ------------------------------------------------------------
RAAC02738               ------------------------------------------------------------ ref|YP_001666203.1|     ------------------------------------------------------------
ref|YP_001512589.1|     ------------------------------------------------------------
ref|NP_842969.1|        INASEPHAGEINTEGRASEFAMILYBACILLUSANTHRACISSTRASCRESIGNIFICAN
ref|ZP_02596019.1|      ------------------------------------------------------------
ref|YP_430640.1|        ------------------------------------------------------------
RAAC02738               ------------------------------------------------------------ ref|YP_001666203.1|     ----------------------------YSIVVDIGRDEN-GKRKQKWISGFKTKKEAEK
ref|YP_001512589.1|     -----------------------KKNHKWYIVVDS-IDEN-GKRKRKWISGFNTQKEAEK
ref|NP_842969.1|        CEE-IDENTITIESPSITIVESGAPSEKWSFTIDIGKDPITGKRKQKTASGFKTKKEAER
ref|ZP_02596019.1|      ------------------TVKKDDKTKTWYFVLTHGKKED-GKPRQFKKRGFKTKQEALK
ref|YP_430640.1|        ----------------------------WTAQITVGIDHE-GKQRRLTLYG-KSKKEVLE
RAAC02738               ---------MTTGRVFSYTTKSNEKKYGYTITITPADPQT-GRYPQVTRKGFKSERAAKS
                                                    :   :        *:  :    * :::: .

ref|YP_001666203.1|     ALAEIIAKIEKNELELTN-LTLGQFLNKWYETHCELKLAPKTLKSYKELIELYFKPYLGD
ref|YP_001512589.1|     KLPEILQQLNTNTFVDTNNITLRDYMQLWLEDYAKPNVAPTTYDKYTYAAN-KVSEILGN
ref|NP_842969.1|        ACNELIHQFNTGSLVDDKNFTLSEYLQEWLENTAKQRVRETTFTNYKRAINSRIIPVLGS
ref|ZP_02596019.1|      ALHELEHSLMTGTYIAPTKMLYGEYLLNQWLEDKQTKVKKQTLQTYRWLVEKHIIPAIGN
ref|YP_430640.1|        KLTQALYQQQNGGFIEPSKITVEQWLNRWLTDYAKPHLRQSTWESYETVLRLHVIPTLGS
RAAC02738               AMMEHLRSLEDTPVVHAKSFTLHEWASRWFADKS-SSLRPWTRRTYHHVLQAYILPELGK
                           :   .         . :   ::            :   *  .*    .  .   :*.
``` continued →

FIG. 106 continued

```
ref|YP_001666203.1|    IELTKLKPVMIQNYYNKLK-ELGLSDTTINYHHRVLKSALKKAVVWQLISKNPCDYVEPP
ref|YP_001512589.1|    MKLQQIKPIHIQQLVNKLN-NSDVTPSTVLSYYRVLNTAINQAVKWQFIQYNPCVAVTPP
ref|NP_842969.1|       HKLKDLKPLHGQRFVKSLI-DEGLSPAYIEYIFIVLKGSLEDAVRWELLFKNPFQHVEIP
ref|ZP_02596019.1|     MELTQLTPMAIQKLYNQLTKEKALSDENIQKVHTLINDSLKKAERWGIISKNPASLVDRP
ref|YP_430640.1|       IPLKKLQPADIQRLYASKL-ESGLSPTRVRYIHVVLHEAMSQARESGLLLQNPTEAAKPP
RAAC02738              MPISKIEARHIQALYRKLS--NRLKPVTVHRIHRVLKTCLLAAVKAGYLDKSPFLNVEPP
                        : .:  .   *     :  .  :  . ::: .: *    : .* . * ref|YP_001666203.1|    KKNKNEITVWSINDVKKAKE--IFKDTPIYLHFMLALYTGMRIGEICGLKWEDIDFNNKT
ref|YP_001512589.1|    RNTKNKMMILDQDEIQILLD--KSKDHVLYPVIVLALLCGLRRGEILGLQWENIDFFSGV
ref|NP_842969.1|       RPRKVVNSTWSIEETKKFLNRTKFENVIYYHLFLLALNTGMRRGEILGLKWKNFDLNEGK
ref|ZP_02596019.1|     KAEKKEIKVWDVKEVQTFLK-HAQSHSRYYIAFLLALTTGMRQGEILGLRWRDVDFETGC
ref|YP_430640.1|       RHPKKKVQPLNPEQVKRFLE--TAKQDPLYPAFLLALGTGLRRGEILGLRWQDLDLQKGI
RAAC02738              EHKTPPKPVLSVNDAFRLLAWLREHRPTSYMAAFLAIHTGMRMGEIAGLQWRDIDLDTGV
                        .  .     ..:             *   .**:   *:* *** **:*.:.*:

ref|YP_001666203.1|    CTVKRQYQQVGGKEIIK-EPKSETSIRVIPLHSDVIEVLKEEKKKQLQNRMLLGEKYNKK
ref|YP_001512589.1|    IHLENNLVMANNESILK-ETKTSTGRRAVDISSNVVEVLKKVKKQKMSYKLLYGSSYHDS
ref|NP_842969.1|       ISVTETLIYDENGFRFT-EPKTHGSKRLISIDQNLCKEFKSYKAKQNEFKLLFGQSYEDN
ref|ZP_02596019.1|     IRITQTLSS-DGKEILP-YTKTKSGSRTVDLPEETIIQLKKHRKLIESEKLEAGSEVYNN
ref|YP_430640.1|       LQVRQSLIRTREGLKFE-EPKTEKSRRQIPLPPSVVAALKRHKAWVNQNKLILGPDYEDH
RAAC02738              IQLERTRYRPKGGQDFLGPPKTFGSRRRIVVTREVVDELRRWK--QSQQEIERESWTPES
                         :    .       :     .*: . * : .       :        .:      .

ref|YP_001666203.1|    YEGYISVWEDGRMKTPEYVSKKFSKILKAYPELPQIRFHDLRHSCASFLVQAGVPMKVVS
ref|YP_001512589.1|    --NFVCTWEDGRPFRPDYIPKAFAKILVS-ANLPKIRFHDLRHTHASILLKSGIHPKVVQ
ref|NP_842969.1|       --DLVFAKETGQPILPRTMTTTFNQFIKK-ADVPQIRFHDLRHTHATILLKLGINPKIVS
ref|ZP_02596019.1|     -WDLVVCTELGTPTNKSNIRRSFNSIIKK-AKIPKIRFHDMRHTHATLLLLQGVNPKIVS
ref|YP_430640.1|       --DLVFPVENGRPRDPKGFAEYFNRLLDK-AGLPHIRLHDLRHTHATLLLLEGVHPKVVQ
RAAC02738              ---FVVRLPNSAPPSPASFNNAIQNARKE-LGLPPVSFHGLRHTHATWLLESGVDLKIVS
                            :          . :          :* : :*.:**: *: *:   *: *:*.

ref|YP_001666203.1|    EILGHSQIGITMDLYSHVLLDSKKEAIKKLEEYLQ---------------
ref|YP_001512589.1|    ERLGHSSISITLDTYSHLVPSLQKSAAEKMATM---------------
ref|NP_842969.1|       ERLGHSSIKTTLDTYSHVTIDMQESAVLKLSEALKS------------
ref|ZP_02596019.1|     ERLGHADVRITLDTYSHLLPSMQKDTAIKFGEML--------------
ref|YP_430640.1|       ERLGHSTVSITLDIYSHILPGLQEKAAERIDGLLQPK-----------
RAAC02738              ERLGHSSITITADIYAHVTDALQREAIEKLQRMMRSRRTNNSGSDDEEDL
                       * ***: :  * * *:*:    :...:  ::
```

FIG. 107

```
ref|YP_001114460.1|        ------------------------------------------------------------
ref|YP_001111555.1|        TRANSPSASEISFAMILYPRTEINDESULFTMACULUMREDUCENSMI-GBABTRANSPS
ref|YP_001112147.1|        ------------------------------------------------------------
ref|YP_001111684.1|        ------------------------------------------------------------
ref|YP_001113963.1|        ------------------------------------------------------------
RAAC02514                  ------------------------------------------------------------ ref|YP_001114460.1|        ------------------------------------------------------------
ref|YP_001111555.1|        ASEISFAMILYPRTEINDESULFTMACULUMREDUCENSMI-GBABTRANSPSASEISFA
ref|YP_001112147.1|        ------------------------------------------------------------
ref|YP_001111684.1|        ------------------------------------------------------------
ref|YP_001113963.1|        ------------------------------------------------------------
RAAC02514                  ------------------------------------------------------------ ref|YP_001114460.1|        ------------------------------------------------------------
ref|YP_001111555.1|        MILYPRTEINDESULFTMACULUMREDUCENSMI-GBABTRANSPSASEISFAMILYPRT
ref|YP_001112147.1|        ------------------------------------------------------------
ref|YP_001111684.1|        ------------------------------------------------------------
ref|YP_001113963.1|        ------------------------------------------------------------
RAAC02514                  ------------------------------------------------------------ ref|YP_001114460.1|        ------------------------------------------------------------
ref|YP_001111555.1|        EINDESULFTMACULUMREDUCENSMI-SCRESIGNIFICANCEE-IDENTITIESPSIT
ref|YP_001112147.1|        ------------------------------------------------------------
ref|YP_001111684.1|        ------------------------------------------------------------
ref|YP_001113963.1|        ------------------------------------------------------------
RAAC02514                  ------------------------------------------------------------ ref|YP_001114460.1|        --------VSRTYKGTDGYAPIFAYLAKEGYCVNTELRQGSEHCQKNTSEFVAESIRYAR
ref|YP_001111555.1|        IVESGAPSVSRTYKGTDGYAPIFAYLAKEGYCVNTELRQGSEHCQKNTSEFVAESIRYAR
ref|YP_001112147.1|        --------VSRTYKGTDGYAPIFAYLAKEGYCVNTELRQGSEHCQKNTSEFVAESIRYAR
ref|YP_001111684.1|        --------VSRTYKGTDGYAPIFAYLAKEGYCVNTELRQGSEHCQKNTSEFVAESIRYAR
ref|YP_001113963.1|        --------VSRTYKGTDGYAPIFAYLAKEGYCVNTELRQGSEHCQKNTSEFVAESIRYAR
RAAC02514                  --------MSRTYKGHDGYAPIFAYLGQEGYVVNVQLREGSTHVQKGTSTFLRESIQYAR
                                   :**** ***** :.: .::** * . *: *:* ref|YP_001114460.1|        KITQLPLLLRMDSGNDSASNIEICLNDDTKADFIIKRNLRKETPEGWLLLAKNNKDIYCQ
ref|YP_001111555.1|        KITQLPLLLRMDSGNDSASNIEICLNDDTKADFIIKRNLRKETPEGWLLLAKNNKDIYCQ
ref|YP_001112147.1|        KITQLPLLLRMDSGNDSASNIEICLNDDTKADFIIKRNLRKETPEGWLLLAKNNKDIYCQ
ref|YP_001111684.1|        KITQLPLLLRMDSGNDSASNIEICLNDDTKADFIIKRNLRKETPEGWLLLAKNNKDIYCQ
ref|YP_001113963.1|        KITQLPLLLRMDSGNDSASNIEICLNDDTKADFIIKRNLRKETPEGWLLLAKNNKDIYCQ
RAAC02514                  QVTELPLLVRLDAGNDSAENIAVCRSQDSRAEFIIKRNLRKESPAAWLEIAQRHG--TCH
                           ::*:****:*:*:*****:**.:**:.*:*:**********:.** :*:..      *:

ref|YP_001114460.1|        E-REGKKVYYGSMMKYKKELKREIRVVYKITERTFGKDGQIFLVPQVEAETYWTSLPDPP
ref|YP_001111555.1|        E-REGKKVYYGSMMKYKKELKREIRVVYKITERTFGKDGQIFLVPQVEAETYWTSLPDPP
ref|YP_001112147.1|        E-REGKKVYYGSMMKYKKELKREIRVVYKITERTFGKDGQIFLVPQVEAETYWTSLPDPP
ref|YP_001111684.1|        E-REGKKVYYGSMMKYKKELKREIRVVYKITERTFGKDGQIFLVPQVEAETYWTSLPDPP
ref|YP_001113963.1|        E-REGKKVYYGSMMKYKKELKREIRVVYKITERTFGKDGQIFLVPQVEAETYWTSLPDPP
RAAC02514                  EPREGKKVYHGSLMCPVKGVSEPVRMVFEVIERTTTADGQILLVPDIEVSAYWTSLPDDP
                           * *.***::* .:*   *:*:::  *    *:.***::*.:*******.* ref|YP_001114460.1|        HVIERLYHEHGTSEQFHSELKTDLDLERLPSGKFDTNNLILHFGVVAYNLLRMIGQSTTR
ref|YP_001111555.1|        HVIERLYHEHGTSEQFHSELKTDLDLERLPSGKFDTNNLILHFGVVAYNLLRMIGQSTTR
ref|YP_001112147.1|        HVIERLYHEHGTSEQFHSELKTDLDLERLPSGKFDTNNLILHFGVVAYNLLRMIGQSTTR
ref|YP_001111684.1|        HVIERLYHEHGTSEQFHSELKTDLDLERLPSGKFDTNNLILHFGVVAYNLLRMIGQSTTR
ref|YP_001113963.1|        HVIERLYHEHGTSEQFHSELKTDLDLERLPSGKFDTNNLILHFGVVAYNLLRMIGQSTTR
RAAC02514                  AVIIRLYHDHAVMEQFHSEIKTDLDAERLPSGKFATNNLVLHFCVAYNLLRVIGQESLK
                           ** ****::*..:****:*:*****.********.****:***.*.******:***:*  : :

ref|YP_001114460.1|        MQHVPLRKQAERRRIRTVIQ-
ref|YP_001111555.1|        MQHVPLRKQAERRRIRTVIQ-
ref|YP_001112147.1|        MQHVPLRKQAERRRIRTVIQ-
ref|YP_001111684.1|        MQHVPLRKQAERRRIRTVIQ-
ref|YP_001113963.1|        MQHVPLRKQAERRRIRTVIQ-
RAAC02514                  RNDAPLRKKAERRRIRTVIRT
                           :..******:********* :
```

FIG. 108

```
ref|YP_001111555.1|       TRANSPSASEISFAMILYPRTEINDESULFTMACULUMREDUCENSMI-GBABTRANSPS
ref|YP_001114460.1|       ------------------------------------------------------------
ref|YP_001111684.1|       ------------------------------------------------------------
ref|YP_001113963.1|       ------------------------------------------------------------
dbj|BAD18231.1|           ------------------------------------------------------------
RAAC02515                 ------------------------------------------------------------ ref|YP_001111555.1|       ASEISFAMILYPRTEINDESULFTMACULUMREDUCENSMI-GBABTRANSPSASEISFA
ref|YP_001114460.1|       ------------------------------------------------------------
ref|YP_001111684.1|       ------------------------------------------------------------
ref|YP_001113963.1|       ------------------------------------------------------------
dbj|BAD18231.1|           ------------------------------------------------------------
RAAC02515                 ------------------------------------------------------------ ref|YP_001111555.1|       MILYPRTEINDESULFTMACULUMREDUCENSMI-GBABTRANSPSASEISFAMILYPRT
ref|YP_001114460.1|       ------------------------------------------------------------
ref|YP_001111684.1|       ------------------------------------------------------------
ref|YP_001113963.1|       ------------------------------------------------------------
dbj|BAD18231.1|           ------------------------------------------------------------
RAAC02515                 ------------------------------------------------------------ ref|YP_001111555.1|       EINDESULFTMACULUMREDUCENSMI-SCRESIGNIFICANCEE-IDENTITIESPSIT
ref|YP_001114460.1|       ------------------------------------------------------------
ref|YP_001111684.1|       ------------------------------------------------------------
ref|YP_001113963.1|       ------------------------------------------------------------
dbj|BAD18231.1|           ------------------------------------------------------------
RAAC02515                 ------------------------------------------------------------ ref|YP_001111555.1|       IVESGAPSFEIEQCDEELTTHSGLALIGALLTNTKIKTRLNNTMSAEQKK-PHISNGSVG
ref|YP_001114460.1|       --------FEIEQGDEELTTHSGLALIGALLTNTKIKTRLNNTMSAEQKK-PHISNGSVG
ref|YP_001111684.1|       --------FEIEQGDEELTTHSGLALIGALLTNTKIKTRLNNTMSAEQKK-PHISNGSVG
ref|YP_001113963.1|       --------FEIEQGDEELTTHSGLALIGALLTNTKIKTRLNNTMSAEQKK-PHISNGSVG
dbj|BAD18231.1|           --------VKFILENSDDTLTTHSGLGLIGLLLSXTKFHKRFSSLKVPEIKSSPKILNGDVT
RAAC02515                 --------MRFIEESDEVIVTHSGMTLVGVLLDKTRIGERLNHTRLPGMGK-PNISNEDVA
                                    *:*:.*, :.****: *:* ** :*:: *:.    .  *:* * .* ref|YP_001111555.1|       IAYIGLLCQGKSDFDHIEPFREDNFFAISLNIKETPSSPTLRQRLDMVAKDKQWNNILLE
ref|YP_001114460.1|       IAYIGLLCQGKSDFDHIEPFREDNFFAISLNIKETPSSPTLRQRLDMVAKDKQW------
ref|YP_001111684.1|       IAYIGLLCQGKSDFDHIEPFREDNFFAISLNIKETPSSPTLRQRLDMVAKDKQWNNILLE
ref|YP_001113963.1|       IAYIGLLCQGKSDFDHIEPFREDNFFAISLNIKETPSSPTLRQRLDMVAKDKQW------
dbj|BAD18231.1|           TSYVGLLCQGKNDFDHIEQFRDDPFFYRALDIKLVPSSPTLRQRLDQIAKVTGW------
RAAC02515                 YSYIGLLCQGKTDFDHIEAFRDDEFFTIALQVDNVPSSPTLRQRLDMVAGKSGWESILRE
                           :*:*****,*:  :* **   :*::. ,**********  :*    .  * ref|YP_001111555.1|       ESAGLIKKTNAPLTPVYLCQ------
ref|YP_001114460.1|       --------------------------
ref|YP_001111684.1|       ESAGLIKKTNAPLTPVYLGLENRT--
ref|YP_001113963.1|       --------------------------
dbj|BAD18231.1|           --------------------------
RAAC02515                 ESARLLRALDVTLHPIELGEPAERRT
```

FIG. 109

```
ref|YP_001212947.1|        ------------------------------IKYCLSQWDKLEAFLQDGRLELDNNRSERSIK
ref|YP_431166.1|           ------------------------------INYCLGQWDKLTAFLQDGRLELDNNRSERSIK
ref|YP_754943.1|           ------------------------------ITYCLNQWDALNTFLLDGRLEIDNNRAERSIK
ref|YP_754865.1|           ANCEE-IDENTITIESPSITIVESGAPSITYCLNQWDCLNSFLLDGRLEIDNNRAERSIK
RAAC02530                  ------------------------------MSYCLKQWPKLVRYMEDGHLEIDNNRCERSLK
ref|YP_001318017.1|        ------------------------------ISYSLKCWDKLAAFMKDGRIAIDNNLAERGIK
                                                         :.*.* **   *   :: :: :* .**.:* ref|YP_001212947.1|        PFVIGRKNWLFANTPRGARASAIVYSIVETAKENGLNPFHYLSYLFEKLPNLDTKDENAL
ref|YP_431166.1|           PFVIGRKNWLFANTPRGAKASAITYSIIETAKDNGLNPFQYLIYLFERLPNLDLKDKDAL
ref|YP_754943.1|           PFVIGRKNFLFSNTPRGARGSAIIYSIIETAKENNLKPYDYLVYLFEQLPNVDTSDQTAV
ref|YP_754865.1|           PFVIGRKNWLFTNTPRGARGSAIIYSVIETAKENNLKPYNYMFYLFEQLPNVDTGDQAAI
RAAC02530                  PFVIGRKNWLFANTPRGARASAIAYSIVETAKENGLNPFAYLEYLFEKLPNMDTDDKTAM
ref|YP_001318017.1|        PFVLGRKNYLFAKSPKGATASALCYSIIETAKANKLIPFQYLTYLFEQLPNLDIEDPEAL
                           ***:****:**:::*:**  .**: **:*:**** * * *: *: ****:***.*   * *:

ref|YP_001212947.1|        DKLLPWSDSLPSVCRVNK
ref|YP_431166.1|           DQLLPWSASLP-------
ref|YP_754943.1|           DRLMPWSDTLPEGCR---
ref|YP_754865.1|           DRLLPWSDTLP-------
RAAC02530                  AALLPWSETLPAHIRRRK
ref|YP_001318017.1|        DAMLPWAESLPNEVRHK-
                            ::**:  :**
```

FIG. 110

```
ref|YP_001036724.1|    TRANSPSASEMUTATRTYPECLSTRIDIUMTHERMCELLUMATCCGBABNTRANSPSASE
ref|YP_001039064.1|    ------------------------------------------------------------
ref|YP_001039349.1|    ------------------------------------------------------------
RAAC02533              ------------------------------------------------------------
ref|YP_076118.1|       ------------------------------------------------------------
ref|YP_076073.1|       ------------------------------------------------------------ ref|YP_001036724.1|    MUTATRTYPECLSTRIDIUMTHERMCELLUMATCCGBABNTRANSPSASEMUTATRTYPE
ref|YP_001039064.1|    ------------------------------------------------------------
ref|YP_001039349.1|    ------------------------------------------------------------
RAAC02533              ------------------------------------------------------------
ref|YP_076118.1|       ------------------------------------------------------------
ref|YP_076073.1|       ------------------------------------------------------------ ref|YP_001036724.1|    CLSTRIDIUMTHERMCELLUMATCCGBABNTRANSPSASEMUTATRTYPECLSTRIDIUM
ref|YP_001039064.1|    ------------------------------------------------------------
ref|YP_001039349.1|    ------------------------------------------------------------
RAAC02533              ------------------------------------------------------------
ref|YP_076118.1|       ------------------------------------------------------------
ref|YP_076073.1|       ------------------------------------------------------------ ref|YP_001036724.1|    THERMCELLUMATCCGBABNTRANSPSASEMUTATRTYPECLSTRIDIUMTHERMCELLU
ref|YP_001039064.1|    ------------------------------------------------------------
ref|YP_001039349.1|    ------------------------------------------------------------
RAAC02533              ------------------------------------------------------------
ref|YP_076118.1|       ------------------------------------------------------------
ref|YP_076073.1|       ------------------------------------------------------------ ref|YP_001036724.1|    MATCCGBABNTRANSPSASEMUTATRTYPECLSTRIDIUMTHERMCELLUMATCCGBABN
ref|YP_001039064.1|    ------------------------------------------------------------
ref|YP_001039349.1|    ------------------------------------------------------------
RAAC02533              ------------------------------------------------------------
ref|YP_076118.1|       ------------------------------------------------------------
ref|YP_076073.1|       ------------------------------------------------------------ ref|YP_001036724.1|    TRANSPSASEMUTATRTYPECLSTRIDIUMTHERMCELLUMATCCGBABNTRANSPSASE
ref|YP_001039064.1|    ------------------------------------------------------------
ref|YP_001039349.1|    ------------------------------------------------------------
RAAC02533              ------------------------------------------------------------
ref|YP_076118.1|       ------------------------------------------------------------
ref|YP_076073.1|       ------------------------------------------------------------ ref|YP_001036724.1|    MUTATRTYPECLSTRIDIUMTHERMCELLUMATCCSCRESIGNIFICANCEE-IDENTIT
ref|YP_001039064.1|    ------------------------------------------------------------
ref|YP_001039349.1|    ------------------------------------------------------------
RAAC02533              ------------------------------------------------------------
ref|YP_076118.1|       ------------------------------------------------------------
ref|YP_076073.1|       ------------------------------------------------------------ ref|YP_001036724.1|    IESPSITIVESGAPSLDEFVEEFKNRRLEGEYPYLWLDATFPKVREGGRVCSMALVIAVG
ref|YP_001039064.1|    ---------------LDEFVEEFKNRRLEGEYPYLWLDATFPKVREGGRVCSMALVIAVG
ref|YP_001039349.1|    ---------------LDEFVEEFKNRRLEGEYPYLWLDATFPKVREGGRVCSMALVIAVG
RAAC02533              ---------------MDETVQQFKERPLEREYPYVWLDATFPKVREGGRVQSMALVIAIG
ref|YP_076118.1|       ---------------LDEVVEAFRNRPLEGRYPYVWLDAKYEKVRENGRVSSMALVIAMG
ref|YP_076073.1|       ---------------LDEVVQAFRNRPLEGRYPYVWLDAKYVKVRENGRVSSMALVVAVG
                                      :** *: *:;* ** .***:****.: ****.*** *****:*:*
``` continued →

FIG. 110 continued

```
ref|YP_001036724.1|    VNQQGEREILGFDVGMSEDGAFWEEFLRRLVARGLKGVRLVISDAHEGLKAAIKKILTGS
ref|YP_001039064.1|    VNQQGEREILGFDVGMSEDGAFWEEFLRRLVARGLKGVRLVISDAHEGLKAAIKKILTGS
ref|YP_001039349.1|    VNQQGEREILGFDVGMSEDGAFWEEFLRRLVARGLKGVRLVISDAHEGLKAAIKKILTGS
RAAC02533              VSDTGEREVLGFDVGTSEDGAFWTDFLRDLKTRGLRGVRLVVSDAHAGLRQAIAEVLTGA
ref|YP_076118.1|       VREDGEREILGLDVGPSEDGAFWTAFLRQLVARGLKGVLLVISDNHVGLREAIRTVFSGA
ref|YP_076073.1|       VREDGDREILGLDVGPSEDGAFWTAFLRQLVARGLKGVLLAISDSHVGLQEAIRTVLSGA
                       * : *:**:**:*** *******  *** * :***:** *.:** * **: **   :::*:

ref|YP_001036724.1|    AWQRCRVHFMRNVLSQVPKHYQGMVSSIIRTIFAQNDQESAREQLRHVVDELKNRFPKAM
ref|YP_001039064.1|    AWQRCRVHFMRNVLSQVPKHYQGMVSSIIRTIFAQNDQESAREQLRHVVDELKNRFPKAM
ref|YP_001039349.1|    AWQRCRVHFMRNVLSQVPKHYQGMVSSIIRTIFAQNDQESAREQLRHVVDELKKRFPKAM
RAAC02533              TWQRCKVHAIRNVLSQVPKKEQPMMASILRTIFTQPTQDAAREQLRRVVGEFRRRYPKAM
ref|YP_076118.1|       SWQRCRVHFMRNLLGYVPKNLQSMVSAAVRTIFAQPDQQAAKSQLAVVVENLRKQFPRAA
ref|YP_076073.1|       SWQRCRVHFMRNLLSYVPKHWQSMVAAAVRTIFAQPDQQAARRQLAVVADNLRPQFPRAA
                       :**: :**:*. ***: * *::: :****:*  *::*: **  *. ::: ::*:* ref|YP_001036724.1|    KILEEAEEEILAYMAFPREHWAQIHSTNPLERLNREIRRRTDVVCIFPNREAVIRLVGAM
ref|YP_001039064.1|    KILEEAEEEILAYMAFPREHWAQIHSTNPLERLNREIRRRTDVVCIFPNRKAVIRLVGAM
ref|YP_001039349.1|    KILEEAEEEILAYMAFPREHWAQIHSTNPLERLNREIRRRTDVVCIFPNREAVIRLVGAM
RAAC02533              AILADAEEDVLAFMALPFEHWRQICSTNPLERLNREMRRRMNVVGIFPNRDSVVRLVGAI
ref|YP_076118.1|       QLLEDAEEDILAYMAFPTEHWRRLHSTNPLERLNREIGRRTEIVGIFPNREALIRLAGAV
ref|YP_076073.1|       QLLEEAEDDILAYMAFPTEHWRQLHSTNPLERLNREIGRRTDVVGIFPNREAVIRLAGAV
                       :* :**:::**:**:* *** :: ***********: ** ::* *****.:::**.**:

ref|YP_001036724.1|    LMEQNDEWKVG-RRYFSLESMSKITSINEFTLTPVALLHK
ref|YP_001039064.1|    LMEQNDEWKVG-RRYFSLESMSKITSINEFTLTPVALLHK
ref|YP_001039349.1|    LMEQNDEWKVG-RRYFSLESMSKITSINEFTLTPVALLHK
RAAC02533              LQEQHEEWLVS-RRYFSLESMAKLKPQ-QPMLSAQALLQK
ref|YP_076118.1|       MIEQQEEWMTAPRRYFSQASMAKLYAH-DPSLGRPELL--
ref|YP_076073.1|       LIEQQDEWTAAPRRYFSQASMAKLYTS-NQSVSGTDFL--
                       : **::** .. ***** **:*:. .  :   :   :*
```

FIG. 111

```
ref|YP_076118.1|        ------------------------------------------------------------
ref|YP_074958.1|        ------------------------------------------------------------
ref|YP_001036724.1|     TRANSPSASEMUTATRTYPECLSTRIDIUMTHERMCELLUMATCCGBABNTRANSPSASE
ref|YP_001039064.1|     ------------------------------------------------------------
ref|YP_001039349.1|     ------------------------------------------------------------
RAAC02534               ------------------------------------------------------------ ref|YP_076118.1|        ------------------------------------------------------------
ref|YP_074958.1|        ------------------------------------------------------------
ref|YP_001036724.1|     MUTATRTYPECLSTRIDIUMTHERMCELLUMATCCGBABNTRANSPSASEMUTATRTYPE
ref|YP_001039064.1|     ------------------------------------------------------------
ref|YP_001039349.1|     ------------------------------------------------------------
RAAC02534               ------------------------------------------------------------ ref|YP_076118.1|        ------------------------------------------------------------
ref|YP_074958.1|        ------------------------------------------------------------
ref|YP_001036724.1|     CLSTRIDIUMTHERMCELLUMATCCGBABNTRANSPSASEMUTATRTYPECLSTRIDIUM
ref|YP_001039064.1|     ------------------------------------------------------------
ref|YP_001039349.1|     ------------------------------------------------------------
RAAC02534               ------------------------------------------------------------ ref|YP_076118.1|        ------------------------------------------------------------
ref|YP_074958.1|        ------------------------------------------------------------
ref|YP_001036724.1|     THERMCELLUMATCCGBABNTRANSPSASEMUTATRTYPECLSTRIDIUMTHERMCELLU
ref|YP_001039064.1|     ------------------------------------------------------------
ref|YP_001039349.1|     ------------------------------------------------------------
RAAC02534               ------------------------------------------------------------ ref|YP_076118.1|        ------------------------------------------------------------
ref|YP_074958.1|        ------------------------------------------------------------
ref|YP_001036724.1|     MATCCGBABNTRANSPSASEMUTATRTYPECLSTRIDIUMTHERMCELLUMATCCGBABN
ref|YP_001039064.1|     ------------------------------------------------------------
ref|YP_001039349.1|     ------------------------------------------------------------
RAAC02534               ------------------------------------------------------------ ref|YP_076118.1|        ------------------------------------------------------------
ref|YP_074958.1|        ------------------------------------------------------------
ref|YP_001036724.1|     TRANSPSASEMUTATRTYPECLSTRIDIUMTHERMCELLUMATCCGBABNTRANSPSASE
ref|YP_001039064.1|     ------------------------------------------------------------
ref|YP_001039349.1|     ------------------------------------------------------------
RAAC02534               ------------------------------------------------------------ ref|YP_076118.1|        ------------------------------------------------------------
ref|YP_074958.1|        ------------------------------------------------------------
ref|YP_001036724.1|     MUTATRTYPECLSTRIDIUMTHERMCELLUMATCCSCRESIGNIFICANCEE-IDENTIT
ref|YP_001039064.1|     ------------------------------------------------------------
ref|YP_001039349.1|     ------------------------------------------------------------
RAAC02534               ------------------------------------------------------------ ref|YP_076118.1|        ------------------------LEELLRKSGVDDVDFLREGVRVLAQGLMELEVSQQI
ref|YP_074958.1|        ------------------------LEELLRKTGVDDFDFLREGLRVLAQGLMELEVSQRI
ref|YP_001036724.1|     IESPSITIVESGAPSMATNNRMALLEQLSKYVVEKDKDFLKEALTLLINALMDAEVTSII
ref|YP_001039064.1|     ---------------MATNNRMALLEQLSKYVVEKDKDFLKEALTLLINALMDAEVTSII
ref|YP_001039349.1|     ---------------MATNNRMALLEQLSKYVVEKDKDFLKEALTLLINALMDAEVTSII
RAAC02534               ---------------MALLNSFAVLEWIRKMQDEDHIDVLRELMQLVAQFLIDAEAVEKI
                                                ** : :    .. *.*:* : :: : *:: *. . *
``` continued →

FIG. 111 continued

```
ref|YP_076118.1|       GAERYERSSERSNYRNGYRERQWDTRVGTIDLQIPKLRKGSYMPSWLEPRRRAEKALVAV
ref|YP_074958.1|       GADRYERSAERSTYRNGYRERQWDTRVGTIDLQIPKLRKGSYMPSFLEPRRRAEKALVAV
ref|YP_001036724.1|    GAEKYERNNNRNNYRNGYRLREWDTRVGTLQLSIPKLRHGSYFPSLLEPRKMSEKALLNV
ref|YP_001039064.1|    GAEKYERNNNRNNYRNGYRLREWDTRVGTLQLSIPKLRHGSYFPSLLEPRKMSEKALLNV
ref|YP_001039349.1|    GAEKYERNNNRNNYRNGYRLREWDTRVGTLQLSIPKLRHGSYFPSLLEPRKMSEKALLNV
RAAC02534              GAERYERTDSRVTQRNGSRSRTWDTRLGTVDLKIPKLRQGSFFPSLLEPRRRAEQALAAV
                       ::*. .* . *** * * **:::*.***::: **: :*:** * ref|YP_076118.1|       VQEAYIQGVSTRKVDELVQALGMTGVSKSQV
ref|YP_074958.1|       VLEAYVNGVSTRKVDDLVQALGMTGVSKSQV
ref|YP_001036724.1|    VQEAYVHGVSTRKVDELVEALGMKGIDKSEV
ref|YP_001039064.1|    VQEAYVHGVSTRKVDELVEALGMKGIDKSEV
ref|YP_001039349.1|    VQEAYVHGVSTRKVDELVEALGMKGIDKSEV
RAAC02534              IQEAYVKGVSTRKVDDLVRALGLEGISKSEV
                       : ***::********:**.***: *:.**:*
```

FIG. 112

```
ref|YP_148733.1|       ---------------MDMTLTAKIKIYPTAEQAEVLKATLSAYRQACNAVSVVIFDT-KVL
ref|YP_146224.1|       ---------------MDMTLTAKIKIYPTAEQAEVLKATLSAYRQACNAVSVVIFDT-KVL
ref|ZP_02171259.1|     ---------------MKLTLTAKTKIVPTVEQEDTLRKTAHAYRDACNAVSEVVFDE-NTL
ref|NP_977687.1|       ---------------TITAKIQIHVSDNQAESLKITNAYRKACNWLSKHIFET-KNL
RAAC02562              MSAIPPPSEGEVNGMELTRTVRVRLDPTPEQASALALTIEANRQALDYVSRIAFER-RIR
ref|ZP_02619781.1|     ---------------MEIVRTLKIKLNINQEEKNMINSTLEAFLKALNYASQVAFNNGEIT
                                      .*  : ::    .  ::   . :   *    *  .*  :    *     *:  .

ref|YP_148733.1|       AQAKLHDMTYRLLRSNYALRSQMAQSVIKTVIARYRSLKSNGHEWTLVRFKKPEYDLVWN
ref|YP_146224.1|       AQAKLHDMTYRLLRSNYALRSQMAQSVIKTVIARYRSLKSNGHEWTLVRFKKPEYDLVWN
ref|ZP_02171259.1|     VQAKLHKRTYRELRSTFGLKSQMAQSALKTVIATYKTNQSNGHFRSQVQFKKPQFDLVFN
ref|NP_977687.1|       NQVNLNNLYYSDLRNQFRLKSQMAQSVMKTVIARYKSAKSNGHEWSLIDFKLAEYDLVWN
RAAC02562              NAFDLQRIVYRTIRTRFGLRAQMACTVCRTVAAVYKSMKSNGNANALAKFKHAKPVFQWN
ref|ZP_02619781.1|     NKPKLQKLVYDDLRTKFNLKSQMAVNTCTTVCSSYVTQHSNKVFNSLAVYKSPKAIYSYG
                         .*:     *    :*. : *::***  ..  **  :  *    :**    :   :*  .:         :.

ref|YP_148733.1|       RDYSIVQG--LFSVNTLEGRIKVPFEPKG-MEPYFDGSWTFGTAKLVYKHNKFFLHIPMT
ref|YP_146224.1|       RDYSIVQG--LFSVNTLEGRIKVSFEPKG-MEPYFDGSWTFGTAKLVYKHNKFFLHIPMT
ref|ZP_02171259.1|     RDYSLTKG--LFSVNTLEGRIKVPFYTEG-LEPYFDGTWTFGTAKLVHKYGKWFLHIPVS
ref|NP_977687.1|       RDYSLTKN--QFSVNTLEGRLKLNYERKA-MKKYFNSTWKFGTAKLVHKYKKWFLHIPMT
RAAC02562              KDVYLRSG--LAYITTLDGRLRIPFRVEPPYQRYLQDGWTFGAAELVQKRHGWFLHVSVS
ref|ZP_02619781.1|     RDYSFLNDGQTISINTIAKRIKVHFKVNNYFKKYLTKEWSFGSLEIVERENSYYAHITVS
                       :**  :  ..     :.*:  *:::  :   *:   *.**:  ::*  :   *  *:..:

ref|YP_148733.1|       KTIPTVDEHNIRQVVGVDVGVNFLAAAYDSQGKTCFFNGRKIKHMRAKYKRMRKTLQQKG
ref|YP_146224.1|       KTIPTVDEHNIRQVVGVDVGVNFLAVAYDSQGKTIFFNGRKIKHMRAKYKRMRKTLQQKG
ref|ZP_02171259.1|     KDVQEANLDNINQVVGIDMGVNFTATTYDSNGQTRFFNGKQIKHKRAKYKQMRKELQQKQ
ref|NP_977687.1|       KEYQTLDFADVNNIVGVDLGINFLATTYDSQSKTTFYNGNIVKHKRGKFKATRKQLQTRQ
RAAC02562              KTVPDP-VGDFDAVIGVDQGMRFLVTAS-CGNEVMFTRGGKVKQTRLRYVRLRASLQRKG
ref|ZP_02619781.1|     KEVQEKPLNEFKNIIGIDLGQNFIATFYDSKGKIKFFKGRYLKDMRAKYTRLRKQLQRKG
                       *                :.  ::*:* * .*   ..    ..:   *  .* :*.  *  ::     *  ** :

ref|YP_148733.1|       TASARRKLKTIGQRENRWMTDVNHAVTKALV---RQYGERTLFVLEDLTGIREKTERVRI
ref|YP_146224.1|       TASARRKLKTIGQRENRWMTDVNHAVTKALV---RQYGERTLFVLEDLTGIREKTERVRI
ref|ZP_02171259.1|     TPSARRKLKKIGSRENRWMQNINYCISKALV---FQYGKDTLFVMEDLTGVRNATEKVRV
ref|NP_977687.1|       TPSSRKKIKQIGSRENRYVTDVNHQITKALV---EAYPRGTMFVLEDLTGVRSATEKVRV
RAAC02562              TRSAKRRLKAIGRRESREMTDVNHQIAKAVVRFAKAQGQRPLIVLEDLTGS-NLSVRFRM
ref|ZP_02619781.1|     TYNAHKKIVTINQREQRTMTYINHKISKEIV--EYAKQNNAIIAMENLTGI-NLSCKVKK
                       *  .:::::    *.  **.*   :    :*:  ::* :*            . .::*:*** .  :  :.:

ref|YP_148733.1|       HDRYETVSWAFYQFRQLLEYKARLHGSKVMVVAPHYTSLTCPKCGHTEKANRNKRTHTFC
ref|YP_146224.1|       HDRYETVSWAFYQFRQMLEYKARLHGSKVIVVAPHYTSLTCPKCGHTEKANRKKRTHTFC
ref|ZP_02171259.1|     KDRYQTVSWSFNDLRQKIAYKAQKTGALGIAVDPGYTSQTCPKCGHTEKANRNKKTHTFC
ref|NP_977687.1|       KNRYVSVSWAFYQFRQMLEYKAELNGQKVIVVDPKYTSQTCPKCGNIEKANRNKKLHTFK
RAAC02562              KDQYWRMSWAFRQLADFIRYKAEEVGIAVMVIDPTGTSETCPKCGHCEAANRSRKRHEFK
ref|ZP_02619781.1|     DNRYYRVSWAFNQLQQFIEYKAVQAGLKVIYINPKYTSQTCPICGHIHKDNRNKKLHIFK
                         .::*  :**:* ::   :  :  ***   *    :  *   * : . .::  * * ref|YP_148733.1|       CRTCGYTSNDDRIGAMNLQRKGIE--------
ref|YP_146224.1|       CRTCGYTSNDDRIGAMNLQRKGIE--------
ref|ZP_02171259.1|     CQTCQYTSNDDRIGAMNLQRKGI---------
ref|NP_977687.1|       CKNCQYQSNDDRISAMNLHRKGIK--------
RAAC02562              CKKCGYRCNDDLAASRVIAQKGLECLRQSQSA
ref|ZP_02619781.1|     CRACGCTLNDDLIGAKNIQHKGYD--------
                       *: *    ***  .:  :   : :**
```

FIG. 113

```
ref|YP_516922.1|      ---MFARIKTAYNRDGSPRRYLQIVESRREEGKVRQKVLCNLGRVEDLQNGKLDDLIRSL
ref|YP_520815.1|      ------------------------------------------------------------
ref|YP_519534.1|      ---MFARIKTAYNRDGSPRRYLQLVESRREEGKVRQKVLCNLGRVEDLQNGKLDDLIRSL
ref|ZP_01372264.1|    ---MFARIKTAYNRDGSPRRYLQLVESRREEGKVRQKVLCNLGRVEDLQNGKLDDLIRSL
ref|ZP_01370818.1|    ---MFARIKTAYNRDGSPRRYLQLVESRREEGKVRQKVLCNLGRVEDLQNGKLDDLIRSL
RAAC03229             MILLFAQIVSTKKPDGKTYKYLHIVESYREGRTVKKRRVASLGNISQYSEREIEQIIRTL ref|YP_516922.1|      AKFSDKLAVVDAAEDLFADWSKEYGPSMVFNRLWDNLGLHKILDGLFSERELSIDVREAI
ref|YP_520815.1|      ------------------------------LWDNLGLHKILDGLFSERELSIDVREAI
ref|YP_519534.1|      AKFSDTLAVVDAAEDLFADWSKEFGPSMVFRRLWENLGLHKILSGLFNERELSIDVQEAI
ref|ZP_01372264.1|    AKFSDTLAVVDAAEDLFADWSKEFGPSMVFRRLWENLGLHKIFAGLFNERDLSIDVQEAI
ref|ZP_01370818.1|    AKFSDTLAVVDAAEDLFADWSKEFGPSMVFRRLWENLGLHTILDGLFNERDLSIDVQEAI
RAAC03229             ESLLQHRTTG-SLEDFEAQQVLHFGVPYVVQFLWNQLGLTEAIRDALRAREVTFDVARYV
                                                  **:;***   :   :   *:::;**  . :

ref|YP_516922.1|      FCMVLNRLTEPTSKLGVSDWKDSVYRPDF--ETLKLHHFYKAIDFLDENKDTIEEQLFFH
ref|YP_520815.1|      FWMVLNRLTEPTSKLGVSDWKDSVYRPDF--ETLKLHHFYKAIDFLDENKDTIEEQLFFH
ref|YP_519534.1|      FCMVLNRLTEPTSKLGVSDWKDSVYRPEF--ESLKLHHFYKAIDFLDENKESIEEQLFFH
ref|ZP_01372264.1|    FCMVLNRLTEPTSKLGVSDWKDSVYRPDF--ESLKLHHFYKAIDFLDENKDTLEEQLFFH
ref|ZP_01370818.1|    FCMVLNRLTEPTSKLGVSDWKDSVYRPEF--ESLKLHHFYKAIDFLDENKDTLEEQLFFH
RAAC03229             QAMVIHRLVDPSSKLRLFHTLDDLYLPDWGGEPWQLQHFYRALDYLVDIKPQLERVLYAR
                      **::**.:*:***  : .  *.:*  *::  *. :*:***:*:*:*  :  *  .*: :

ref|YP_516922.1|      HTNLFTQQLDLVFFDTTSTYVEGDAGAFDLLEYGHSKDHRPDRLQVMIGILMSRDGIPIA
ref|YP_520815.1|      HTNLFTQQLDLVFFDTTSTYVEGDAGAFDLLEYGHSKDHRPDRLQVMIGILMSRDGIPIA
ref|YP_519534.1|      QTNLFTQQLDLVFFDTTSTYVEGDAGAFDLLEYGHSKDHRPDRLQVMIGILMSRDGIPIA
ref|ZP_01372264.1|    HTNLFTQQLDLVFFDTTSTYVQGDAGAFDLLEYGHSKDHRPDRLQVMIGILMSRDGIPIA
ref|ZP_01370818.1|    HTNLFTQQLDLVFFDTTSTYVEGDAGAFDLLEYGHSKDHRPDRLQVMIGLLMSRDGIPIA
RAAC03229             LTDLLNFRLSLVLYDLTSTHLHG--HACPLGGHYSRTHRPDLEQVELGLLVTPEGIPIT
                      *:*:. :*.**:* ***::.*     *   *  :*:*: ****  ** :*:*::  ****:

ref|YP_516922.1|      HHVFPGNTPDTDAFIEAVSDLKKRFNIQRVIVVGDRGMMGKRTLELLEELQLQYILGVRM
ref|YP_520815.1|      HHVFPGNTPDTDAFIEAVSDLKKRFNIQRVIVVGDRGMMGKRTLELLEELQLQYILGVRM
ref|YP_519534.1|      HHVFPGNTPDTDAFIEAVRDLKKRFTIQRVIVVGDRGMMGKRTLELLEELELHYILGVRM
ref|ZP_01372264.1|    HHVFPGNTPDTDAFIEAVSDLKKRFTIQRVIVVGDRGMMGKRTLELLEELQLHYILGVRM
ref|ZP_01370818.1|    HHVFPGNTSDTDAFIEAVSDLKKRFTIQRVIVVGDRGMMGKRTLELLEELQLHYILGVRM
RAAC03229             HEVFAGNVSDKQTVPDILKRLKEDFAVEQCVFVGDRGMVTEKNMALMAEAGFPYIVGFHK
                      *.**.**..*.::.: :  : :  **. *  :::  :.******: ::.: *: *   : **:*.:

ref|YP_516922.1|      RN---IKAGPDLANSPEPYAFIKDNLKVKEVVHQ--------EKRYIVCLNEEEAKRDQ
ref|YP_520815.1|      RN---IKAGPDLANSPEPYAFIKDNLKVKEVVHQ--------EKRYIVCLNEEEAKRDQ
ref|YP_519534.1|      RN---IKAGPELAASPEPYTFLKDNLKVKEVLHQ--------EKRYIVCLNEEEAKRDR
ref|ZP_01372264.1|    RN---IKAGPELAASAQPYPYFVKDNLKVKEVLHQ--------EKRYIVCLNEEEAKRDQ
ref|ZP_01370818.1|    RN---VKAGPELATSPEPYVFTKDNLKVKEVLHQ--------GKRYIVCLNEEEAKRDQ
RAAC03229             RGRIVSDALLEQFADVNAYHELKDNLRYLEVPAASVDDVEKAEGVRYILCYNPEKARQDA
                      *.    .*  :   .:.*   **;     **:  * *:::* ref|YP_516922.1|      LVREQIEIKLRS----------KLEHG----------SIKDLIGNSEYKKYINVTAEAAT
ref|YP_520815.1|      LVREQIEIKLRS----------KLEHG----------SIKDLIGNSEYKKYINVTAEAAT
ref|YP_519534.1|      LVREQIEMKLRS----------KLEHG----------SIKDLIGHSEYKKYINVTAEAAT
ref|ZP_01372264.1|    LVREHIEMKLRS----------KLEHG----------GIKDLIGHSEYKKYINVTAEAAT
ref|ZP_01370818.1|    WVREQIEVKLRS----------KLEHG----------SIKDLIGHSEYKYLNVSAEAAT
RAAC03229             AFRESALEEAETGLKALAESLAKPKRGRKPTDKGVMLKVADLLTRKGVEAFFQVDYKDGI
                      .**   : .:     *  : *     :**:  .  :  :::*  : .

ref|YP_516922.1|      IN----TDKLKQAAVFDGLYILQTNTELPTEEVATAYRDLWQIERAFRNLKSTLDLRPVY
ref|YP_520815.1|      IN----TDKLKQAAVFDGLYILQTNTELPTEEVATAYRDLWQIERAFRNLKSTLDLRPVY
ref|YP_519534.1|      MN----TDKLKQAAVFDGLYILQTNTELPTEEVATAYRDLWQIERAFRNLKSTLDVRPVY
ref|ZP_01372264.1|    IN----TDKLKQAAVFDGLYILQTNTELPTEEVATAYRDLWQIERAFRNLKSTLDLRPVY
ref|ZP_01370818.1|    IN----TDKLKQAAVFDGLYILQTNTELPTEEVATAYRDLWQIERAFRNLKSTLDLRPVY
RAAC03229             LTYRRDEDAITKEALRDGKFLIRTNTDLPAADVVQSYKTLMGIERAFHQIKNFLDVGPIY
                      :.      * :.:  *: ** :::;****:**:   *.  :*: *   *****:::*. **:  *:
``` continued →

FIG. 113 continued

```
ref|YP_516922.1|      HWKERRISGHIMLCFLALVVQIKFQKLLES-----------------------CGSEY
ref|YP_520815.1|      HWKERRISGHIMLCFLALVVQIKFQKLLES-----------------------CGSEY
ref|YP_519534.1|      HWKERRISGHIMLCFLALVIQIRFQKLLEN-----------------------CASEY
ref|ZP_01372264.1|    HWKERRISGHIMLCFLALVIQIRFQKLLEN-----------------------CASEY
ref|ZP_01370818.1|    HWKERRISGHIMLCFLALVVQIRFQKLLEN-----------------------CASEY
RAAC03229             HWNEQRVRGHIFVCVLAYLFEQEMQVLYRRQWAHDKAVAESLACVEEQAKVLAELESRWY
                      **:*:*: ***::*.** :.: ..:* * .                       .  * ref|YP_516922.1|      GYTEVIRALRKVHAVKLKIKDQDHLVRTEIHGAAAMAFKAVGLRIPER------------
ref|YP_520815.1|      GYTEVIRALRKVHAVKLKIKDQDHLVRTEIHGAAAMAFKAVGLRIPER------------
ref|YP_519534.1|      GYTEVIRALRKVHAVKLKLKDQDHLVRTEIHGAAAMAFKAVGLRIPER------------
ref|ZP_01372264.1|    GYTEVIRALRKVHAVKLKLKDQDHLVRTEIHGAAAMAFKAVGLRIPER------------
ref|ZP_01370818.1|    GYTEVIRALRKVHAVKLKLKDQDHLVRTEIHGAAAMAFRAVGLRVPER------------
RAAC03229             TGEAIVRELRRWKAVRATFLDKEFVSVTKATDQAKAILTSLGIPTPNKTLSVTKVPSMTP
                      ::* **: :**: .: *::.: *:  . *    : ::*:  *::

ref|YP_516922.1|      --
ref|YP_520815.1|      --
ref|YP_519534.1|      --
ref|ZP_01372264.1|    --
ref|ZP_01370818.1|    --
RAAC03229             DE
```

FIG. 114

```
ref|YP_001125159.1|  -------VTAVKGIGEETAAALADLGITTVGELLNYAPYRYDDYEQKDLAAVRHEEKVTV
ref|YP_147039.1|     -------VTAVKGIGEETAAALADIGIATVGELLAYAPYRYDDYEQKDLAAVRHEEKVTV
ref|ZP_02849289.1|   MTLEQYSVRQIKGVSAPKEEELHAFGVHTVADLLDYFPFRYEDYRIRELAEIKDGEKVTV
ref|ZP_02329219.1|   MDLNQIPVTRVSGVGPQKAEDLAALGIHTAAQLIAYFPFRYEDYRLRDLSEVKDGERITV
ref|NP_816723.1|     -------VSVLPGVGPKRAENLQELGIATIEDLLTYYPFRYDDIQEKDLSEIQDQEKVTL
RAAC00160            MSLRSLSVRALPGVGPQKERALEALGIRTVDDLLHTYPFRYDERAEKPFSEWRDGDRVTA
                            *  : *:..     *  :*: *  :*:   *:**::    : ::  :. :::* ref|YP_001125159.1|  EGKVHSAPLLTYYGKKKSRLSFRLLTG-RYLITVVCFNRPYLKGKITLNETVTVIGKWDR
ref|YP_147039.1|     EGKVYSAPLLTYYGKKKSRLSFRMLAD-RYLITVVCFNRPYLKEKIALNETVTVIGKWDR
ref|ZP_02849289.1|   QGTIRGNGILQRYGKNKSRLTCKIEVD-HMLVTAVWFNRHFLQGQLTPGREIMLTGKWEQ
ref|ZP_02329219.1|   QGNLIGAPVLQRYGR-KSRLSCKVVID-HFFVTAVWFNRPFLKDKLASGKEIRLTGKWDA
ref|NP_816723.1|     KGLVVSEAVVSRYGYKKSRLTFRMMQE-HAVINVSFFNQPFLKDKVVLSEEIAVYGKWDA
RAAC00160            RAVVEG-PVQVRWRGSKSIMTARVRVDGQHPVVCLWFSQHYLRSKLSDGRFIVVTGKWNE
                     ..  :  .  :    :    **  ::  ::        :    *.:  :*:  ::   .. : :*** :

ref|YP_001125159.1|  HRQTINAYELRFGAAPE----ATGIEPVYSVRSPLTVKTMRRLIKAAFAQFGMHIPDLLP
ref|YP_147039.1|     HRQTINAYELRFGPAPE----TTGIEPVYSVRSPLTVKTMRRLMKAAPEQFGEHIPDPLP
ref|ZP_02849289.1|   QRLQMTVSESEFADKSTGMVKSGTLQPVYSVGGGITQAWMRKTIKQALLQYGSMIEEVLP
ref|ZP_02329219.1|   RRKQLTVSESEFPGNDS---LTGTLQPVYSLTGSLTQKSIRKMIQQALKQFGNLIQEVLP
ref|NP_816723.1|     KRKSLNGMKILASKGDN-----EDFAPIYHVNKKVRQSTLVQLIRTAFEEYGSLVEEILP
RAAC00160            ALRRLVASETSFDAGTQ----APSLVPVYRASKELSTKAIHQLILKALEQYAEEIQESLP
                      :          :    * :*       :    :   :    *:  ::.    : : **

ref|YP_001125159.1|  PALRRAYRLIDKQEAVRALHFPRSREELHQARRRLVYEEFLLYQLKMQALRKVMRDERRG
ref|YP_147039.1|     PALRRAYRLVDKQEALRALHFPRTREELHQARRRLIYEEFLLYQLKMQALRRLMRDERRG
ref|ZP_02849289.1|   HELVERHGLMARRDAVQRIHDPEEVKEGLEARRRMVYEELFLFQLKLQAYRSLTRKRGDG
ref|ZP_02329219.1|   ADFVKRYQLLPRKQAVALIHQPSGLEDGKQARRRMVYEELFFFQLKMHAFKAITRKRADG
ref|NP_816723.1|     NDLLEKYRLMPRKEAMWAMHFPSNPEESHQAKRRVFEEFLFQLKMQGLKKQEKAEKNG
RAAC00160            YALVRKYRLWTHRDALFGMHRPKSLEDVRQARRRLVFEEFLLFQIQLQWLRAK--REEPAG
                       :     .  *   :::*:   :*   *       ::  :*::::::::*::: :    : .    * ref|YP_001125159.1|  IIHSFPEEQLASFLSGLPFSLTNAQRRVIREILDDMRAPRQMNRLLQGDVGSGKTVVAAV
ref|YP_147039.1|     VVHSFSEERLSSFLSGLPFVLTNAQRRVIGEILADMRSPRQMNRLLQGDVGSGKTVVAAV
ref|ZP_02849289.1|   IVHQVNGETIRNFAATLPFELTDGQKKVVNEIMSDMRQPAAMNRLLKGDVGSGKTVVAAI
ref|ZP_02329219.1|   LAQQVDLPKIRSFVKSLPFELTPSQKQVVGEILHDMQQPYTMNRLLKGDVGAGKTVVAAT
ref|NP_816723.1|     LAIQYDVDRLKTFTQGLPFELTGAQKKVTNEICRDLRSPKHMQRLLQGDVGSGKTVVAAI
RAAC00160            RAQPVPSDALTAFEALLPGPMTNAQRRACEDILRDLQRPVPMTRLIQGDVGSGKTWVALF
                      :  *      **  :*  .*::.     :*  *::  *    * :.:.* ** ref|YP_001125159.1|  ALYAAVLSGFQGALMVPTEILAEQHVRSLAELFADTGVTVELLTSSVKGKRRKELLAKLE
ref|YP_147039.1|     ALYAALSGFQGALMVPTEILAEQHARSLAELFADTDVTIALLTSSVKGKQRKAVLAELE
ref|ZP_02849289.1|   ALYCTIKAGHQGALMVPTEILAEQHLRSLQKLFADTGIEVALLTGSLTEKKRRDVLAGLQ
ref|ZP_02329219.1|   ALYATVTAGCQGALMVPTEILAEQHKKSLSRMFKPYGIETALLTGSSTDKKRREILAGVQ
ref|NP_816723.1|     ALYATMTAGFQGALMVPTEILAQQHMESLQQLFDPLEVRTALLTGSTKTKERRLILEELA
RAAC00160            ACFAVHLARGQSALMAPTEILAEQHARLAHELLGSAGVRVELLTGSVTGRERDRVLAGLA
                     *  :..   :  *.***.****** **    ..::     :    *** * . :.*  :*  :

ref|YP_001125159.1|  DGTVDIVIGTHALIQEGVQFRQLGLVITDEQHRFGVEQRRVLREKGHAPDVLMMTATPIP
ref|YP_147039.1|     EGTIDIVVGTHALIQEGVQFRRLGLVITDEQHRFGVEQRRVLREKGHAPDVLMMTATPIP
ref|ZP_02849289.1|   MGMIDILVGTHALIQDDVFFRSLGLVVTDEQHRFGVNQRSILRRKGMNPDVLTMTATPIP
ref|ZP_02329219.1|   MGLIQVLIGTHALIQEDVFFRKLGLVVTDEQHRFGVSQRSILRRKGMNPDVLSMTATPIP
ref|NP_816723.1|     NGEIDIVVGTHALIQQDVSFHQLGLVITDEQHRFGVNQRKILREKGLKPDVLFMTATPIP
RAAC00160            SGDVSLAVGTHALLSEGVEFRDLALLVTDEQHRFGVAQRARLREKGRAPDVLMLSATPIP
                      *   :.:  :*****:.:.* *:  .*:*:*******     :  ** ::*** ref|YP_001125159.1|  RTLAITAFGDMDVSVLDEMPAGRKKVETYWVKHNQFARVLDFIEKELRRGHQAYVICPLI
ref|YP_147039.1|     RTLAITAFGDMDVSVLDEMPAGRKKVETYWVKHHQFSRVLDFIEKELRRGHQAYVICPLI
ref|ZP_02849289.1|   RTLAITAFGDMDVSTIKERPHGRKPIKTYWVKHDMMERVLGFIRREVGEGRQAYVICPLI
ref|ZP_02329219.1|   RTLAITAFGDLDVSTLREMPKGRKPIKTYWVHHDMLERVLGFIQKEAAGGRQAYVICPLI
ref|NP_816723.1|     RTLAITAYGEMDVSIIDEMPAGRIPIETRWIRPPQLDTVLEWMEKELARGHQAYIICPLI
RAAC00160            RTLALAIYGDMDVSILNELPKGRKPVQTIAVPSKDDETVLRLIRRELARGHQAYIVAPAI
                     ****::   *::***  :   **     * *    :  *   :  **   :***:: * *
``` continued →

FIG. 114 continued

```
ref|YP_001125159.1|    EESEKLDVQNAIDVHSQLVYYYRGKYEVGLMHGRLSADEKEAVMRAFSENRIHVLVSTTV
ref|YP_147039.1|       EESDKLDVQNAIDVHSQLVHYYRGKYEIGLMHGRLSADEKERVMRAFSENRIHVLVSTTV
ref|ZP_02849289.1|     EESDKLDVQNAIDLYVQMQQAFP-DLKVGLLHGRLSASEKDEVMRGFGANETQLLVATTV
ref|ZP_02329219.1|     EESDKLDVQNAIDVHVQLQQHFP-DLNIGLLHGRMTAAEKDDTMRSFKDGSIQVLVSTTV
ref|NP_816723.1|       EESEALDVKNATEIFEHMQSFYSPRYQVGLLHGKMKNQEKDDIMQEFKDNQLQLLVSTTV
RAAC00160              EASERDDVASVTELYERVREHLA-GFRVELLHGRMPSADKERMMRAFRDGDIHALVATTV
                       * *: **  .. ::. ::         .: *:**::    :*:  *: *  .  : :* ref|YP_001125159.1|    VEVGVNVPNATVMVIYDAERFGLAQLHQLRGRVGRGDAQSYCILIADPKSEIGKERMHIM
ref|YP_147039.1|       VEVGVNVPNATVMVIYDAERFGLAQLHQLRGRVGRGDAQSYCILIADPKSEVGKERMRIM
ref|ZP_02849289.1|     VEVGVDVPNATLIIIMDAERFGLSQLHQLRGRVGRGAHQSFCVLVADPKSENGRERMKVM
ref|ZP_02329219.1|     IEVGVDVPNATLMVVYDADRFGLSQLHQLRGRVGRGEHQSFCVLIADPKTEVGKERMQAM
ref|NP_816723.1|       IEVGVNVPNATVMLIMDADRFGLAQLHQLRGRVGRGSSASYCILVANPKNEMGVERMKIM
RAAC00160              IEVGIDVPNATVMAIYGAERFGLAQLHQLRGRVGRGPHPSYCLLIHDASSEAARARIETM
                       :*::***:: :  .*:**:**********     *:*:*: :...*  . *:. * ref|YP_001125159.1|    TETTDGFVLAEKDLELRGPGDFFGTKQSGLPEFQFGDPVHDYRILEVARRDAAKLVSSAA
ref|YP_147039.1|       TETADGFVLAEKDLELRGPGDFFGTKQSGLPEFRYGDPVHDYRILEVARRDAAKLVSSAA
ref|ZP_02849289.1|     TETNDGFEVSRRDLELRGPGDFFGTKQSGLPEFKIADMAAEYEMLELARDDAAELTGRDD
ref|ZP_02329219.1|     TETTDGFEIARRDLELRGPGDFFGTKQSGLPEFRIADLMCDFEIMEIARDDAADLVAKPE
ref|NP_816723.1|       TETTNGFVLSERDLELRGPGEVFGARQSGVPQFAVGDIVTDFNILEVARQEASALWKVKE
RAAC00160              LQTNDGFEIAERDLELRGPGELFGLRQSGLPEFALGDLARDYRIMEVAREEALALLRRDD
                       :* : ::..:****:. :***:*:*  .*     ::.::*:** :*  * ref|YP_001125159.1|    FWRDEAYAGLRAELE----------
ref|YP_147039.1|       FWRDEAYAGLRAELE----------
ref|ZP_02849289.1|     FWTNPLFERMR--------------
ref|ZP_02329219.1|     FWTAAEYVPLRQFLQK---------
ref|NP_816723.1|       WWQYPAYQGLANRVKPQDEAAQFFD
RAAC00160              FWYAPWAEGLRNALKEAMDKVSYRD
                       :*           :
```

FIG. 115

```
ref|YP_148969.1|        ----------------YLQLAHNEWDPKAKYAKAKVIYSFGREDEVDRAVLERLAKSIS
ref|YP_001126171.1|     ----------------YLQLAHNEWDPKAKYAKAKVIYSFGREDEVDRAVLERLAKSIS
ref|YP_146154.1|        ------------------------------------------------------------
ref|YP_146741.1|        MYIRRVTRKNKDGTTVAYLQLAHNEWDPKAKYAKAKVIYSFGREDEVDRAVLERLAKSIS
RAAC03182               MYIRVIRRKNKNGSVTGYVQLAHNFRDPNTGQPKAKVLYTFGREDEIDLEALRRLAQSIH
ref|ZP_02130848.1|      MYIRTISRKNKDGSKVEYVQLAHNYRDPKSKQARAEVLYSFGRKDQLDMEAIRRLAKSVE ref|YP_148969.1|        RFLSPEQAWEIETLTGEVSDDFQFQSSKRLGGAWLLDQLWRQLGLGEILHSLFASRHHQI
ref|YP_001126171.1|     RFLSPEQAWEIETLTGEVSDDFQFQSSKRLGGAWLLDQLWRQLGLGEILHSLFASRHHQI
ref|YP_146154.1|        ----------------------------------------------------VCSRHHQI
ref|YP_146741.1|        RFLSPEQAWEVEKLTGEASDDFQFQSCKHLGGVWLLDQLWRQLGLGEILHSLFTSRHHQI
RAAC03182               RFVGDEFTAGRGQSEGIQT---TLLDSRPMGGAYLLDELWRQLGLDEVLRERLADRKFKA
ref|ZP_02130848.1|      RFLAKTGDVETQCKLQFPGEDVRFVESRPMGGVFVLKKIWDRLRISECLDKALADRQYTA
                                                                              . .*:.

ref|YP_148969.1|        PLERLIFAMVANRALHPSSKLAMEEWVEKDVHIPHLPQVASHQLYRAMDELLAVQPELER
ref|YP_001126171.1|     PLERLIFAMVANRALHPSSKLAMEEWVEKDVHIPHLPQGASHQLYRAMDELLAVQPELER
ref|YP_146154.1|        PLERLIFAMVANRALHPSSKLAMEEWVEKDVHIPHLPQVASHQLYRAMDELLAVQPELER
ref|YP_146741.1|        SLERLIFAMVANRALHPSSKLAMEEWVEKDVYIPHLPQVASHQLYRAMDELLAVQPELER
RAAC03182               AVERVIFAMVANRALAPSSKLAMEEWVDREVALPGMTELDVWQAYRAMDFLHDVAEDLQY
ref|ZP_02130848.1|      PIGDAVFAMVANRALAPDSKLAVEDWAAKDVHLELDQPLKVQHLYRAMDFLLENQEAIQK
                          .:  :********* *.****:*:*. ::*  :         : ***** *    ::

ref|YP_148969.1|        QVFHAVADLLNLEVDLIYFDTTSSYFEVDPSETPEGESLRKQGFSKDKRPDLVQIVIGLA
ref|YP_001126171.1|     QVFHAVADLLNLEVDLIYFDTTSSYFEVDPSETPEGESLRKQGFSKDKRPDLVQIVIGLA
ref|YP_146154.1|        QVFHAVADLLNLEVDLIYFDTTSSYFEVDPSETPEGESLRKQGFSKDKRPDLVQIVIGLA
ref|YP_146741.1|        QVFHAVADLLNLEVDLIYFDTTSSYFEVDPSETPEGESLRKQGFSKDKRPDLVQIVIGLA
RAAC03182               EVFRRVSDLLNLDVDLLFFDTTSTYFET---EDESDDSLRRKGYSKDHRPDLPQVVIGLA
ref|ZP_02130848.1|      EVFWSTANLLNLEVDLVFFDTTSTYFER---DEEDEEGLKRYGHSKDKRKDLPQVVVGLA
                        :   .:::*::***:*     :  .: .*::  *.***:*  ** *:*:*** ref|YP_148969.1|        VTREGVPIRAWVWPGNTMDMTVIKQVKQDLIGWKLGRVISVMDRGFSSEENLRILQQAGG
ref|YP_001126171.1|     VTREGVPIRAWVWPGNTMDMTVIKQVKQDLIGWKLGRVISVMDRGFSSEENLRILQQAGG
ref|YP_146154.1|        VTREGVPIRAWVWPGNTMDMTVIKQVKQDLIGWKLGRVISVMDRGFSSEENLRILQQAGG
ref|YP_146741.1|        VTREGIPIRAWVWPGNTMDMTVIKQVKQDLIGWKLGRVISVMDRGFSSEENLRILQQAGG
RAAC03182               VTRDGIPVRCWTWPGNTADMSVVEEVKQDLIGWRLGRVITVVDRGFVSESNLRILQRAGG
ref|ZP_02130848.1|      VTKEGLPIRSWVFPGNTPDVNTVEQIQKEMNDWKLGRVVWAMDRGMTSEENRAILQRGGG
                        **::*:*:*.*.:**** *:..::::::: .*:****: .:***:** . ***::.**

ref|YP_148969.1|        HYIVGEKMRSGKAAVEEALNRRGRYQQVRENLHIKEIIVGDGEARQRYVLVYNPSEAERQ
ref|YP_001126171.1|     HYIVGEKMRSGKAAVEEALNRRGRYQQVRENLHIKEIIVGDGEARQRYVLVYNPSEAERQ
ref|YP_146154.1|        HYIVGEKMRSGKAAVEEALNRRGRYQQVRENLHIKEIIVGDGEARQRYVLVYNPSEAERQ
ref|YP_146741.1|        HYIVGENMRSGKAAVEEALSRRGRYHEVDENLHIKEIIVGDGEARQRYVLVYNPGEAERQ
RAAC03182               HYIAGEKMTSGKPAVEAALARPGRFRELRPNLKVKEVVVGDGEARVRYVLAFNPEEAKRD
ref|ZP_02130848.1|      NYILGEKLR-GSNMSKAVLGSPGRFTTVRDNLEIKEVTAGDGACRRYVIVRNPKQVKRD
                        :** **::  *.       : .*  **:   : **:**: .*** .* ***:.  ** :.:*:

ref|YP_148969.1|        RKEREKLLESLKEELEGLRQLPNEAHHKATCRLRSHPSYGKYLRQLKDGTLRIDKQAVRE
ref|YP_001126171.1|     RKEREKLLESLKEELEGLRQLPNEAHHKATCRLRSHPSYGKYLRQLKDGTLRIDKQAVRE
ref|YP_146154.1|        RKEREKLLESLKEELEGLRQLPNEAHHKATCRLRSHPSYGKYLRQLKDGTLRIDKQAVRE
ref|YP_146741.1|        RKERETLLESLKEELEGLRQLPNEAHHKATCRLRSHPSYGKYLRQLKDGTLRIDKQAVRD
RAAC03182               EARREAMLRELRMELERLKELQGEAHHCRLASHPTFKRYLKQDRWGNLRIDPEAVRQ
ref|ZP_02130848.1|      QATRERLIRRAEQEIEAIGDLTGKKHTKAACALLSHRSMGKYVRELKSGKLKINKAKITE
                        .  **  ::.. .*:*  :*  .: *  * **  * :  :*:::  *.*.*:   : :

ref|YP_148969.1|        AEKYDGKYLIRTSDDTLSAEDVALGYKQLVDIEQAFRTLKSTLELRPMYHRLEDRIRAHV
ref|YP_001126171.1|     AEKYDGKYLIRTSDDTLSAEDVALGYKQLVDIEQAFRTLKSTLELRPMYHRLEDRIRAHV
ref|YP_146154.1|        AEKYDGKYLIRTSDDTLSAEDVALGYKQLVDIEQAFRTLKSTLELRPMYHRLEDRIRAHV
ref|YP_146741.1|        AEKYDGNYLIRTSDDTLSAEDVALGYKQLVDIEQAFRTLKSTLELRPMYHRLEDRIRAHV
RAAC03182               AAHLDGKYLIRTSDDTLSTEDVALGYKQLLMVESAFRTLKTTLDIRPVYHRKDERIRSHV
ref|ZP_02130848.1|      EEKLDGKYLLSCSDDTLSPEEIALGYKQLLEVERAFRTLKSTLDLRPVYHRKDERIRSHV
                        : **:**:  ******.*::*:****** :* ******:**::**:*** :::***:**
``` continued →

FIG. 115 continued

```
ref|YP_148969.1|       LLSWLALLLVRIVEIRTHESWPKVR-------------DECE----------------
ref|YP_001126171.1|    LLSWLALLLVRIVEIRTHESWPKVR-------------DECE----------------
ref|YP_146154.1|       LLSWLALLLVRIVEIRTHESWPKVR-------------DECE----------------
ref|YP_146741.1|       LLSWLALLLVRIVEIRTHESWPKVR-------------DECE----------------
RAAC03182              LLCWLALLLVRIAEVQIGRSWPDIRSHVQGNAPSDAFRRDRCAAHRNDRGAAGDPASLED
ref|ZP_02130848.1|     TLCWLALLLVRLIELETGMTWNQVR-----------------------------------
                       *.********: *:.   :*  .:* ref|YP_148969.1|       ----------------------------------------
ref|YP_001126171.1|    ----------------------------------------
ref|YP_146154.1|       ----------------------------------------
ref|YP_146741.1|       ----------------------------------------
RAAC03182              QGTAEDPEGRTSNTRAVDTTRVIHRSHESTSDMGLWDFV
ref|ZP_02130848.1|     ----------------------------------------
```

FIG. 116

```
ref|YP_148733.1|      ------MDMTLTAKIKIYPTAEQAEVLKATLSAYRQACNAVSVVIFDTKVLA-QAKLHDM
ref|YP_146224.1|      ------MDMTLTAKIKIYPTAEQAEVLKATLSAYRQACNAVSVVIFDTKVLA-QAKLHDM
ref|ZP_02171259.1|    ------MKLTLTAKTKIVPTVEQEDTLRKTAHAYRDACNAVSEVVFDENTLV-QAKLHKR
ref|NP_977687.1|      ----------TITAKIQIEVSDNQAESLKITTNAYRKACNWLSKHIFETKNLN-QVNLNNL
ref|ZP_02619781.1|    ------MEIVRTLKIKLNINQEEKNMINSTLEAFLKALNYASQVAFNNGEITNKPKLQKL
RAAC03163             MREVNGMELTRTIRVRLEPTPEQASALARTVEANRQALDYVSRIAFERKIRN-RVALHRA
                             . *  :  :: . ::.. : *   *   .*  :   *   *:    : *:

ref|YP_148733.1|      TYRLLRSNYALRSQMAQSVIKTVIARYRSLKSNGHEWTLVRFKKPEYDLVWNRDYSIVQG
ref|YP_146224.1|      TYRLLRSNYALRSQMAQSVTKTVIARYRSLKSNGHEWTLVRFKKPEYDLVWNRDYSIVQG
ref|ZP_02171259.1|    TYRELRSTFGLKSQMAQSALKTVIATYKTNQSNGHERSQVQFKKPQFDLVFNRDYSLTKG
ref|NP_977687.1|      YYSDLRNQFRLKSQMAQSVMKTVIARYKSAKSNGHEWSLIDFKLAEYDLVWNRDYSLTKN
ref|ZP_02619781.1|    VYDDLRTKFNLKSQMAVNTCTTVCSSYVTQHSNKVFNSLAVYXSPKAIYSYGRDYSFLND
RAAC03163             AYRTIRTRFGLRAQMACTVCRVVAGVYKSMKSNGNEDTPAEFKRAKPVFQWNKDYVLRNG
                        .  * :*.  *:  **  ..  .* . * :**    :*  .:    :.:**  : :.

ref|YP_148733.1|      --LFSVNTLEGRIKVPFEPK-GMEFYFDGSWTFGTAKLVYKHNKFFLHIPMTKTIPTVDE
ref|YP_146224.1|      --LFSVNTLEGRIKVSFEPK-GMEFYFDGSWTFGTAKLVYKHNKFFLHIPMTKTIPTVDE
ref|ZP_02171259.1|    --LFSVNTLEGRTKVPFYTE-GLEPYFDGTWTFGTAKLVHKYGKWFLHIPVSKDVQEANL
ref|NP_977687.1|       ·QFSVNTLEGRLKLNYERK-AMKKYFNSTWKFGTAKLVHKYKKWFLHIPMTKEYQTLDF
ref|ZP_02619781.1|    GQTISINTIAKRIKVHFKVNNYFKKYLTKEWSFGSLEIVERENSYYAHITVSKEVQEKPL
RAAC03163             --VAHITTIDGRLRIPFRVEPPYRRYLQDGWTFGAAELVRKRHGWYLHVSVSKSVPD-IIA
                       .    *:   *:::    :     .*:    *,**:  ::*  :    :: *:..:* ref|YP_148733.1|      HNIRQVVGVDVGVNFLAAAYDSQGKTTFFNGRKIKHMRAKYKRMRKTLQQKGTASARRKL
ref|YP_146224.1|      HNIRQVVGVDVGVNFLAVAYDSQGQTIFFNGRKIKHMRAKYKRMRKTLQQKGTASARRKL
ref|ZP_02171259.1|    DNINQVVGIDMGVNFTATTYDSNGQTRFFNGKQIKHKRAKYKQMRKELQQKQTPSARRKL
ref|NP_977687.1|      ADVNNIVGVDLGINFLATTYDSQSKTTFYNGNIVKHKRGKFKATRKQLQTRQTPSSRKKI
ref|ZP_02619781.1|    NEFKNIIGIDLGQNFIATFYDSKGKIKFFKGRYLKDMRAKYTRLRKQLQRKGTYNAHKKI
RAAC03163             DDFDAVIGVDQGMRFLVTAS-CGDQVMFIRGGRVKQTRLRYVRLRASLQRKGTRSAKRRL
                       :. ::*:* *  .*  ..    . .:  * .*   :*. *  ::    * ** : * .:::::

ref|YP_148733.1|      KTIGQRENRWMTDVNHAVTKALVRQYGER---TLFVLEDLTGIREKTERVRIHDRYETVS
ref|YP_146224.1|      KTIGQRENRWMTDVNHAVTKALVRQYGER---TLFVLEDLTGIREKTERVRIHDRYETVS
ref|ZP_02171259.1|    KKIGQRENRWMQNINYCISKALVEQYGKD---TLFVMEDLTGVRNATEKVRVKDRYQTVS
ref|NP_977687.1|      KQIGSRENRYVTDVNHQITKALVEAYPRG---TMFVLEDLTGVRSATEKVRVKNRYVSVS
ref|ZP_02619781.1|    VTINQREQRTMTYINHKISKEIVEYAKQNN--AIIAMENLTGIN-LSCKVKKDNRYYRVS
RAAC03163             KAIGRRESRFMTDVNHQIAKAVVRFAQAQGQRPLIVLEDLTGSN LSVRFRLKDRYWRMS
                      *. **.*  :  *:  ::*  :*.        .:::*:*  . : :.:  .: :* ref|YP_148733.1|      WAFYQFRQLLEYKARLHGSKVMVVAPHYTSLTCPKCGHTEKANRNKRTHTFCCRTCGYTS
ref|YP_146224.1|      WAFYQFRQMLEYKARLHGSKVIVVAPHYTSLTCPKCGHTEKANRKKRTHTFCCRTCGYTS
ref|ZP_02171259.1|    WSFNDLRQKIAYKAQKTGALGIAVDPGYTSQTCPKCGHTEKANRNKKTHTFCCQTCQYTS
ref|NP_977687.1|      WAFYQFRQMLEYKAELNGQKVIVVDPKYTSQTCPKCGNIEKANRNKKLHTFKCKNCQYQS
ref|ZP_02619781.1|    WAFNQLQQFIEYKAVQAGLKVIYINPKYTSQTCPICGHIHKDNRNKKLHIFKCRACGCTL
RAAC03163             WAFRQLTDFIRYKAEEAGIAVMFIDPTGTSETCPKCGHCETANRSRKRHEFRCKKCGYRC
                      *:*  ::  : : ***   *    :    * *::  .:: *  *   *: * ref|YP_148733.1|      NDDRIGAMNLQRKGIE--------
ref|YP_146224.1|      NDDRIGAMNLQRKGIE--------
ref|ZP_02171259.1|    NDDRIGAMNLQRKGI---------
ref|NP_977687.1|      NDDRISAMNLHRKGIK--------
ref|ZP_02619781.1|    NDDLIGAKNIQHKGYD--------
RAAC03163             NDDLAASRVIAQKGLECLRQSQSA
                      ***  .:  :  :**
```

FIG. 117

```
ref|YP_148733.1|       ---YSIVQGLFSVNTLEGRIKVPFEPKG-MEPYFDGSWTFGTAKLVYKHNKFFLHIPMTKT
ref|YP_146224.1|       ---YSIVQGLFSVNTLEGRIKVSFEPKG-MEPYFDGSWTFGTAKLVYKHNKFFLHIPMTKT
ref|ZP_02171259.1|     ---YSLTKGLFSVNTLEGRIKVPFYTEG-LEPYFDGTWTFGTAKLVHKYGKWFLHIPVSKD
ref|YP_001396471.1|    ---YSLNKNIFSINSLQGRLKIPYQSKG-MEKYFDGSYSFGTAKLVYKFNKYFLHIPVTKD
ref|ZP_02619781.1|     ----------INTIAKRIKVHFKVNNYFKKYLTKEWSFGSLEIVERENSYYAHITVSKE
RAAC01387              MVYVLRSGLAHITTFDGRLRIPYHVEPPYLRYLQDGWTFGAAELVQKRHRWYLHVSVSKT
                              :.::  *:::  :  :       *:   ::**: ::* :    :: *:.::* ref|YP_148733.1|       IPTVDEHNIRQVVGVDVGVNFLAAAYDSQGKTFFFNGRKIKHMRAKYKRMRKTLQQKGTA
ref|YP_146224.1|       IPTVDEHNIRQVVGVDVGVNFLAVAYDSQGKTIFFNCRKIKHMRAKYKRMRKTLQQKGTA
ref|ZP_02171259.1|     VQEANLDNINQVVGIDMGVNFTATTYDSNGQTRFFNGKQIKHKRAKYKQMRKELQQKQTP
ref|YP_001396471.1|    YPQTTPFEIKKIVGIDLGINFLATTYDSFGKATFYQGRHIKAKRGHYKILRKQLQECGSK
ref|ZP_02619781.1|     VQEKPLNEFKNIIGIDLGQNFIATFYDSKGKIKFFKGRYLKDMRAKYTRLRKQLQRKGTY
RAAC01387              APD-PVGDFDAVIGIDQGMRFLITASCGN-QVMFIRGGKVKQTRLRYVRLRASLQRKGTR
                        :    ::  :*:*  * .*  .   .  :   * .*  :*  * :*   :*  **.  :

ref|YP_148733.1|       SARRKLKTIGQRENRWMTDVNHAVTKALVRQYG---ERTLFVLEDLTGIREKTERVRIHD
ref|YP_146224.1|       SARRKLKTIGQRENRWMTDVNHAVTKALVRQYG---ERTLFVLEDLTGIREKTERVRIHD
ref|ZP_02171259.1|     SARRKLKKIGQRENRWMQNINYCISKALVEQYG---KDTLFVMEDLTGVRKATEKVRVKD
ref|YP_001396471.1|    SAKRRIKSIGSRENRYVSDINHQITKSLVDKYG---TNTLFVLEDLTNVRTATEKVTINN
ref|ZP_02619781.1|     NAHKKIVTINQREQRTMTYINHKISKEIVEYAKQ--NNATIAMENLTGIN-LSCKVKKDN
RAAC01387              SAKRRLKAIGRRESRFMADVNHQIAKAVIRFAQTQGQRPLIVLEDLTGSN-LSVRFRLKD
                       .*::::  *, **.* : :*: ::* ::      .:::.:*;**. .  :  :.   ..:

ref|YP_148733.1|       RYETVSWAFYQFRQLLEYKARLHGSKVMVVAPHYTSLTCPKCGHTEKANRNKRCHTFCCR
ref|YP_146224.1|       RYETVSWAFYQFRQMLEYKARLHGSKVIVVAPHYTSLTCPKCGHTEKANRKKRCHTFCCR
ref|ZP_02171259.1|     RYQTVSWSFNDLRQKTAYKAQKTGALGIAVDPGYTSQTCPKCGHTEKANRNKRCHTFCCQ
ref|YP_001396471.1|    RYVSVSWAFYQFRQLLEYKAQMNGSIVMAVNPKYTSQTCPKCGHIEKANRDKKNHIFKCK
ref|ZP_02619781.1|     RYYRVSWAFNQLCQFIEYKAVQAGLKVIYINPKYTSQTCPICGHIHKDNRNKKLHIFKCR
RAAC01387              QYWRMSWSFRQLADFIRYKAEEAGIAVMLVDPAGTSETCPKCGHCEPANRSRKRHFFRCK
                        :*  :**:*  :: : :  ***   *  : :   *  ** *** ***  .  **.::  * * *:

ref|YP_148733.1|       TCGYTSKDDRIGAMNLQRKGIE--------
ref|YP_146224.1|       TCGYTSKDDRIGAMNLQRKGIE--------
ref|ZP_02171259.1|     TCQYTSNDDRIGAMNLQRKGI---------
ref|YP_001396471.1|    NCSYQSNDDRIGAINLWRKGIEYIEQS---
ref|ZP_02619781.1|     ACGCTLNDDLIGAKNIQHKGYD--------
RAAC01387              RCGYRCNDDLAASRVIAQKGLECLRQSQSA
                         *   ***  .:   : :**
```

FIG. 118

```
gb|AAL87775.1|AF403183_11    ------------------------------------------------
ref|ZP_01368657.1|           REFZPTRANSPSASEISDESULFITBACTERIUMHAFNIENSEDCB-GBE
ref|YP_517288.1|             ------------------------------------------------
ref|YP_517659.1|             ------------------------------------------------
ref|YP_001212990.1|          ------------------------------------------------
RAAC03385                    ------------------------------------------------ gb|AAL87775.1|AF403183_11    ------------------------------------------------
ref|ZP_01368657.1|           ATTRANSPSASEISDESULFITBACTERIUMHAFNIENSEDCB-GBEATT
ref|YP_517288.1|             ------------------------------------------------
ref|YP_517659.1|             ------------------------------------------------
ref|YP_001212990.1|          ------------------------------------------------
RAAC03385                    ------------------------------------------------ gb|AAL87775.1|AF403183_11    ------------------------------------------------
ref|ZP_01368657.1|           RANSPSASEISDESULFITBACTERIUMHAFNIENSEDCB-GBEATTRAN
ref|YP_517288.1|             ------------------------------------------------
ref|YP_517659.1|             ------------------------------------------------
ref|YP_001212990.1|          ------------------------------------------------
RAAC03385                    ------------------------------------------------ gb|AAL87775.1|AF403183_11    ------------------------------------------------
ref|ZP_01368657.1|           SPSASEISDESULFITBACTERIUMHAFNIENSEDCB-GBEATTRANSPS
ref|YP_517288.1|             ------------------------------------------------
ref|YP_517659.1|             ------------------------------------------------
ref|YP_001212990.1|          ------------------------------------------------
RAAC03385                    ------------------------------------------------ gb|AAL87775.1|AF403183_11    ------------------------------------------------
ref|ZP_01368657.1|           ASEISDESULFITBACTERIUMHAFNIENSEDCB-GBEATTRANSPSASE
ref|YP_517288.1|             ------------------------------------------------
ref|YP_517659.1|             ------------------------------------------------
ref|YP_001212990.1|          ------------------------------------------------
RAAC03385                    ------------------------------------------------ gb|AAL87775.1|AF403183_11    ------------------------------------------------
ref|ZP_01368657.1|           ISDESULFITBACTERIUMHAFNIENSEDCB-GBEATTRANSPSASEISD
ref|YP_517288.1|             ------------------------------------------------
ref|YP_517659.1|             ------------------------------------------------
ref|YP_001212990.1|          ------------------------------------------------
RAAC03385                    ------------------------------------------------ gb|AAL87775.1|AF403183_11    ------------------------------------------------
ref|ZP_01368657.1|           ESULFITBACTERIUMHAFNIENSEDCB-GBEATTRANSPSASEISDESU
ref|YP_517288.1|             ------------------------------------------------
ref|YP_517659.1|             ------------------------------------------------
ref|YP_001212990.1|          ------------------------------------------------
RAAC03385                    ------------------------------------------------ gb|AAL87775.1|AF403183_11    ------------------------------------------------
ref|ZP_01368657.1|           LFITBACTERIUMHAFNIENSEDCB-GBEATTRANSPSASEISDESULFI
ref|YP_517288.1|             ------------------------------------------------
ref|YP_517659.1|             ------------------------------------------------
ref|YP_001212990.1|          ------------------------------------------------
RAAC03385                    ------------------------------------------------
``` continued →

FIG. 118 continued

```
gb|AAL87775.1|AF403183_11   ---------------------------------------------------
ref|ZP_01368657.1|          TBACTERIUMHAFNIENSEDCB-SCRESIGNIFICANCEE-IDENTITIE
ref|YP_517288.1|            ---------------------------------------------------
ref|YP_517659.1|            ---------------------------------------------------
ref|YP_001212990.1|         ---------------------------------------------------
RAAC03385                   --------------------------------------------------- gb|AAL87775.1|AF403183_11   -------------MLQHNSLPEQHQNQLSLIFSSLKLSQLLRAAGIRKSY
ref|ZP_01368657.1|          SPSITIVESGAPSMLQHNSLPEQHQNQLSLIFSSLKLSQLLRAAGIRKSY
ref|YP_517288.1|            -------------MLQHNSLPEQHQNQLSLIFSSLKLSQLLRAAGIRKSY
ref|YP_517659.1|            -------------MLQHNSLPEQHQNQLSLIFSSLKLSQLLRAAGIRKSY
ref|YP_001212990.1|         ---------------------QFYSRVDNFLSRHEIGKILRRSNFQKEK
RAAC03385                   -------------MVRDSQHPDQLQSMVTAFFMEYHIGKLLRQSNITKQA
                                         *  .  :    : :     . : . : * *  : .  * .

gb|AAL87775.1|AF403183_11   GVSSFVVFQIIFQLVFQGRNLFRLLEGSRAESLPGKDVVYRFLNDSRYNW
ref|ZP_01368657.1|          GVSSFVVFQIIFQLVFQGRNLFRLLEGSRAESLPGKDVVYRFLNDSRYNW
ref|YP_517288.1|            GVSSFVVFQIIFQLVFQGRNLFRLLEGSRAESLPGKDVVYRFLNDSRYNW
ref|YP_517659.1|            GVSSFVVFQIIFQLVFQGRNLFRLLEGSRAESLPGKDVVYRFLNDSRYNW
ref|YP_001212990.1|         GFSCLELFKFIFLLVFKGKNLYRTLQSEAEPGRPEKDTIYRFLNSFRYNW
RAAC03385                   GIPVLEVFRLLFALVFHQRSLKRVLEQLAMN-QFGKDTVYRFLNSPRHNW
                            *..  : :*:::* ***: :. * * *:            ** . ***** . *:**

gb|AAL87775.1|AF403183_11   RRFYQLLSLKMVGRFEK-LTSAQRIRVFIVDDSVMERERSKKVELLARVF
ref|ZP_01368657.1|          RRFYQLLSLKMVGRFEK-LTSAQRIRVFIVDDSVMERERSKKVELLARVF
ref|YP_517288.1|            RRFYQLLSLKMVGRFEK-LTSAQRIRVFIVDDSVMERERSKKVELLARVF
ref|YP_517659.1|            RRFYQLLSLKMVGRFEK-LTSAQRIRVFIVDDSVMERERSKKVELLARVF
ref|YP_001212990.1|         RKFLLILSSSVINETIEPLTSRNWKNVLVLDDSLYSRNRSKAVELLARVK
RAAC03385                   RRFLLLLSSAVVRRTAR-LTSEDRADVFIVDDSLFSRSRSKKVELLAKVY
                            *:*  :  ::  .  .  * :   *:::***: .*.* ***:* gb|AAL87775.1|AF403183_11   DHV-----------------------------------------------
ref|ZP_01368657.1|          DHV-----------------------------------------------
ref|YP_517288.1|            DHV-----------------------------------------------
ref|YP_517659.1|            DHV-----------------------------------------------
ref|YP_001212990.1|         DHV-----------------------------------------------
RAAC03385                   DHVLRSNLLTEQPASIPSGDYYFDGMVYSPAGVNRPYAHPDKGYYGISPY
                            *** gb|AAL87775.1|AF403183_11   ---------------------------------------------------
ref|ZP_01368657.1|          ---------------------------------------------------
ref|YP_517288.1|            ---------------------------------------------------
ref|YP_517659.1|            ---------------------------------------------------
ref|YP_001212990.1|         ---------------------------------------------------
RAAC03385                   VTWHRVGNQDLHCQIDYYDSQSILEAPAWAVGSGVGALVGGMVTDGNLTG gb|AAL87775.1|AF403183_11   ---------------------------------------------------
ref|ZP_01368657.1|          ---------------------------------------------------
ref|YP_517288.1|            ---------------------------------------------------
ref|YP_517659.1|            ---------------------------------------------------
ref|YP_001212990.1|         ---------------------------------------------------
RAAC03385                   SVIGAIIGGALGAYYGAQVERLADENGCIWFTIDNNPPIVNLGTWWAPEW gb|AAL87775.1|AF403183_11   ------------------------
ref|ZP_01368657.1|          ------------------------
ref|YP_517288.1|            ------------------------
ref|YP_517659.1|            ------------------------
ref|YP_001212990.1|         ------------------------
RAAC03385                   YMDVRYIELGPWATTNFYYYLGGVY
```

FIG. 119

```
ref|YP_001126171.1|    MDELLAVQPELERQVFHAVADLLNLEVDLIYFDTTSSYFEVDPSETPEGESLRKQGFSKD
ref|YP_148969.1|       MDELLAVQPELERQVFHAVADLLNLEVDLIYFDTTSSYFEVDPSETPEGESLRKQGFSKD
ref|YP_146154.1|       MDELLAVQPELERQVFHAVADLLNLEVDLIYFDTTSSYFEVDPSETPEGESLRKQGFSKD
ref|YP_146741.1|       MDELLAVQPELERQVFHAVADLLNLEVDLIYFDTTSSYFEVDPSETPEGESLRKQGFSKD
ref|ZP_02172080.1|     MDELLSVQKQLEDRVFDHVSNLLNLEVDLLYFDTTSSYFEVASDETPEEDDFRLQGYSKD
RAAC03398              MDFLHDVAEDLQYEVFRRVSDLLNLDVDLLFFDTTSTYFETE-DES--DDSLRRKGYSKD
                       ** *  *    :*:  .** *::**:*:**:*.   .*:   :.:* :*:*** ref|YP_001126171.1|    KRPDLVQIVIGLAVTREGVPIRAWVWPGNTMDMTVIKQVKQDLIGWKLGRVISVMDRGFS
ref|YP_148969.1|       KRPDLVQIVIGLAVTREGVPIRAWVWPGNTMDMTVIKQVKQDLIGWKLGRVISVMDRGFS
ref|YP_146154.1|       KRPDLVQIVIGLAVTREGVPIRAWVWPGNTMDMTVIKQVKQDLIGWKLGRVISVMDRGFS
ref|YP_146741.1|       KRPDLVQIVIGLAVTREGIPIRAWVWPGNTMDMTVIKQVKQDLIGWKLGRVISVMDRGFS
ref|ZP_02172080.1|     KRSDLVQVVIGLAVTREGIPIKVWTWPGNTMDMNVVEEVKKDLMGWRLGRVVKVMDRGFS
RAAC03398              HRPDLPQVVIGLAVTRDGIPVRCWTWPGNTADMSVVEEVKQDLIGWRLGRVITVVDRGFV
                       :*.** *:*********:*:*:  *.*** .*::::::*:.*:**** ref|YP_001126171.1|    SEENLRILQQAGGHYIVGEKMRSGKAAVEEALNRRGRYQQVRENLHIKEIIVGDGEARQR
ref|YP_148969.1|       SEENLRILQQAGGHYIVGEKMRSGKAAVEEALNRRGRYQQVRENLHIKEIIVGDGEARQR
ref|YP_146154.1|       SEENLRILQQAGGHYIVGEKMRSGKAAVEEALNRRGRYQQVRENLHIKEIIVGDGEARQR
ref|YP_146741.1|       SEENLRILQQAGGHYIVGENMRSGKAAVEEALSRRGRYEEVDENLHIKEIIVGDGEARQR
ref|ZP_02172080.1|     SEKNLRILQRGAGHYIIGERMRSGKKDVEEALSKRGRFEKVRENLHVKESIVGDEARKR
RAAC03398              SESNLRILQRAGGHCIAGEKMTSGKPAVEAALARPGRFRELRPNLKVKEVVVGDGEARVR
                       .**:.. * **.* *    : :::    :* :******* * ref|YP_001126171.1|    YVLVYNPSEAERQRKEREKLLESLKEELEGLRQLPNEAHHKATCRLRSHPSYGKYLRQLK
ref|YP_148969.1|       YVLVYNPSEAERQRKEREKLLESLKEELEGLRQLPNEAHHKATCRLRSHPSYGKYLRQLK
ref|YP_146154.1|       YVLVYNPSEAERQRKEREKLLESLKEELEGLRQLPNEAHHKATCRLRSHPSYGKYLRQLK
ref|YP_146741.1|       YVLVYNPGEAERQRKERETLLESLKEELEGLRQLPNEAHHKATCRLRSHPSYGKYLRQLK
ref|ZP_02172080.1|     YVIAFNPDEAIRDREKRQEIVRSVEEQLHHLKQLPNEAHHKQACALRAHKVYGKYIRQLK
RAAC03398              YVLAFNPEEAKRDEARREAMLRELRMELERLKELQGEAHKAHCRLASHPTFKRYLKQDR
                       **:.:** ** *:,. *:  ::..::  :*. *::*  .*** *   * *   : :*::*  :

ref|YP_001126171.1|    DGTLRIDKQAVREAEKYDGKYLIRTSDDTLSAEDVALGYKQLVDIEQAFRTLKSTLELRP
ref|YP_148969.1|       DGTLRIDKQAVREAEKYDGKYLIRTSDDTLSAEDVALGYKQLVDIEQAFRTLKSTLELRP
ref|YP_146154.1|       DGTLRIDKQAVREAEKYDGKYLIRTSDDTLSAEDVALGYKQLVDIEQAFRTLKSTLELRP
ref|YP_146741.1|       DGTLRIDKQAVRDAEKYDGNYLIRTSDDTLSAEDVAIGYKQLVDIEQAFRTLKSTLELRP
ref|ZP_02172080.1|     DGTLKTNKQAVRDAEKYDGKYLIRTSDDTLSIEDVALGYKQLLQVEDAFRTMKTTLVLRP
RAAC03398              WGNLRIDPEAVRQAAHLDGKYLIRTSDDTLSTEDVALGYKQLLMVESAFRTLKTTLDIRP
                        *.*:::: :***:*   :  ***:*********** ****:*****:  :*.****:*:** ;**

ref|YP_001126171.1|    MYHRLEDRIRAHVLLSWLALLLVRIVEIRTHESWPKVRDECERLMLGHFSSKNGDLYQRT
ref|YP_148969.1|       MYHRLEDRIRAHVLLSWLALLLVRIVEIRTHESWPKVRDECERLMLGHFSSKNGDLYQRT
ref|YP_146154.1|       MYHRLEDRIRAHVLLSWLALLLVRIVEIRTHESWPKVRDECERLMLGHFSSKNGDLYQRT
ref|YP_146741.1|       MYHRLEDRIRAHVLLSWLALLLVRIVEIRTHESWPKVRDECERLMLGHFSSKNGDLYQRT
ref|ZP_02172080.1|     MYHRLEDRIRAHVIISWLALLLVRMIELDTNESWNTVRRNIQRLQAGHFTTSDGLYRTT
RAAC03398              MYHRKDERIRSHVLLCWLALLLVRTAEVQTGRSWPDIRSHMQAMHQVTKSTPDGIVVQRT
                       ** ::*::::********:  *: *      : :            :: :* : :  * ref|YP_001126171.1|    ELTAKQALFLAALGLEPPPKILGIHPRT---
ref|YP_148969.1|       ELTAKQALFLAALGLEPPPKILGIHPRT---
ref|YP_146154.1|       ELTAKQALFLAALGLEPPPKILGIHPRT---
ref|YP_146741.1|       ELTAKQAQLFAALGLEPPPKILGIHPR----
ref|ZP_02172080.1|     TPTAKQKEIFRNTGTEIPPEILAIRPKS---
RAAC03398              ETTEVQWEILRALRALRITEPPRILRMEPRTRGL
                        *   *    ::        **.**  :.*:
```

FIG. 120

```
ref|YP_148969.1|       --PSSKLAMEEWVEKDVHIPHLPQVASHQLYRAMDELLAVQPELERQVFHAVADLLNLEV
ref|YP_146154.1|       --PSSKLAMEEWVEKDVHIPHLPQVASHQLYRAMDELLAVQPELERQVFHAVADLLNLEV
ref|YP_001126171.1|    --PSSKLAMEEWVEKDVHIPHLPQGASHQLYRAMDELLAVQPELERQVFHAVADLLNLEV
ref|YP_146741.1|       --PSSKLAMEEWVEKDVYIPHLPQVASHQLYRAMDELLAVQPELERQVFHAVADLLNLEV
ref|ZP_02172080.1|     LAPSSKLVMEEWLSEDVYLPDMPVFKSHQLYRSMDELLSVQKQLEDRVFDHVSNLLNLEV
RAAC03177              MAPSSKLAMEEWVDREVALPGMTELEVWQAYRAMDFLHDVAEDLQYEVFRRVSDLLNLDV
                         ***.**:..:* :* :.   * :  *   *   :*:.** *::****:* ref|YP_148969.1|       DLIYFDTTSSYFEVDPSETPEGESLRKQGFSKDKRPDLVQIVIGLAVTREGVPIRAWVWP
ref|YP_146154.1|       DLIYFDTTSSYFEVDPSETPEGESLRKQGFSKDKRPDLVQIVIGLAVTREGVPIRAWVWP
ref|YP_001126171.1|    DLIYFDTTSSYFEVDPSETPEGESLRKQGFSKDKRPDLVQIVIGLAVTREGVPIRAWVWP
ref|YP_146741.1|       DLIYFDTTSSYFEVDPSETPEGESLRKQGFSKDKRPDLVQIVIGLAVTREGIPIRAWVWP
ref|ZP_02172080.1|     DLIYFDTTSSYFEVASDETPEEDDFRLQGYSKDKRSDLVQVVIGLAVTREGIPIKVWTWP
RAAC03177              DLLFFDTTTSTYFETE--DEPE-DGLRRKGYSKDHRPDLPQVVIRLAVTRDGIPVRCWTWP
                       **::*****:***.    : ** :.:*  :*:***:** *:** *****:*:*::  *.**

ref|YP_148969.1|       GNTMDMTVIKQVKQDLIGWKLGRVISVMDRGFSSEENLRILQQAGGHYIVGEKMRSGKAA
ref|YP_146154.1|       GNTMDMTVIKQVKQDLIGWKLGRVISVMDRGFSSEENLRILQQAGGHYIVGEKMRSGKAA
ref|YP_001126171.1|    GNTMDMTVIKQVKQDLIGWKLGRVISVMDRGFSSEENLRILQQAGGHYIVGENMRSGKAA
ref|YP_146741.1|       GNTMDMTVIKQVKQDLIGWKLGRVISVMDRGFSSEENLRILQQAGGHYIVGENMRSGKAA
ref|ZP_02172080.1|     GNTMDMNVVEEVKKDLMGWRLGRVVKVMDRGFSSEKNLRILQRGAGHYIIGERMRSGKKD
RAAC03177              GNTADMSVVEEVKQDLIGWRLGRVITVVDRGFVSFSNTIRTIQRAGGHYIAGEKMTSGKPA
                       * .*::::::**:.*:** .****:.. ..* *** ref|YP_148969.1|       VEEALNRRGRYQQVRENLHIKEIIVGDGEARQRYVLVYNPSEAERQRKEREKLLESLKEE
ref|YP_146154.1|       VEEALNRRGRYQQVRENLHIKEIIVGDGEARQRYVLVYNPSEAERQRKEREKLLESLKEE
ref|YP_001126171.1|    VEEALNRRGRYQQVRENLHIKEIIVGDGEARQRYVLVYNPSEAERQRKEREKLLESLKEE
ref|YP_146741.1|       VEEALSRRGRYHEVDENLHIKEIIVGDGEARQRYVLVYNPGEAERQRKERETLLESLKEE
ref|ZP_02172080.1|     VEEALSKRGRFHKVRENLHVKESIVGDGEARKRYVIAFNPDEATRDREKRQEIVRSVEEQ
RAAC03177              VEAALARPGRFRELRPNLKVKEVVVGDGEARVRYVLAFNPEEAKRDEARREAMLRELRME
                       ** **  : **::::  **::**  :****** ***:..:** **  *:. .*: ::.:..  :

ref|YP_148969.1|       LEGLRQLPNEAHHKATCRLRSHPSYGKYLRQLKDGTLRIDKQAVREAEKYDGKYLIRTSD
ref|YP_146154.1|       LEGLRQLPNEAHHKATCRLRSHPSYGKYLRQLKDGTLRIDKQAVREAEKYDGKYLIRTSD
ref|YP_001126171.1|    LEGLRQLPNEAHHKATCRLRSHPSYGKYLRQLKDGTLRIDKQAVREAEKYDGKYLIRTSD
ref|YP_146741.1|       LEGLRQLPNEAHHKATCRLRSHPSYGKYLRQLKDGTLRIDKQAVRDAEKYDGNYLIRTSD
ref|ZP_02172080.1|     LHHLKQLPNEAHHKQACALRAHKVVYGKYIRQLKDGTLKLNKQAVRDAEKYDGKYLIRTSD
RAAC03177              LERLKELQGEAHTKAHCRLASHPTFKRYLKQDRWGNLRIDPEAVRQAAHLDGKYLIRTSD
                       *. *::* .***  *   *  :*    : :*:* :*.:::.*::*:*  : ******** ref|YP_148969.1|       DTLSAEDVALGYKQLVDIEQAFRTLKSTLELRPMYHRLEDRIRAHVLLSWLALLLVRIVE
ref|YP_146154.1|       DTLSAEDVALGYKQLVDIEQAFRTLKSTLELRPMYHRLEDRIRAHVLLSWLALLLVRIVE
ref|YP_001126171.1|    DTLSAEDVALGYKQLVDIEQAFRTLKSTLELRPMYHRLEDRIRAHVLLSWLALLLVRIVE
ref|YP_146741.1|       DTLSAEDVALGYKQLVDIEQAFRTLKSTLELRPMYHRLEDRIRAHVLLSWLALLLVRIVE
ref|ZP_02172080.1|     DTLSIEDVALGYKQLLQVEDAFRTMKTTLVLRPMYHRLEDRIRAHVIISWLALLLVRMIE
RAAC03177              DTLSTEDVALGYKQLLMVESAFRTLKTTLDIRPMYHRKDERIRSHVLLCWLALLLVRIAE
                       **::*;:  :.**:* *:**** ::*:::.******** * ref|YP_148969.1|       IRTHESWPKVRDECERLMLGHFSSKNGDLYQRTELTAKQALFLAALGLEPPPKILGIHPR
ref|YP_146154.1|       IRTHESWPKVRDECERLMLGHFSSKNGDLYQRTELTAKQALFLAALGLEPPPKILGIHPR
ref|YP_001126171.1|    IRTHESWPKVRDECERLMLGHFSSKNGDLYQRTELTAKQALFLAALGLEPPPKILGIHPR
ref|YP_146741.1|       IRTHESWPKVRDECERLMLGHFSSKNGDLYQRTELTAKQAQLFAALGLEPPPKILGIHPR
ref|ZP_02172080.1|     LDTNESWNTVRRNIQRLQAGHFTTSDGDLYRTTTPTAKQKEIFRNTGTEIPPEILATRPK
RAAC03177              VQTGRTWADIRSHMQAMHRVTKSTPEGIVVQRTFTTEVQREILRALRITEPPRILRMEPR
                       : * .:*   :*  . : : ::   :* : :*    * *  ::  **.** :.*:

ref|YP_148969.1|       T---
ref|YP_146154.1|       T---
ref|YP_001126171.1|    T---
ref|YP_146741.1|       ----
ref|ZP_02172080.1|     S---
RAAC03177              TRGL
```

FIG. 121

```
ref|YP_074105.1|          ------------------------------------------------------------
ref|YP_076073.1|          ------------------------------------------------------------
ref|YP_001036724.1|       TRANSPSASEMUTATRTYPECLSTRIDIUMTHERMCELLUMATCCGBABNTRANSPSASE
ref|YP_001039064.1|       ------------------------------------------------------------
ref|YP_001039349.1|       ------------------------------------------------------------
RAAC03588                 ------------------------------------------------------------ ref|YP_074105.1|          ------------------------------------------------------------
ref|YP_076073.1|          ------------------------------------------------------------
ref|YP_001036724.1|       MUTATRTYPECLSTRIDIUMTHERMCELLUMATCCGBABNTRANSPSASEMUTATRTYPE
ref|YP_001039064.1|       ------------------------------------------------------------
ref|YP_001039349.1|       ------------------------------------------------------------
RAAC03588                 ------------------------------------------------------------ ref|YP_074105.1|          ------------------------------------------------------------
ref|YP_076073.1|          ------------------------------------------------------------
ref|YP_001036724.1|       CLSTRIDIUMTHERMCELLUMATCCGBABNTRANSPSASEMUTATRTYPECLSTRIDIUM
ref|YP_001039064.1|       ------------------------------------------------------------
ref|YP_001039349.1|       ------------------------------------------------------------
RAAC03588                 ------------------------------------------------------------ ref|YP_074105.1|          ------------------------------------------------------------
ref|YP_076073.1|          ------------------------------------------------------------
ref|YP_001036724.1|       THERMCELLUMATCCGBABNTRANSPSASEMUTATRTYPECLSTRIDIUMTHERMCELLU
ref|YP_001039064.1|       ------------------------------------------------------------
ref|YP_001039349.1|       ------------------------------------------------------------
RAAC03588                 ------------------------------------------------------------ ref|YP_074105.1|          ------------------------------------------------------------
ref|YP_076073.1|          ------------------------------------------------------------
ref|YP_001036724.1|       MATCCGBABNTRANSPSASEMUTATRTYPECLSTRIDIUMTHERMCELLUMATCCGBABN
ref|YP_001039064.1|       ------------------------------------------------------------
ref|YP_001039349.1|       ------------------------------------------------------------
RAAC03588                 ------------------------------------------------------------ ref|YP_074105.1|          ------------------------------------------------------------
ref|YP_076073.1|          ------------------------------------------------------------
ref|YP_001036724.1|       TRANSPSASEMUTATRTYPECLSTRIDIUMTHERMCELLUMATCCGBABNTRANSPSASE
ref|YP_001039064.1|       ------------------------------------------------------------
ref|YP_001039349.1|       ------------------------------------------------------------
RAAC03588                 ------------------------------------------------------------ ref|YP_074105.1|          ------------------------------------------------------------
ref|YP_076073.1|          ------------------------------------------------------------
ref|YP_001036724.1|       MUTATRTYPECLSTRIDIUMTHERMCELLUMATCCSCRESIGNIFICANCEE-IDENTIT
ref|YP_001039064.1|       ------------------------------------------------------------
ref|YP_001039349.1|       ------------------------------------------------------------
RAAC03588                 ------------------------------------------------------------ ref|YP_074105.1|          ---------------VISDAHEGLRQAIAEVLQGAAWQRCRVHFMRNLLGYVPKPAQSMV
ref|YP_076073.1|          ----------------ISDSHVGLQEAIRTVLSGASWQRCRVHFMRNLLSYVPKHWQSMV
ref|YP_001036724.1|       IESPSITIVESGAPSVISDAHEGLKAAIKKILTGSAWQRCRVHFMRNVLSQVPKHYQGMV
ref|YP_001039064.1|       ---------------VISDAHEGLKAAIKKILTGSAWQRCRVHFMRNVLSQVPKHYQGMV
ref|YP_001039349.1|       ---------------VISDAHEGLKAAIKKILTGSAWQRCRVHFMRNVLSQVPKHYQGMV
RAAC03588                 ---------------MVSDAHAGLRQAISEVLTGATWQRCKVHTIRNVLSQVPKREQSMV
                                          :**:* **: **  :* *::****:** :**:*. ***  *.**
``` continued →

FIG. 121 continued

```
ref|YP_074105.1|        AALVRTVFAQPDIEAAREQLDRVVASLGRRYPKVAALLSEAAEDVLAYMAFPREHWQKIH
ref|YP_076073.1|        AAAVRTIFAQPDQQAARRQLAVVADNLRPQFPRAAQLLEEAEDDILAYMAFPTEHWRQLH
ref|YP_001036724.1|     SSIIRTIFAQNDQESAREQLRHVVDELKNRFPKAMKILEEAEEEILAYMAFPREHWAQIH
ref|YP_001039064.1|     SSIIRTIFAQNDQESAREQLRHVVDELKNRFPKAMKILEEAEEEILAYMAFPREHWAQIH
ref|YP_001039349.1|     SSIIRTIFAQNDQESAREQLRHVVDELKKRFPKAMKILEEAEEEILAYMAFPREHWAQIH
RAAC03588               ASIIRSIFTQPTQEAAREQLRRVVAELRGRFPKAMDILEAAEEDVLAFMALPIEHWRQIC
                        ::  :*::*:*       ::**.**   *..*   ::*:.    :*. * :::**:**:* *** ::

ref|YP_074105.1|        STNPLERLMREIGRRVDVVGIFPNAAAALRLIGAVLQEQEDEWRVQ-RRYLSMQSMAKLA
ref|YP_076073.1|        STNPLERLNREIGRRTDVVGIFPNREAVIRLAGAVLIEQQDEWTAAPRRYFSQASMAKL-
ref|YP_001036724.1|     STNPLERLNREIRRRTDVVCIFPNREAVIRLVGAMLMEQNDEWKVG-RRYFSLESMSKIT
ref|YP_001039064.1|     STNPLERLNREIRRRTDVVCIFPNRKAVIRLVGAMLMEQNDEWKVG-RRYFSLESMSKIT
ref|YP_001039349.1|     STNPLERLNREIRRRTDVVCIFPNREAVIRLVGAMLMEQNDEWKVG-RRYFSLESMSKIT
RAAC03588               STNPLERLNREMRRRMDVVGIFPNRASVVRLAGAILQEQHEEWLVS-RRYFSLESMAKLK
                        ******** **: ** *** ****  :.:** **:* **.:** .  ***:*  **:*:

ref|YP_074105.1|        ------LTPSEP---
ref|YP_076073.1|        ---------------
ref|YP_001036724.1|     SINEFTLTPVALLHK
ref|YP_001039064.1|     SINEFTLTPVALLHK
ref|YP_001039349.1|     SINEFTLTPVALLHK
RAAC03588               P-NRPLLAAEAMLQK
```

FIG. 122

```
ref|NP_634718.1|                 ------------------------------------MLKTEEWLLIRDLYSQGFSISEIA
ref|NP_616807.1|                 ------------------------------------MLKTEEWLSIRDLYSQGFSISEIS
ref|YP_074959.1|                 ------------------------------------MLRSGETLEIRQMYAGGLSISEIA
gb|AAR99616.1|                   --------------------------------------------IKEMYERGMSISDIA
sp|Q45618|TRA6_BACST             --------------------------------------------IKEMYERGMSISDIA
RAAC03818                        MRIPQDERPQFLKIIGMNSPPPCRIVAPVIRSWEVPVMREDERMETRQLYEAGVSISELA
                                                                             *::* *.***:::

ref|NP_634718.1|                 KQTGFDRKTVRKYLRLKTLPEPQ--KRSGRKSKLDPFKP----
ref|NP_616807.1|                 RRTGYARETVRKYL-----------------------------
ref|YP_074959.1|                 RRTGRDRKTIRKWLRTNTMPKPA---KRKR-------------
gb|AAR99616.1|                   RELGIDRKTVRKYIHSPNPPSKS--KRKQ--------------
sp|Q45618|TRA6_BACST             RELGIDRKTVRKYIHSPNPPSKS--KRKQ--------------
RAAC03818                        RRFGYDRKTIRNALNSSLERSRAQERRVGSERKVPSWSPTRIT
                                 :. *  *:*:*: :
```

FIG. 123

```
ref|YP_594046.1|    LKGRIEQGVLSAVVLFREVQERGYQGQYTVVKDFVRPFRRTQVSAARVTTRFETAPGEQA
RAAC03819           MKQRMQLGVLNAERILREIREQGYTGGITVLREFMKPLR--PVVSAKATERYESDPGEQA
ref|YP_074959.1|    --EQMQKGVTSASKMLYLLQQRGFKGKIRIVRAFMAPYR--PMAKAAATVRFETPPGKQA
ref|YP_359963.1|    IQELMNLGIFNCEVIYERIKEEGYTGGRTILRDYVRQFR--PPKQVPAVCRYETKPGQQA
ref|YP_361300.1|    IQELMNLGIFNCEVIYERIKEEGYTGGRTILRDYVRQFR--PPKQVPAVCRYETKPGQQA
ref|NP_622784.1|    ----INMGIFNCEVIYERIKEEGYTGGKTILRDYVRQFR--PSKHIQAVCRYETKSGEQA
                        :: *:  ..  :   :::.*: *    ::: ::    *       .. *:*: .*:**

ref|YP_594046.1|    QVDFGRYSYLNLE-GQTRSIWAFVMVLGWSRALYVEFIRKADTASFIRCHLNAFAYFGGM
RAAC03819           QIDLGAFPYYDSH-GQRRTIWAFAMVLAYSRMLYVEFIKAADQLHILQALRNALEFFGGV
ref|YP_074959.1|    QVDWADFGYIEVD-GRRLKLYCFIMVLAYSRAMYLEFVTATDMKTFMRCHINAFKFFGGV
ref|YP_359963.1|    QVDWGEYTYIDEETGEIRKLYVFVMVLGYSRAIYVEFTNRCDVRTFIRCLIHGFEYFGGV
ref|YP_361300.1|    QVDWGEYTYIDEETGEIRKLYVFVMVLGYSRAIYVEFTNRCDVHTFIRCLIHGFEYFGGV
ref|NP_622784.1|    QVDWGEYNYIDQETGEVRKLYLFVMVLGYSRAMYVEFTNRCDVHTFNRCLIHGFEYFGGV
                    *:*  .  :  *  :  . *.  .:: * ***.:** :*:**    *   : :.  ..: :***:

ref|YP_594046.1|    TQSILYDNTKQVVLERDETG----------------------------------
RAAC03819           PRVMLSDNCSPLVVANDGQGHVDCNRLISILPSSTDSCPRHVGLAGAAPRAR
ref|YP_074959.1|    PHETLYDNVKTVVKDRD-----------------------------------
ref|YP_359963.1|    TDIVLTDRMKTVIL--------------------------------------
ref|YP_361300.1|    TDIVLTDRMKTVIL--------------------------------------
ref|NP_622784.1|    TDVVLTDRMKTVIIGTDANKKPIWNAVFEDLAATLGFVPR------------
                      .:* *. . ::
```

FIG. 124

```
ref|ZP_01695687.1|   LVLNILCSGKPLYKVHEFYQNLDSEMLF--DTSVSPDQLNDDALGRALDYLYEA-EAWKV
ref|ZP_01695982.1|   LVLNILCSGKPLYKVHEFYQNLDSEMLF--DTSVSPDQLNDDALGRALDYLYEA-EAWKV
ref|ZP_01695971.1|   LVLNILCSGKPLYKVHEFYQNLDSEMLF  DTSISPDQLNDDALGRALDYLYKA-EAWKV
ref|ZP_01695655.1|   LVLNILCSGKPLYKVHEFYQNLDSEMLF--DTSISPDQLNDDALGRALDYLYKA-EAWKV
ref|YP_430569.1|     LIINLLVDREALYHVERFYENQDLEVLFGAEQQVRPEDFNDDALGRALDKLFTSGQLKKL
RAAC03823            MLVNTGTNREALYRVERFYAQRDVFVLLG--SGVSADDLHDDALARALDALYDA-GLEAL
                     :::*:    .  :.**:*..**  :  *  *:*:       :.::::****.****  *:   :

ref|ZP_01695687.1|   YSTLALKTLKKLNLP-----IGILHNDTTSISVYGEYKQPKEDGLQITYGYSKAHRPDLK
ref|ZP_01695982.1|   YSTLALKALKKLNLP-----IGILHNDTTSISVYGEYKQPKEDGLQITYGYSKAHRPDLK
ref|ZP_01695971.1|   YSTLALKALKKLNLP-----IGVLHNDTTSISVYGEYKQPKEDGLQITYGYSKAHRPDLK
ref|ZP_01695655.1|   YSTLALKALKKLNLP-----IGVLHNDTTSISVYGEYKQPKEDGLQITYGYSKAHRPDLK
ref|YP_430569.1|     FSSIALTAAATHNVS-----IAGIHVDTTSISVQGAYDG--EGDLDITFGFSKDHRPDLK
RAAC03823            YARIALHTLRRLRVLSDSNELIPIHADTTSLSMTGEYLD--QTAFRIDRGFSKDHRPDLK
                     ::  :**  :    .:       :  :*  ***:*: *  *      :   : * *: **** ref|ZP_01695687.1|   QIVLCMGVTPERIPILAKVENGNTSDKSWNVEFIQKMRKILSHEDWKNLIYQADSALITT
ref|ZP_01695982.1|   QIVLGMGVTPERIPILAKVENGNTSDKSWNVEFIQKMRKILSHEDWKNLIYQADSALITT
ref|ZP_01695971.1|   QIVLGMGVTPERIPILAKVENGNTSDKSWNVEFIQKMRKILSHEDWKNLIYQADSALITT
ref|ZP_01695655.1|   QIVLGMGVTPERIPILAKVENGNTSDKSWNVEFIQKMRKILSHEDWKNLIYQADSALITT
ref|YP_430569.1|     QFLIGLTVNRDGLPILAQSLEGNSSDKSWYPQVIEELVQTFKPEKLREVIFVADCALVTK
RAAC03823            QIVFGL-CTVHGLGLCANVNPGNLDDHTWNFENIQQLLSQLDEETRKRSVYVADAALVTK
                     *:::*:   .    .  : *:     ** .*:*   : *:::  ::  *   *:. ::  **.**:*.

ref|ZP_01695687.1|   ENLAEIQQQN------LSFISRLPDTFGLSTELKKEAWLLNN-WERVGSLSNKKDAAIYQI
ref|ZP_01695982.1|   ENLAEIQQQN------LSFISRLPDTFGLSTELKKEAWLLNN-WERVGSLSNKKDAAIYQI
ref|ZP_01695971.1|   ENLAEIQQQN------LSFISRLPDTFGLSTELKKEAWLLNN-WERVGSLSNKKDAAIYQI
ref|ZP_01695655.1|   ENLAEIQQQN------LSFISRLPDTFGLSTELKKEAWLLNN-WERVGSLSNKKDAAIYQI
ref|YP_430569.1|     DNLALLVQEEGNKPALQFISLLPENFGLNKEIKAEAFRTGT-WQEIGKLSPKKDAACYKS
RAAC03823            DNLELLAEED------FHFISRLPGTYKLSEDLKRAAWEKENSWKEVGRLAEAEDSAHYRI
                     :**   : :::         : *** ** .: :.:*   *:   .  :*:.:* *:   :*:*  *:

ref|ZP_01695687.1|   QAFERQIQNLPYRFLVVHSNNLDQRKEKTLNRAIEKEEIQLKKEIEKLSKVIFHCKEDAL
ref|ZP_01695982.1|   QAFERQIQNLPYRFLVVHSNNLDQRKEKTLNRAIEKEEIQLKKEIEKLSKVIFHCKEDAL
ref|ZP_01695971.1|   QAFERQIQNLPYRFLVVHSNNLDQRKEKTLNRAIEKEETKLKKEIEKLSKVIFHCKEDAL
ref|ZP_01695655.1|   QAFERQIQNLPYRFLVVHSNNLDQRKEKTLNRAIEKEEIQLKKEIEKLSKVIFHCKEDAL
ref|YP_430569.1|     QSFVREIDGRDYRLIVVHSTTLDKRKENSLLKKWAKQREVLEKAAKDLSRRPFACKADAR
RAAC03823            QAFRRTLYGRTYRFVVVRSSSLDTRKERKLKEVLKREKAALEKAAKAMSQNVYSCEQDAQ
                     *:*  *     .  **::**:*.:.** ***..*   ::.  *:*    : :*:    *: **

ref|ZP_01695687.1|   EAIQSFKKKQKASYFCYKLNVQMSDQPIKRKKRGRPKKDEQTK REQIYQIQLESFEKDH
ref|ZP_01695982.1|   EAIQSFKKKQKASYFCYKLNVQMSDQPIKRKKRGRPKKDEQTK-REQIYQIQLESFEKDH
ref|ZP_01695971.1|   EAIQSFKKKQKASYFCYKLNVQMSDQPIKRKKRGRPKKDEQTK-REQIYQIQLESFEKDH
ref|ZP_01695655.1|   EAIQSFKKKQKASYFCYKLNVQMSDQPIKRKKRGRPKKDEQTK-REQIYQIQLESFEKDH
ref|YP_430569.1|     KAIELFLREYR-------------------------------------------------
RAAC03823            MAMQTFMHEHRATLHPISARICAEQVQAKRARRGRPRKDDPPPPVHTQYRVEVAILPPSE
                     *:: *  *  :.       **:  * :*.**   :: .*:*      : :*:     *: **

ref|ZP_01695687.1|   DFIENKKKMLSTFVLITNKLDEETLSNQEVLRVYKGQSAAETRFRLIKDSQMIDAIYLKT
ref|ZP_01695982.1|   DFIENKKKMLSTFVLITNKLDEETLSNQEVLRVYKGQSAAETRFRLIKDSQMIDAIYLKT
ref|ZP_01695971.1|   DFIENKKRMLSTFVLITNKLDEETLSNQEVLRVYKGQSAVETRFRLIKDSQMIDAIYLKT
ref|ZP_01695655.1|   DFIENKKKMLSTFVLITNKLDEETLSNQEVLRVYKGQSAAETRFRLIKDSQMIDAIYLKT
ref|YP_430569.1|     ------------------------------------------------------------
RAAC03823            ERVQQWREKEATFVLITDIRDDQRVSDEQILRLYKEQHEVEARFRYLKSPYHVGPIYLHK ref|ZP_01695687.1|   PERVEALGIVYVMALLIYGILEYRVRKELKEKNLSLILKGKRKLYQPTGQALLEQLEDIT
ref|ZP_01695982.1|   PERVEALGIVYVMALLIYGILEYRVRKELKEKNLSLILKGKRKLSQPTGQALLEQLEDIT
ref|ZP_01695971.1|   PERVEALGIVYVMALLIYGILEYRVRKELKEKNLSLILKGKRKLYQPTGQALLEQLEDIT
ref|ZP_01695655.1|   PERVEALGIVYVMALLIYGILEYRVRKELKEKNLSLILKGKRKLYQPTGQALLEQLEDIT
ref|YP_430569.1|     ------------------------------------------------------------
RAAC03823            PTRVKAFGFVMLLSLLLYSVLEYLIREKYKRETEPLMLPGNRKSFRPTGLAILEMLDGVT ref|ZP_01695687.1|   VILINQNQQKIRLLPDNIDSQAKKIIELCGYDLSIYA------
ref|ZP_01695982.1|   VILINQNQQKIRLLPDNIDSQAKKIIELCGYDLSIYA------
ref|ZP_01695971.1|   VILINQNRQKLRLLPDNIDSQAKKIIELCGYDLSIY-------
ref|ZP_01695655.1|   VILINQNRQKLRLLPDNIDSQAKKIIELCGYDLSIY-------
ref|YP_430569.1|     -------------------------------------------
RAAC03823            TVHMQVGDTWQRVPATPHNPQIMRVLKLLNYDLSIYAESQKTA
```

FIG. 125

```
ref|ZP_02330348.1|    MGLWTKQQLREFIKENNLVTAQDAQNALKELFAETIQEMLEAELDTHLGYEKHEVKAKKT
ref|ZP_02328298.1|    MGLWTKQQLREFIKENNLVTAQDAQNALKELFAETIQEMLEAELDTHLGYEKHEVKAKKT
ref|ZP_02326599.1|    MGLWTKQQLREFIKENNLVTAQDAQNALKELFAETIQEMLEAELDTHLGYEKHEVKAKKT
RAAC01171             MELLSKEQIRQLIRDGKLKDIHDVQSMLKDLFASTIQEMLEAELNTHLGYAKYDAKHKDT
ref|YP_001664428.1|   MSLLTKEQLRNFISENNIQSIPDLYTSLKNLFKDTIQEMLEAELSTELGYSRYDKKDKDT
ref|YP_001664274.1|   MSLLTKEQLRNFISENNIQSIPDLYTSLKNLFKDTTQEMLEAELSTELGYSRYDKKDKDT
                       * * :*:*:*::*  :.::      *  . :  .*********.*.***  ::: * *.* ref|ZP_02330348.1|    PNSRNGR-SHKTVVSEYGEQQIAVPRDRMGEFEPLVVKKHQSNVTGIEDQIVALYAK---
ref|ZP_02328298.1|    PNSRNGR-SHKTVVSEYGEQQIAVPRDRMGEFEPLVVKKHQSNVTGIEDQIVALYAK---
ref|ZP_02326599.1|    PNSRNGR-SHKTVVSEYGEQQIAVPRDRMGEFEPLVVKKHQSNVTGIEDQIVALYAK---
RAAC01171             DNAKNGHGAKRTVQSELGDIDEALPRDRKGEFEPLIVQKRQKRMPSIEEQVIALYLKFDS
ref|YP_001664428.1|   QNSRNGY-TQKTVKTQFGEMEIDIPRDRQGEFEPKIVPKYKRDISGIEEKVIALYAR---
ref|YP_001664274.1|   QNSRNGY-TQKTVKTQFGEMEIDIPRDRQGEFEPKIVPKYKRDISGIEEKVIALYAR---
                      *:***    ::*  ::  *:  :*  :**** *****  :*  *  :   :..**:::***  :

ref|ZP_02330348.1|    --------------------
ref|ZP_02328298.1|    --------------------
ref|ZP_02326599.1|    --------------------
RAAC01171             KTPHPKVRTALQRGFFAV
ref|YP_001664428.1|   --------------------
ref|YP_001664274.1|   --------------------
```

FIG. 126

```
ref|YP_516922.1|    ---MFARIKTAYNRDGSPRRYLQIVESRREEGKVRQKVLCNLGRVEDLQNGKLDDLIRSL
ref|YP_520815.1|    ------------------------------------------------------------
ref|YP_519534.1|    ---MFARIKTAYNRDGSPRRYLQLVESRREEGKVRQKVLCNLGRVEDLQNGKLDDLIRSL
ref|ZP_01372264.1|  ---MFARIKTAYNRDGSPRRYLQLVESRREEGKVRQKVLCNLGRVEDLQNGKLDDLIRSL
ref|ZP_01370818.1|  ---MFARIKTAYNRDGSPRRYLQLVESRREEGKVRQKVLCNLGRVEDLQNGKLDDLIRSL
RAAC03825           MILLFAQIVSTKKPDGKTYKYLHIVESYREGRTVKKRRVASLGNISQYSEREIEQIIRTL ref|YP_516922.1|    AKFSDKLAVVDAAEDLFADWSKEYGPSMVFNRLWDNLGLHKILDGLFSERELSIDVREAI
ref|YP_520815.1|    -------------------------------LWDNLGLHKILDGLFSERELSIDVREAI
ref|YP_519534.1|    AKFSDTLAVVDAAEDLFADWSKEFGPSMVFRRLWENLGLHKILSGLFNERELSIDVQEAI
ref|ZP_01372264.1|  AKFSDTLAVVDAAEDLFADWSKEFGPSMVFRRLWENLGLHKIFAGLFNERDLSIDVQEAI
ref|ZP_01370818.1|  AKFSDTLAVVDAAEDLFADWSKEFGPSMVFRRLWENLGLHTILDGLFNERDLSIDVQEAI
RAAC03825           ESLLQHRTTG-SLEDFEAQQVLHFGVPYVVQFLWNQLGLTEAIRDALRAREVTFDVARYV
                                                    **::***    :  . :  *:::** . :

ref|YP_516922.1|    FCMVLNRLTEPTSKLGVSDWKDSVYRPDF--ETLKLHHFYKAIDFLDENKDTIEEQLFFH
ref|YP_520815.1|    FWMVLNRLTEPTSKLGVSDWKDSVYRPDF--ETLKLHHFYKAIDFLDENKDTIEEQLFFH
ref|YP_519534.1|    FCMVLNRLTEPTSKLGVSDWKDSVYRPEF--ESLKLHHFYKAIDFLDENKESIEEQLFFH
ref|ZP_01372264.1|  FCMVLNRLTEPTSKLGVSDWKDSVYRPEF--ESLKLHHFYRAIDFLDENKDTLEEQLFFH
ref|ZP_01370818.1|  FCMVLNRLTEPTSKLGVSDWKDSVYRPEF--ESLKLHHFYKAIDFLDENKDTLEEQLFFH
RAAC03825           QAMVIHRLVDPSSKLRLFHTLDDLYLPDWGGEPWQLQHFYRALDYLVDIKPQLERVLYAR
                     **:**.:*:***   : . *.:*  *::   *. :*:***:*:*:*  *   :*. *:  :

ref|YP_516922.1|    HTNLFTQQLDLVFFDTTSTYVEGDAGAFDLLEYGHSKDHRPDRLQVMIGILMSRDGIPIA
ref|YP_520815.1|    HTNLFTQQLDLVFFDTTSTYVEGDAGAFDLLEYGHSKDHRPDRLQVMIGILMSRDGIPIA
ref|YP_519534.1|    QTNLFTQQLDLVFFDTTSTYVEGDAGAFDLLEYGHSKDHRPDRLQVMIGILMSRDGIPIA
ref|ZP_01372264.1|  HTNLFTQQLDLVFFDTTSTYVQGDAGAFDLLEYGHSKDHRPDRLQVMIGILMSRDGIPIA
ref|ZP_01370818.1|  HTNLFTQQLDLVFFDTTSTYVEGDAGAFDLLEYGHSKDHRPDRLQVMIGLLMSRDGIPIA
RAAC03825           LTDLLNFRLSLVLYDLTSTHLHG--HACPLGEHGYSRTHRPDLEQVELGLLVTPEGIPIT
                     *:*:. :*.**::* ***::.*    *  *  *:*:*:  ****  **  *:*:*: :****:

ref|YP_516922.1|    HHVFPGNTPDTDAFIEAVSDLKKRFNIQRVIVVGDRGMMGKRTLELLEELQLQYILGVRM
ref|YP_520815.1|    HHVFPGNTPDTDAFIEAVSDLKKRFNIQRVIVVGDRGMMGKRTLELLEELQLQYILGVRM
ref|YP_519534.1|    HHVFPGNTPDTDAFIEAVRDLKKRFTIQRVIVVGDRGMMGKRTLELLEELELHYILGVRM
ref|ZP_01372264.1|  HHVFPGNTPDTDAFIEAVSDLKKRFTIQRVIVVGDRGMMGKRTLELLEELQLHYILGVRM
ref|ZP_01370818.1|  HHVFPGNTSDTDAFIEAVSDLKKRFTIQRVIVVGDRGMMGKRTLELLEELQLHYILGVRM
RAAC03825           HEVFAGNVSDKQTVPDILKRLKEDFAVEQCVFVGDRGMVTEKNMALMAEAGFPYIVGFHK
                     *.**.**..*.::. : :   **: * ::: :.******: ::.: *: *   : **:*..:

ref|YP_516922.1|    RN---IKAGPDLANSPEPYAFIKDNLKVKEVVHQ---------EKRYIVCLNEEEAKRDQ
ref|YP_520815.1|    RN---IKAGPDLANSPEPYAFIKDNLKVKEVVHQ---------EKRYIVCLNEEEAKRDQ
ref|YP_519534.1|    RN---IKAGPELAASPEPYTFLKDNLKVKEVLHQ---------EKRYIVCLNEEEAKRDR
ref|ZP_01372264.1|  RN---IKAGPELAASAQPYPFVKDNLKVKEVLHQ---------EKRYIVCLNEEEAKRDQ
ref|ZP_01370818.1|  RN---VKAGPELATSPEPYVFTKDNLKVKEVLHQ---------GKRYIVCLNEEEAKRDQ
RAAC03825           RGRIVSDALLEQFADVNAYHELKDNLRYLEVPAASVDDVEKAEGVRYILCYNPEKARQDA
                     *.     .*   :    . ..:*   **;          ***:* *  *:*::* ref|YP_516922.1|    LVREQIEIKLRS---------KLEHG---------SIKDLIGNSEYKKYINVTAEAAT
ref|YP_520815.1|    LVREQIEIKLRS---------KLEHG---------SIKDLIGNSEYKKYINVTAEAAT
ref|YP_519534.1|    LVREQIEMKLRS---------KLEHG---------SIKDLIGHSEYKKYINVTAEAAT
ref|ZP_01372264.1|  LVREHIEMKLRS---------KLEHG---------GIKDLIGHSEYKKYINVTAEAAT
ref|ZP_01370818.1|  WVREQIEVKLRS---------KLEHG---------SIKDLIGHSEYKKYLNVSAEAAT
RAAC03825           AFRESALEEAETGLKALAESLAKPKRGRKPTDKGVMLKVADLLTRKGVEAFFQVDYKDGI
                     .**      :  .:         * ::*          : **: ..   : :::*   :  .

ref|YP_516922.1|    IN----TDKLKQAAVFDGLYILQTNTELPTEEVATAYRDLWQIERAFRNLKSTLDLRPVY
ref|YP_520815.1|    IN----TDKLKQAAVFDGLYILQTNTELPTEEVATAYRDLWQIERAFRNLKSTLDLRPVY
ref|YP_519534.1|    MN----TDKLKQAAVFDGLYILQTNTELPTEEVATAYRDLWQIERAFRNLKSTLDVRPVY
ref|ZP_01372264.1|  IN----TDKLKQAAVFDGLYILQTNTELPTEEVATAYRDLWQIERAFRNLKSTLDLRPVY
ref|ZP_01370818.1|  IN----TDKLKQAAVFDGLYILQTNTELPTEEVATAYRDLWQIERAFRNLKSTLDLRPVY
RAAC03825           LTYRRDEDAITKEALRDGKFLIRTNTDLPAADVAQSYKTLMGIERAFHQIKNFLDVGPIY
                     :.     * :.: *:  :::*:; :  :*: *    *****::;:*. **. *;* continued →
```

FIG. 126 continued

```
ref|YP_516922.1|      HWKERRISGHIMLCFLALVVQIKFQKLLES------------------------CGSEY
ref|YP_520815.1|      HWKERRISGHIMLCFLALVVQIKFQKLLES------------------------CGSEY
ref|YP_519534.1|      HWKERRISGHIMLCFLALVIQIRFQKLLEN------------------------CASEY
ref|ZP_01372264.1|    HWKERRISGHIMLCFLALVIQIRFQKLLEN------------------------CASEY
ref|ZP_01370818.1|    HWKERRISGHIMLCFLALVVQIRFQKLLEN------------------------CASEY
RAAC03825             HWNEQRVRGHIFVCVLAYLFEQEMQVLYRRQWAHDKAVAESLACVEEQAKVLAELESRWY
                      **:*:*: ***::*.**  :.: ..:* * .                       . * ref|YP_516922.1|      GYTEVIRALRKVHAVKLKIKDQDHLVRTEIHGAAAMAFKAVGLRIPER------------
ref|YP_520815.1|      GYTEVIRALRKVHAVKLKIKDQDHLVRTEIHGAAAMAFKAVGLRIPER------------
ref|YP_519534.1|      GYTEVIRALRKVHAVKLKLKDQDHLVRTEIHGAAAMAFRAVGLRIPER------------
ref|ZP_01372264.1|    GYTEVIRALRKVHAVKLKLKDQDHLVRTEIHGAAAMAFKAVGLRIPER------------
ref|ZP_01370818.1|    GYTEVIRALRKVHAVKLKLKDQDHLVRTEIHGAAAMAFRAVGLRVPER------------
RAAC03825             TGEAIVRELRRWKAVRATFLDKEFVSVTKATDQAKAILTSLGIPTPNKTLSVTKVPSMTP
                         ::* **: :**:  .: *::.: *:  . *   : ::*:  *::

ref|YP_516922.1|      --
ref|YP_520815.1|      --
ref|YP_519534.1|      --
ref|ZP_01372264.1|    --
ref|ZP_01370818.1|    --
RAAC03825             DE
```

FIG. 127

```
ref|ZP_02851608.1|        ------------------LSMYAKGMTVRDIQTHLQELYGVDASPTLTSGITDKIVPLI
ref|YP_001307815.1|       ---------------HLESAVIGMYAKGMTTRDIATQINDIYGMDASPTLISNITDKVIPML
ref|ZP_02326599.1|        ------------------LYAKGVSTREIQDHLQNLYGIEVSPTLISNVTNKIVPLI
RAAC03826                 MRVVQTCPYNPRHIKGTVKLELYARGFSTRDIQDHLQQIYGVDMSPTLVSNLTDRLLPRT
ref|YP_001212943.1|       ------------------IAMYAKGMSTRDIEDHMRDIYGIDVSPTMVSKITDKILPMI
ref|YP_001113174.1|       ------------------IAMYGKGMSTRDIEDHMRDTYGTDVSPTMVSRITDKIMPMV
                                            :*.:*.:.*:*   ::.::**::  ***:* :*:::* :

ref|ZP_02851608.1|        KEWQNRPLSREYAHVVMDAVHYKVRQDGRIVNKAAYMAIGIDLDGMKDVLGIWIGENESS
ref|YP_001307815.1|       KEWQSRPLESIYPIIFMDAIHFKVRKDNAIVSKAAYAVIGVNLEGKKDVLGIWIGASESP
ref|ZP_02326599.1|        KEWQNRPLQSVYAVVFLDAIHFKVQDGATVSKAAYMVIGIDLDGNKDVLGMWIGENESS
RAAC03826                 QEWQNRPLHPLYTVVFLDAIHYKVREEGRLVSKAAYMVIGIDIEGQKDVLGIWIGQSESS
ref|YP_001212943.1|       SEWQSRPLDRVYPVVFLDAIHFKVRKENRIINKAAYSVMAINMAGQKEVLGIWVGENESA
ref|YP_001113174.1|       IEWQSRPLDRVYPIVFLDAIHFKVRQDNRIINKAAYSVLGITMDGHKEILGIWVGEHESS
                           ***.***   :*. :.:**:*:**::: .::.****   .:.:  :  * *::**:*:*  **.

ref|ZP_02851608.1|        KYWLKIINELKNRGVEDILIVSIDGLKGFEDALHAVYPQTEIQSCIIHQIRNSTRYISYK
ref|YP_001307815.1|       KYWLLVLKELKNRGINDILIACVDGTNGFKEAIKAVFPNTEIQRCIIHQIRNSSKYLSYK
ref|ZP_02326599.1|        KFWLSVLKDLKNRGVQDILITCVDNLNGFSEAITASYPKTEIQKCIIHQIRNSTRYVSYK
RAAC03826                 KFWLGVLKDLKNRGVQDVLVFSTDNLKGFSEAIAACFPQSDVQKCIVHQIRNSLRYVSYK
ref|YP_001212943.1|       SFWLGVCNDLKNRGVQDILIACKDGLSGFSEAISSAFPRTEIQLCIIHQIRNSMKYVPYK
ref|YP_001113174.1|       KFWLGVCNDLKSRGVEDILIACKDGLSGFSEAINTAFPKTQIQLCVIHQIRNSLKYVPYK
                           .:** : *:** **:*:*:    .  *.*.**.:**  : :*.:::* *::****** :*:.**

ref|ZP_02851608.1|        DRKEFCSDLKNVYRAPTEEVALIELDKLEEKWGDKYEISIRSWRNNWDKLSVMFKYPEEV
ref|YP_001307815.1|       DLKAFNTDLKSVYKAPTEDVALAELDNLEEKWGGKYLIAIKSWRNNWDELSTFFKYPPEI
ref|ZP_02326599.1|        DLKKVTADLKPIYKASTEEAAVLELDRFEEVWGSKYFLIIRSWRNNWAELATFFKYPPEI
RAAC03826                 DFKAVAAALKPIYQAPTEEAALMELDQFERGWGARYPLCVKSWRDNWTELATFYRYPVEM
ref|YP_001212943.1|       YQKELIADLKKIYQALTIEEAEMSFTTFKGKWGKKHPIIVRSWENNWLELTAYFKYPYEI
ref|YP_001113174.1|       YRKELMKDLKKVYQALTIEEAEFAFEEFKEKWGSKYPVVIKSWENNWVELTTYFQYPRGI
                           *  .  ** :*:* * :* *   ::   ** ::  : ::**.:** :*:. ::**   :

ref|ZP_02851608.1|        RKLIYTNNSMESYNRQLRKVTKSKSIFPTDESLLKMLYLATMDITKKWTMRTKNWAQILG
ref|YP_001307815.1|       RKIIYTTNAMESYNRQLRKVTKSKSIFPNDESLLKILYLATIDITKKWTQGIKGWAQILA
ref|ZP_02326599.1|        RRLIYTTNMIESYHRQLRKVTKGKSIFPSDEALLK-------------------------
RAAC03826                 RRIMYTTNIIEGYHRQLRKATKGKSMFPNDEALLKMLYLATMELDRKWTMRVANWGTILG
ref|YP_001212943.1|       RRMIYTTNIIEGYHRQLRKVTKTKTAYPTDEALVKIIYLATIEASKKWTMSTKDWKNCIS
ref|YP_001113174.1|       RRMIYTTNVIEGYHRQLRKVTKTKTAYPSDEALVKMLYLATLDASKKWTMPLREWRECIS
                           *:::**.* :*.*:***. *:  :*.**:*:* ref|ZP_02851608.1|        QLSIYFEGRL-----
ref|YP_001307815.1|       QLSIFFEGRL-----
ref|ZP_02326599.1|        ----------------
RAAC03826                 QLAIYFGDRVTPYTP
ref|YP_001212943.1|       QFAIYFEDRL   ---
ref|YP_001113174.1|       QFLIFFGDRL-----
```

FIG. 128

```
ref|ZP_01592598.1|     ----------------RYDRKATIVTSQLPIKAWYDAMQDPTLADAILDRL----------
RAAC02717              MNKLGGAGRNLPAAPRYALNSTCVASQLPIEAWYDTFADPTVADAVLDRLAKCSQALVEK
ref|ZP_01002160.1|     ----------------RYERKSTVITSQLPIEKWYDIIADPTLADAILDRL----------
ref|YP_771767.1|       -----------------RYEVGSTLITSQLPIDAWHDVIGEPTFADAILDRL----------
ref|YP_001229345.1|    ---------------RHGITSTIIASQIPTEKWHDAIGDPTIADAVLDRLVHNAHMITMK
ref|YP_245447.1|       --------------------SLLITSQYPQEKWYELFADPTIADAILDRIIHKSHTLQLK
                                         :  ::** *  . *::  :  :**.***:**:

ref|ZP_01592598.1|     ------------
RAAC02717              AITKELIEGRRN
ref|ZP_01002160.1|     ------------
ref|YP_771767.1|       ------------
ref|YP_001229345.1|    ------------
ref|YP_245447.1|       GESMRKVRARRS
```

FIG. 129

```
ref|YP_145872.1|        ------------------------------------------------------------
ref|YP_001124150.1|     ------------------------------------------------------------
ref|NP_240902.1|        ------------------------------------------------------------
ref|NP_466224.1|        INATINPRTEINRECRLISTERIAMNCYTGENESREFZPRECMBINATINPRTEINRECR
ref|ZP_02850412.1|      ------------------------------------------------------------
RAAC01155               ------------------------------------------------------------ ref|YP_145872.1|        ------------------------------------------------------------
ref|YP_001124150.1|     ------------------------------------------------------------
ref|NP_240902.1|        ------------------------------------------------------------
ref|NP_466224.1|        LISTERIAMNCYTGENESREFZPRECMBINATINPRTEINRECRLISTERIAMNCYTGEN
ref|ZP_02850412.1|      ------------------------------------------------------------
RAAC01155               ------------------------------------------------------------ ref|YP_145872.1|        ------------------------------------------------------------
ref|YP_001124150.1|     ------------------------------------------------------------
ref|NP_240902.1|        ------------------------------------------------------------
ref|NP_466224.1|        ESSREFZPRECMBINATINPRTEINRECRLISTERIAMNCYTGENESHPBREFZPRECMB
ref|ZP_02850412.1|      ------------------------------------------------------------
RAAC01155               ------------------------------------------------------------ ref|YP_145872.1|        ------------------------------------------------------------
ref|YP_001124150.1|     ------------------------------------------------------------
ref|NP_240902.1|        ------------------------------------------------------------
ref|NP_466224.1|        INATINPRTEINRECRLISTERIAMNCYTGENESFSL-REFZPRECMBINATINPRTEIN
ref|ZP_02850412.1|      ------------------------------------------------------------
RAAC01155               ------------------------------------------------------------ ref|YP_145872.1|        ------------------------------------------------------------
ref|YP_001124150.1|     ------------------------------------------------------------
ref|NP_240902.1|        ------------------------------------------------------------
ref|NP_466224.1|        RECRLISTERIAMNCYTGENESLREFZPRECMBINATINPRTEINRECRLISTERIAMNC
ref|ZP_02850412.1|      ------------------------------------------------------------
RAAC01155               ------------------------------------------------------------ ref|YP_145872.1|        ------------------------------------------------------------
ref|YP_001124150.1|     ------------------------------------------------------------
ref|NP_240902.1|        ------------------------------------------------------------
ref|NP_466224.1|        YTGENESFSLR-REFZPRECMBINATINPRTEINRECRLISTERIAMNCYTGENESFSL-
ref|ZP_02850412.1|      ------------------------------------------------------------
RAAC01155               ------------------------------------------------------------ ref|YP_145872.1|        ------------------------------------------------------------
ref|YP_001124150.1|     ------------------------------------------------------------
ref|NP_240902.1|        ------------------------------------------------------------
ref|NP_466224.1|        REFZPRECMBINATINPRTEINRECRLISTERIAMNCYTGENESFSL-REFZPRECMBIN
ref|ZP_02850412.1|      ------------------------------------------------------------
RAAC01155               ------------------------------------------------------------ ref|YP_145872.1|        ------------------------------------------------------------
ref|YP_001124150.1|     ------------------------------------------------------------
ref|NP_240902.1|        ------------------------------------------------------------
ref|NP_466224.1|        ATINPRTEINRECRLISTERIAMNCYTGENESFSL-SPQYXRECRLISMRECMBINATIN
ref|ZP_02850412.1|      ------------------------------------------------------------
RAAC01155               ------------------------------------------------------------
``` continued →

FIG. 129 continued

```
ref|YP_145872.1|       ------------------------------------------------------------
ref|YP_001124150.1|    ------------------------------------------------------------
ref|NP_240902.1|       ------------------------------------------------------------
ref|NP_466224.1|       PRTEINRECRSPQWRECRLISMFRECMBINATINPRTEINRECREMBCADRECRLISTER
ref|ZP_02850412.1|     ------------------------------------------------------------
RAAC01155              ------------------------------------------------------------ ref|YP_145872.1|       ------------------------------------------------------------
ref|YP_001124150.1|    ------------------------------------------------------------
ref|NP_240902.1|       ------------------------------------------------------------
ref|NP_466224.1|       IAMNCYTGENESGBAATRECMBINATINPRTEINRECRLISTERIAMNCYTGENESSTRB
ref|ZP_02850412.1|     ------------------------------------------------------------
RAAC01155              ------------------------------------------------------------ ref|YP_145872.1|       ------------------------------------------------------------
ref|YP_001124150.1|    ------------------------------------------------------------
ref|NP_240902.1|       ------------------------------------------------------------
ref|NP_466224.1|       FGBEALRECMBINATINPRTEINRECRLISTERIAMNCYTGENESSTRAFGBEBARECMB
ref|ZP_02850412.1|     ------------------------------------------------------------
RAAC01155              ------------------------------------------------------------ ref|YP_145872.1|       ------------------------------------------------------------
ref|YP_001124150.1|    ------------------------------------------------------------
ref|NP_240902.1|       ------------------------------------------------------------
ref|NP_466224.1|       INATINPRTEINRECRLISTERIAMNCYTGENESGBEBARECMBINATINPRTEINRECR
ref|ZP_02850412.1|     ------------------------------------------------------------
RAAC01155              ------------------------------------------------------------ ref|YP_145872.1|       ------------------------------------------------------------
ref|YP_001124150.1|    ------------------------------------------------------------
ref|NP_240902.1|       ------------------------------------------------------------
ref|NP_466224.1|       LISTERIAMNCYTGENESSGBEBARECMBINATINPRTEINRECRLISTERIAMNCYTGE
ref|ZP_02850412.1|     ------------------------------------------------------------
RAAC01155              ------------------------------------------------------------ ref|YP_145872.1|       ------------------------------------------------------------
ref|YP_001124150.1|    ------------------------------------------------------------
ref|NP_240902.1|       ------------------------------------------------------------
ref|NP_466224.1|       NESGBEBARECMBINATINPRTEINRECRLISTERIAMNCYTGENESFSLN-GBEBAREC
ref|ZP_02850412.1|     ------------------------------------------------------------
RAAC01155              ------------------------------------------------------------ ref|YP_145872.1|       ------------------------------------------------------------
ref|YP_001124150.1|    ------------------------------------------------------------
ref|NP_240902.1|       ------------------------------------------------------------
ref|NP_466224.1|       MBINATINPRTEINRECRLISTERIAMNCYTGENESFSLN-GBEBARECMBINATINPRT
ref|ZP_02850412.1|     ------------------------------------------------------------
RAAC01155              ------------------------------------------------------------ ref|YP_145872.1|       ------------------------------------------------------------
ref|YP_001124150.1|    ------------------------------------------------------------
ref|NP_240902.1|       ------------------------------------------------------------
ref|NP_466224.1|       EINRECRLISTERIAMNCYTGENESFGBEBARECMBINATINPRTEINRECRLISTERIA
ref|ZP_02850412.1|     ------------------------------------------------------------
RAAC01155              ------------------------------------------------------------
``` continued →

FIG. 129 continued

```
ref|YP_145872.1|         --------------------------------------------------------YPEPLSK
ref|YP_001124150.1|      --------------------------------------------------------YPEPISK
ref|NP_240902.1|         --------------------------------------------------------YPEPIAK
ref|NP_466224.1|         MNCYTGENESHPBSCRESIGNIFICANCEE-IDENTITIESPSITIVESGAPSYPEPITK
ref|ZP_02850412.1|       --------------------------------------------------------YPEPIAK
RAAC01155                ------------------------------------------------------MYGYPEPVAR
                                                                                 ****.::

ref|YP_145872.1|         LIDSFMKLPGIGPKTAARLAFHVLAMKEDTVLEFAKALVDVKRHIHYCTICGHITDTDPC
ref|YP_001124150.1|      LIDSFMKLPGIGPKTAARLAFHVLAMKEDTVLEFAKALVDVKRHIHYCTICGHITDTDPC
ref|NP_240902.1|         LIEGFMRLPGIGPKTASRLAFFVLEMKEDDVLDFAKALVNVKRKLTYCSVCHNITDTDPC
ref|NP_466224.1|         LIDSFMKLPGIGPKSAARLAFYVLDMKEDDVLDFAKALVDAKRNLSFCSVCGHITDKDPC
ref|ZP_02850412.1|       LIDAFTRLPGVGPKTAARLAFHVLRMKEDDVIDFAKALVSVKRNLTYCSVCCNITDTDPC
RAAC01155                AIEHFMKLPGVGPKTAARLAFHVLEMSEADVKAFAKALIDLKTGLTECAVCCNITEASPC
                         *: *  :***:***:*:****.** *.*  *   *****:.  *   : *::* :**: .**

ref|YP_145872.1|         YICKDERRDRTTICVVQDPKDVIAMERMKEYNGLYHVLHGAISPMEGIGPEDIKIAELLT
ref|YP_001124150.1|      YICKDERRDRTMICVVQDPKDVIAMEKMKEYNGLYHVLHGAISPMEGIGPEDIKIAELLA
ref|NP_240902.1|         RICEDSKRDESVICVVQDAKDVIAMEKMKEYHGKYHVLHGAISPMDGIGPEDIKIPELIK
ref|NP_466224.1|         YICADTSRDRSVICVVQESKDVIAMEKMRDFHGLYHVLHGTISPMDGIGPEDINIPDLLK
ref|ZP_02850412.1|       RICQDKTRDNSVICVVQESKDLVAMERTKEFQGFYHVLQGAISPIEGIGPDQIKIAELLR
RAAC01155                AICRDPRRDRRVICVVQEPRDVIAMERTREYHGLYHVLHGAISPMEGVGPQDIRIRELVT
                          ** *   **.  *****:.:*::***: :::: * ****:*:*** ::*:**::*.*  :*:

ref|YP_145872.1|         RLQDETVQEVILATDPNIEGEATAMYISRLLKPTGIKVTRIAHGLPVGGDLEYADEVTLS
ref|YP_001124150.1|      RLQDETIQEVILATDPNIEGEATAMYLSRLLKPTGIKITRIAHGLPVGGDLEYADEVTLS
ref|NP_240902.1|         RLQDDTIQEVIVATNPTIEGEATAMYISRLVKPTGIKVTRIAHGLPVGGDLEYADEVTLS
ref|NP_466224.1|         RLQDDTIEEVILATNPNVEGEATAMYISRLLKPSGIKVTRIAHGLPVGGDLEYADEVTLS
ref|ZP_02850412.1|       RLSDERVQELILATNPNIEGEATAMYISRLVKPFGIRVTRIAHGLPVGGDLEYADEVTLS
RAAC01155                RVGENEIEEVILATNPNVEGEATAMYISRLLKPFQVKLTRIAHGLPVGGDLEYADEVTLA
                         *:  :: ::*:*:**:*.:********:***:**  :::********************:

ref|YP_145872.1|         KALEGRREL
ref|YP_001124150.1|      KALEGRREL
ref|NP_240902.1|         KAMEGRREL
ref|NP_466224.1|         KAMEGRR--
ref|ZP_02850412.1|       KALEGRREL
RAAC01155                KALEGRRAL
                         **:****
```

FIG. 130

```
dbj|BAA94830.1|      ------------------------------------------------------------
RAAC03145            ------------------------------------------------------------
ref|ZP_01666433.1|   ------------------------------------------------------------
ref|YP_001213263.1|  ------------------------------------------------------------
ref|YP_387030.1|     PSASEPRTEINDESULFVIBRIDESULFURICANSGREFYPPUTATIVETRANSPSASEP
ref|YP_387237.1|     ------------------------------------------------------------ dbj|BAA94830.1|      ------------------------------------------------------------
RAAC03145            ------------------------------------------------------------
ref|ZP_01666433.1|   ------------------------------------------------------------
ref|YP_001213263.1|  ------------------------------------------------------------
ref|YP_387030.1|     RTEINDESULFVIBRIDESULFURICANSGREFYPPUTATIVETRANSPSASEPRTEIND
ref|YP_387237.1|     ------------------------------------------------------------ dbj|BAA94830.1|      ------------------------------------------------------------
RAAC03145            ------------------------------------------------------------
ref|ZP_01666433.1|   ------------------------------------------------------------
ref|YP_001213263.1|  ------------------------------------------------------------
ref|YP_387030.1|     ESULFVIBRIDESULFURICANSGGBABBPUTATIVETRANSPSASEPRTEINDESULFV
ref|YP_387237.1|     ------------------------------------------------------------ dbj|BAA94830.1|      ------------------------------------------------------------
RAAC03145            ------------------------------------------------------------
ref|ZP_01666433.1|   ------------------------------------------------------------
ref|YP_001213263.1|  ------------------------------------------------------------
ref|YP_387030.1|     IBRIDESULFURICANSGGBABBPUTATIVETRANSPSASEPRTEINDESULFVIBRIDE
ref|YP_387237.1|     ------------------------------------------------------------ dbj|BAA94830.1|      ------------------------------------------------------------
RAAC03145            ------------------------------------------------------------
ref|ZP_01666433.1|   ------------------------------------------------------------
ref|YP_001213263.1|  ------------------------------------------------------------
ref|YP_387030.1|     SULFURICANSGGBABBPUTATIVETRANSPSASEPRTEINDESULFVIBRIDESULFUR
ref|YP_387237.1|     ------------------------------------------------------------ dbj|BAA94830.1|      ------------------------------------------------------------
RAAC03145            ------------------------------------------------------------
ref|ZP_01666433.1|   ------------------------------------------------------------
ref|YP_001213263.1|  ------------------------------------------------------------
ref|YP_387030.1|     ICANSGGBABBPUTATIVETRANSPSASEPRTEINDESULFVIBRIDESULFURICANSG
ref|YP_387237.1|     ------------------------------------------------------------ dbj|BAA94830.1|      ------------------------------------------------------------
RAAC03145            ------------------------------------------------------------
ref|ZP_01666433.1|   ------------------------------------------------------------
ref|YP_001213263.1|  ------------------------------------------------------------
ref|YP_387030.1|     GBABBPUTATIVETRANSPSASEPRTEINDESULFVIBRIDESULFURICANSGGBABBP
ref|YP_387237.1|     ------------------------------------------------------------ dbj|BAA94830.1|      ------------------------------------------------------------
RAAC03145            ------------------------------------------------------------
ref|ZP_01666433.1|   ------------------------------------------------------------
ref|YP_001213263.1|  ------------------------------------------------------------
ref|YP_387030.1|     UTATIVETRANSPSASEPRTEINDESULFVIBRIDESULFURICANSGGBABBPUTATIV
ref|YP_387237.1|     ------------------------------------------------------------
``` continued →

FIG. 130 continued

```
dbj|BAA94830.1|       ------------------------------------------------------------
RAAC03145             ------------------------------------------------------------
ref|ZP_01666433.1|    ------------------------------------------------------------
ref|YP_001213263.1|   ------------------------------------------------------------
ref|YP_387030.1|      ETRANSPSASEPRTEINDESULFVIBRIDESULFURICANSGGBABBPUTATIVETRANS
ref|YP_387237.1|      ------------------------------------------------------------ dbj|BAA94830.1|       ------------------------------------------------------------
RAAC03145             ------------------------------------------------------------
ref|ZP_01666433.1|    ------------------------------------------------------------
ref|YP_001213263.1|   ------------------------------------------------------------
ref|YP_387030.1|      PSASEPRTEINDESULFVIBRIDESULFURICANSGGBABBPUTATIVETRANSPSASEP
ref|YP_387237.1|      ------------------------------------------------------------ dbj|BAA94830.1|       ------------------------------------------------------------
RAAC03145             ------------------------------------------------------------
ref|ZP_01666433.1|    ------------------------------------------------------------
ref|YP_001213263.1|   ------------------------------------------------------------
ref|YP_387030.1|      RTEINDESULFVIBRIDESULFURICANSGSCRESIGNIFICANCEE-IDENTITIESPS
ref|YP_387237.1|      ------------------------------------------------------------ dbj|BAA94830.1|       -----MSKEQITLTKNELKRVMVIEKWIDGHLTEQDVARNLGISVRQAYRLKAKYRHGGA
RAAC03145             MKMSCMSKEYLVMRQEEARRLTVISKLIDGHLSVAQAAEYLQLSIRQVLRIKKRVLEEGE
ref|ZP_01666433.1|    --MSLMEKEKIFLSDKEVRRAIVIDKVIQGVCTIAEAAEVLSLSERQVKRLKAGVIKEGF
ref|YP_001213263.1|   ---------LSMTQDERNKLYVARCLLDGKMTISEAAETLGLSERQVKRIKKGVKEHGE
ref|YP_387030.1|      ITIVESGAPSVLMKAEEARRAFVIKQAVAGAFTVREAGEVLGLSYRQVIRLKNRYRKEGA
ref|YP_387237.1|      -----------MKAEEARRAFVIKQAVAGAFTVREAGEVLGLSYRQVIRLKNRYRKEGA
                                 :  .*  .:   *    : *    :   *  :* **. *:*    . * dbj|BAA94830.1|       QAIAHGNRGRKPAHTLTDSLKQRVMLLYQER-YFGSNATHFAELLAEHENIHLSVSSVRR
RAAC03145             AGVIHKNRGRQPSHTLPQSLKHKIVALYQSDDYRGCNDTHFTELLAVRENIYVSTSTVRR
ref|ZP_01666433.1|    GFLAHGNRGRKPAHAISDELREQVLAIIRQPVFCEANDSHLTELLAEHYNIFLSVSSIRR
ref|YP_001213263.1|   SFVIHKNRGRKPPHALTDEVRKLVVNLKKSEKYSKANFSHFQELLEEFESISLSKPSVYR
ref|YP_387030.1|      VGLVHKGRGKASNRRIAQEIRKFVAEKAKSD-FEGASCQHMEELFASRYGLELSAKSIGR
ref|YP_387237.1|      VGLVHKGRGKASNRRIAQEIRKFVAEKAKSD-FEGASCQHMEELFASRYGLELSAKSIGR
                        :  * .**:  .  :  :..:.::  :     :.   :  .. *: **:   .: :*  :: * dbj|BAA94830.1|       ILLEGGLRPARLRRRPKAHRPRPRKPQAGMLWQIDASPYAWLEDRGPMLTLHGIIDDATG
RAAC03145             ILRAAGISAARKHRAPRSHRSRRRMPQAGLLWQMDASTFDWLEDRGPRLTLHAAIDDATG
ref|ZP_01666433.1|    IRRSAGISSPRKHRRPKFHRRRKRREQEGMLIQMDGSPHAWLGEDKPYISLIGAIDDATG
ref|YP_001213263.1|   ILVANGLTSPKKHSKVKRHKRRKRKPQRGMLVIIDASPHAWFFNNEE-CSLHGAVDDATG
ref|YP_387030.1|      ILKEQGVACAHRHRSPKGRRCRERSRRRGDLVQMDASPFDWLG-DGVMRSLHGAIDDATG
ref|YP_387237.1|      ILKEQGVACAHRHRSPKGRRCRERSRRRGDLVQMDASPFDWLG-DGVMRSLHGAIDDATG
                      *      *:   .: :      : :: *  *    : * * :*.*..  *:         :* . :***** dbj|BAA94830.1|       EVVAATFRPTETLEGYVTVMIEGLRRKGVPLALYSDQHSIFHPPKG-KPTLEQELAGEPP
RAAC03145             RIVGAAFARTECLEGYWSVLHHGITAYGIPVALYVDRHTIFRSPKADKLTIDEELAGVKP
ref|ZP_01666433.1|    KIVGAIFRPTEDLNGYFEVLRQIITKYGIPIAVYTDRHSIFVSPNADKLTIEDQLEGKKA
ref|YP_001213263.1|   EILALFFMRNECLEGHYQVMKTVISNNGVPLAVYADRHTIFRSPKSDKLSLEEELNGKKV
ref|YP_387030.1|      EVVGLWIEKNECLSGYLRVLRQMLERHGVPRAIYADRHTIFVSPKTGKLTIEEELQGKVA
ref|YP_387237.1|      EVVGLWIEKNECLSGYLRVLRQMLERHGVPRAIYADRHTIFVSPKTGKLTIEEELQGKVA
                       .::.    .  :  *  *.*:  *:       :     *:* *:* *:.** .*: :::::* * dbj|BAA94830.1|       SLSTFGQALADLGITHIEALSPQAKGRIERLWQTFQDRLVIELRLRNVCTMEEANRVLPE
RAAC03145             S-TQLGRAVAELGISLTFARSPQAKGRIERLWETLQDRLTHELRLHRISTLEAANAFLPA
ref|ZP_01666433.1|    NLTQLGRALSELGIEHIKARSAQAKGRVERLWETLQDRLRIEMALAGIQTIEQANEFLQK
ref|YP_001213263.1|   KATQFGRAMAELGINLIWAKSAQAKGRIERLWETLQSRLPVELNIAGITTMEEANAFLAT
ref|YP_387030.1|      PQTQFGRVLETLGVRFIAARSPQAKGRIERLWRTLQSRLVIAFRLAGIRTVEAANDFLGT
ref|YP_387237.1|      PQTQFGRVLETLGVRFIAARSPQAKGRIERLWRTLQSRLVIAFRLAGIRTVEAANDFLGT
                         : :*:..  :       * *.***:**.*:*..**     :  *   *:* ** .* continued →
```

FIG. 130 continued

```
dbj|BAA94830.1|         LIAK-HNRQFAVAPQEAEPAYRPLPETP-LEHIFTRREYRRISGGQTFFWKGKCYMPKPV
RAAC03145               FVER-FNARFAVEPESPEPAYRPLAPHHNLHRILCYRAWRKVSPGQTISWKGQTYRIVPE
ref|ZP_01666433.1|      FILK-HNAMFEVEPANPNSAYRPAPSEESLREILCVKEKRKLKGG-VLSFQGQLYKLD--
ref|YP_001213263.1|     FINK-YNEKFAVEPKDPQPAFRKLEDNINLDYILCTKETRQIDRGSAFSYGGVYYRVICN
ref|YP_387030.1|        YAEQMHNPKFAGAPAEAQNAFLPVVEGTNLDLLLARHEQRKACGDSTVAFGGQKYRLQDS
ref|YP_387237.1|        YAEQMHNPKFAGAPAEAQNAFLPVVEGTNLDLLLARHEQRKACGDSTVAFGGQKYRLQDS
                         : .*   *    *  ..: *:         *  ::   :  *:   . .. : *  * dbj|BAA94830.1|         PGVPRWEAKS-VVEVRVGMDGQVWLWD--QGRAWPCVETQ---ATQTPAPTTAKKEAAPA
RAAC03145               QHRETLAPRS-TVEVRVTTNGELWIVAG-QGRLYRLEPCS---KSPAVKRREDATPTPSR
ref|ZP_01666433.1|      -GLPAYFPDT-TVLVHVHPDGKLRASYPKQNVVYDLTRVS---EPVRTKSQPKEKAGPPP
ref|YP_001213263.1|     GKTMPIAPKA-KITVLKSPQFGLKVQYG--SSIYDIEILE---QLP-PKDIAPGQPRQPR
ref|YP_387030.1|        RGRTRLLRRGKAVTVVEKLDDELMALADGEAFVLVPVVTGKSSEEPASEEKSLARGAQER
ref|YP_387237.1|        RGRTRLLRRGKAVTVVEKLDDELMALADGEAFVLVPVVTGKSSEEPASEEKSLARGAQER
                             :    *          :   :

dbj|BAA94830.1|         SPRKPAANHPWRK--------------------
RAAC03145               QPYKPPADHPWRRMTLGRPKPKLPTPSAEAISP
ref|ZP_01666433.1|      TPRRPAPDHPWRK--------------------
ref|YP_001213263.1|     KPVKPAENHPWRTKTTTFP--------------
ref|YP_387030.1|        EQTSPAAESSW----------------------
ref|YP_387237.1|        EQTSPAAESSW----------------------
                            *.  :  .*
```

FIG. 131

```
ref|YP_148969.1|      ----------------------YLQLAHNEWDPKAKYAKAKVIYSFGREDEVDRAVLER
ref|YP_001126171.1|   ----------------------YLQLAHNEWDPKAKYAKAKVIYSFGREDEVDRAVLER
ref|YP_146154.1|      ------------------------------------------------------------
ref|YP_146741.1|      ------MYIRRVTRKNKDGTTVAYLQLAHNEWDPKAKYAKAKVIYSFGREDEVDRAVLER
RAAC03325             MSYHVDMYIRVIRRKNKNGSVTGYVQLAHNYRDPQTGQPKAKVLYTFGREDEMDLEALRR
ref|ZP_02130848.1|    ------MYIRTISRKNKDGSKVEYVQLAHNYRDPKSKQARAEVLYSFGRKDQLDMEAIRR ref|YP_148969.1|      LAKSISRFLSPEQAWEIETLTGEVSDDFQFQSSKRLGGAWLLDQLWRQLGLGEILHSLFA
ref|YP_001126171.1|   LAKSISRFLSPEQAWEIETLTGEVSDDFQFQSSKRLGGAWLLDQLWRQLGLGEILHSLFA
ref|YP_146154.1|      ------------------------------------------------------------
ref|YP_146741.1|      LAKSISRFLSPEQAWEVEKLTGEASDDFQFQSCKHLGGVWLLDQLWRQLGLGEILHSLFT
RAAC03325             LAQSIHRFVG--DEFTSGRGQSEAIQTTLLDS-RPMGGAYLLDELWRQLELDEVLRERLV
ref|ZP_02130848.1|    LAKSVERFLAKTGDVETQCKLQFPGEDVRFVESRPMGGVFVLKKIWDRLRISECLDKALA ref|YP_148969.1|      SRHHQIPLERLIFAMVANRALHPSSKLAMEEWVEKDVHIPHLPQVASHQLYRAMDELLAV
ref|YP_001126171.1|   SRHHQIPLERLIFAMVANRALHPSSKLAMEEWVEKDVHIPHLPQGASHQLYRAMDELLAV
ref|YP_146154.1|      -------LERLIFAMVANRALHPSSKLAMEEWVEKDVHIPHLPQVASHQLYRAMDELLAV
ref|YP_146741.1|      SRHHQISLERLIFAMVANRALHPSSKLAMEEWVEKDVYIPHLPQVASHQLYRAMDELLAV
RAAC03325             DRKFKAAVERVIFAMVANRALAPSSKLAMEEWVEREVALPGMTELDVWQAYRAMDVLHDV
ref|ZP_02130848.1|    DRQYTAPIGDAVFAMVANRALAPDSKLAVEDWAAKDVHLELDQPLKVQHLYRAMDFLLEN
                            :  :*********.*.****:*:*. ::*  :      :  ***** * ref|YP_148969.1|      QPELERQVFHAVADLLNLEVDLIYFDTTSSYFEVDPSETPEGESLRKQGFSKDKRPDLVQ
ref|YP_001126171.1|   QPELERQVFHAVADLLNLEVDLIYFDTTSSYFEVDPSETPEGESLRKQGFSKDKRPDLVQ
ref|YP_146154.1|      QPELERQVFHAVADLLNLEVDLIYFDTTSSYFEVDPSETPEGESLRKQGFSKDKRPDLVQ
ref|YP_146741.1|      QPELERQVFHAVADLLNLEVDLIYFDTTSSYFEVDPSETPEGESLRKQGFSKDKRPDLVQ
RAAC03325             TEELQYEVFRRVSNLLNLDVDLLFFDTTSTYFETE--DEPE-DGLRRKGYSKDHRPDLPQ
ref|ZP_02130848.1|    QEAIQKEVFWSTANLLNLEVDLVFFDTTSTYFERD---EEDEEGLKRYGHSKDKRKDLPQ
                       :  : .:.:*:**.* :            : :.*:: *.*: * ref|YP_148969.1|      IVIGLAVTREGVPIRAWVWPGNTMDMTVIKQVKQDLIGWKLGRVISVMDRGFSSEENLRI
ref|YP_001126171.1|   IVIGLAVTREGVPIRAWVWPGNTMDMTVIKQVKQDLIGWKLGRVISVMDRGFSSEENLRI
ref|YP_146154.1|      IVIGLAVTREGVPIRAWVWPGNTMDMTVIKQVKQDLIGWKLGRVISVMDRGFSSEENLRI
ref|YP_146741.1|      IVIGLAVTREGIPIRAWVWPGNTMDMTVIKQVKQDLIGWKLGRVISVMDRGFSSEENLRI
RAAC03325             VVIGLAVTRDGIPVRCWTWPGNTADMSVVEEVKQGLIGWRLGRVITVVDRGFVSESNLRI
ref|ZP_02130848.1|    VVVGLAVTKEGLPIRSWVFPGNTPDVNTVEQIQKEMNDWKLGRVVWAMDRGMTSEENRAI
                      :*:*****:.*:*:*.*.:****  *:.:::::: :  .*:**: .:*:.**.* * ref|YP_148969.1|      LQQAGGHYIVGEKMRSGKAAVEEALNRRGRYQQVRENLHIKEIIVGDGEARQRYVLVYNP
ref|YP_001126171.1|   LQQAGGHYIVGEKMRSGKAAVEEALNRRGRYQQVRENLHIKEIIVGDGEARQRYVLVYNP
ref|YP_146154.1|      LQQAGGHYIVGEKMRSGKAAVEEALNRRGRYQQVRENLHIKEIIVGDGEARQRYVLVYNP
ref|YP_146741.1|      LQQAGGHYIVGENMRSGKAAVEEALSRRGRYHEVDENLHIKEIIVGDGEARQRYVLVYNP
RAAC03325             LQRAGGHYIAGEKMNSGKSAVEVALARPGRFRELRPNLKVKEVVVGDGEARVRYVLAFNP
ref|ZP_02130848.1|    LQRGGGNYILGEKLR-GSNMSKAVLGSPGRFTTVRDNLEIKEVTAGDGACRRRYVIVRNP
                      :.:. **::.  *.   : .*   : :  .:**.  .* *.* ref|YP_148969.1|      SEAERQRKEREKLLESLKEELEGLRQLPNEAHHKATCRLRSHPSYGKYLRQLKDGTLRID
ref|YP_001126171.1|   SEAERQRKEREKLLESLKEELEGLRQLPNEAHHKATCRLRSHPSYGKYLRQLKDGTLRID
ref|YP_146154.1|      SEAERQRKEREKLLESLKEELEGLRQLPNEAHHKATCRLRSHPSYGKYLRQLKDGTLRID
ref|YP_146741.1|      GEAERQRKERETLLESLKEELEGLRQLPNEAHHKATCRLRSHPSYGKYLRQLKDGTLRID
RAAC03325             EEAKRDEARREAMLRELRELERLKELQGEAHTKAHCRLASHPTFKRYLKQDRWGNLRID
ref|ZP_02130848.1|    KQVKRDQATRERLIRRAEQEIEAIGDLTGKKHTKAACALLSHRSMGKYVRELKSGKLKIN
                      :..:*:.  **  :: .:*:* .: ** * * **  *:::  *:::: *.*:*:

ref|YP_148969.1|      KQAVREAEKYDGKYLIRTSDDTLSAEDVALGYKQLVDIEQAFRTLKSTLELRPMYHRLED
ref|YP_001126171.1|   KQAVREAEKYDGKYLIRTSDDTLSAEDVALGYKQLVDIEQAFRTLKSTLELRPMYHRLED
ref|YP_146154.1|      KQAVREAEKYDGKYLIRTSDDTLSAEDVALGYKQLVDIEQAFRTLKSTLELRPMYHRLED
ref|YP_146741.1|      KQAVRDAEKYDGNYLIRTSDDTLSAEDVAIGYKQLVDIEQAFRTLKSTLELRPMYHRLED
RAAC03325             PEAVRQAHLDGKYLIRTSDDTLSTEDVALGYKQLLMVESAFRTLKTTLDIRPMYHRKDE
ref|ZP_02130848.1|    KAKITEEEKLDGKYLLSCSDDTLSPEEIALGYKQLLEVERAFRTLKSTLDLRPVYHRKDE
                       : :   : **:**: ******.*::*****.*::*****:**:*:*** ::
``` continued →

FIG. 131 continued

```
dbj|BAA94830.1|         LIAK-HNRQFAVAPQEAEPAYRPLPETP-LEHIFTRREYRRISGGQTFFWKGKCYMPKPV
RAAC03145               FVER-FNARFAVEPESPEPAYRPLAPHHNLHRILCYRAWRKVSPGQTISWKGQTYRIVPE
ref|ZP_01666433.1|      FILK-HNAMFEVEPANPNSAYRPAPSEESLREILCVKEKRKLKGG-VLSFQGQLYKLD--
ref|YP_001213263.1|     FINK-YNEKFAVEPKDPQPAFRKLEDNINLDYILCTKETRQIDRGSAFSYGGVYYRVICN
ref|YP_387030.1|        YAEQMHNPKFAGAPAEAQNAFLPVVEGTNLDLLLARHEQRKACGDSTVAFGGQKYRLQDS
ref|YP_387237.1|        YAEQMHNPKFAGAPAEAQNAFLPVVEGTNLDLLLARHEQRKACGDSTVAFGGQKYRLQDS
                          :.*  *    *  ..: *:          *   ::   : *:   . ... :  *  * ref|YP_148969.1|        RIRAHVLLSWLALLLVRIVEIRTHESWPKVRDECERLMLGHFSSKNGDLYQRTELTAKQA
ref|YP_001126171.1|     RIRAHVLLSWLALLLVRIVEIRTHESWPKVRDECERLMLGHFSSKNGDLYQRTELTAKQA
ref|YP_146154.1|        RIRAHVLLSWLALLLVRIVEIRTHESWPKVRDECERLMLGHFSSKNGDLYQRTELTAKQA
ref|YP_146741.1|        RIRAHVLLSWLALLLVRIVEIRTHESWPKVRDECERLMLGHFSSKNGDLYQRTELTAKQA
RAAC03325               RIRSHVLLCWLALLLVRIAEVQTGRTWSDIRSHMQAMHQVTKSTPDGMVVQRTETTEVQR
ref|ZP_02130848.1|      RIRSHVTLCWLALLLVRLIELETGMTWNQVRRILERLHMGEFFLNNSRILQRTELTQDQN
                        *: *.********: *:.*   :* ..:*    : :         :. : **** *  * ref|YP_148969.1|        LFLAALGLEPPPKILGIHPRT---
ref|YP_001126171.1|     LFLAALGLEPPPKILGIHPRT---
ref|YP_146154.1|        LFLAALGLEPPPKILGIHPRT---
ref|YP_146741.1|        QLFAALGLEPPPKILGIHPR----
RAAC03325               EILRALRIKEPPRILKVEPRTRGL
ref|ZP_02130848.1|      KLLKKLKIKPPPLIKKID------
                         ::   *  :: ** *  :.
```

FIG. 132

```
ref|ZP_02851608.1|      MNLIDKKKVREMMKEGKLKDVNDIQDLLKEQFGELIEEMLEGELDHELGYSKYDYREKET
ref|YP_001307815.1|     MSLSRDELVKLILSNSDTKTTEDIQNTLKDLFGGVLQQMLESEMESHLGYAKHDYENKNT
ref|ZP_02326599.1|      MGLWTKQQLREFIKENNLVTAQDAQNALKELFAETIQEMLEAAELDTHLGYEKHEVKAKKT
RAAC03376               MELLSKEQIRQLIRDGKLKDIHDVQSMLKDLFASTIQEMLEAAELDTHLGYAKYDAKHKDT
ref|YP_001664274.1|     MSLLTKEQLRNFISENNIQSIPDLYTSLKNLFKDTIQEMLEAAELSTELGYERYDKKDKDT
ref|YP_001319448.1|     MSTVSKKVLREMITGGDLKTAGDLQSYLKELFKDTLQEMLEAEIESDLGYEKGDRKNKNT
                         *   .: :: ::    ..:     *    **:  *   ::*** .*:. ***  : : . *.* ref|ZP_02851608.1|      TNSRNGK-REKQLKSNYGNLEIEVPRDREGEFEPQVVKKNQRDVSSIDDQVLSMYAKGMT
ref|YP_001307815.1|     SNSRNGK-STKTMKSNLGLFDLDVPRDREGSFEPAIVKKHQTDVSHLESAVIGMYAKGMT
ref|ZP_02326599.1|      PNSRNGR-SHKTVVSEYGFQQQIAVFRDRMGEFEPLVVKKHQSNVTGIEDQIVALYAKGVS
RAAC03376               DNARNGHGAKRTVQSELGDIDIALFRDRKGEFEPLIVQKRQKRMPSTEFQVIALYARGFS
ref|YP_001664274.1|     QNSRNGY-TQKTVKTQFGEMEIDIPRDRQGEFEPKIVPKYKRDISGIEEKVIALYARGMS
ref|YP_001319448.1|     QNRRNGY-SEKTVKSKFGEMEIEVPRDRNGEFEPVVVPKNKRDISGIEEKVISLYARGMS
                         * ***    :  : ::   *   :: :****  *.***   :* *   :  :. ::.  ::.:**:*.:

ref|ZP_02851608.1|      VRDIQTHLQELYGVDASPTLISGITDKIVPLIKEWQNRPISRIYAHVVMDAVHYKVRQDG
ref|YP_001307815.1|     TRDIATQINDIYGMDASPTLISNITDKVIPMLKEWQSRPLESIYPIIFMDAIHFKVRKDN
ref|ZP_02326599.1|      TREIQDHLQNLYGIEVSPTLISNVTNKIVPLIKEWQNRPLQSVYAVVFLDAIHFKVKQDG
RAAC03376               TRDIQDHLQQIYGVDMSPTLVSNLTDRLLPRIQEWQNRPLHPLYTVVFLDAIHYKVREEG
ref|YP_001664274.1|     TRDIHDQTKDLYGIELSAEMVSKITERIVPETKEWQSRPLEKIYTFIFMDAIHYKVRTDG
ref|YP_001319448.1|     TRDIHDQIQDIYGIEISAEMVSKITDKVIPQVKEWQNRALEAIYPFVFMDAIHYKVREDG
                         .*:*    ::::::**::  *.  ::*   :*::::*  :*:**.*.*    :*.  ..:*:*:**:  :.

ref|ZP_02851608.1|      RIVNKKAAYMAIGIDLDGMKEVLGIWIGENESSKYWLKIINELKNRGVEDILIVSIDGLKG
ref|YP_001307815.1|     AIVSKAAYAVIGVNLEGKKDVLGIWIGASESPKYWLDVLNELKNRGTNDILIACVDGLNG
ref|ZP_02326599.1|      AIVSKAAYMVIGIDLDGNKDVLGMWIGENESSKFWLSVINDLKNRGVQDILITCVDNLNG
RAAC03376               RLVSKAAYMVIGIDIEGQKDVLGIWIGQSESSKFWLGVLNDLKARGVQDVLVFSTDNLKG
ref|YP_001664274.1|     HIINRAAYVVLGVTLEGIKDVLGIWIGENESSRFWLGVLNELKNRGVEDVIVFSVDGLTG
ref|YP_001319448.1|     QIKSKAAYVVLGTAMDGMKDILGIWIGESESSKFWLGILNDLKNRGVNDVLIFSVDGLAG
                         :  .:***  ..:*:  ::* ::*  ..::**   ::*: ::*::: .  *.* * ref|ZP_02851608.1|      FEDAIHAVYPQTEIQSCIIHQIRNSTRYISYKDRKEFCSDLKNVYRAPTEEVALIELDKL
ref|YP_001307815.1|     FKEAIKAVFPNTEIQRCIIHQIRNSSKYLSYKDLKAFNTDLKSVYKAPTEDVALAELDNL
ref|ZP_02326599.1|      FSEAITASYPKTEIQKCIIHQIRNSTRYVSYKDLKKVTADLKPIYKASTEEAAVLELDRF
RAAC03376               FSEAIAACFPQSDVQKCIVHQIRNSLRYVSYKDFKAVAAALKPIYQAPTEEAALMELDQF
ref|YP_001664274.1|     IKEAIQAAFPKSEIQRCIIHQLRNCFKYVSYKHLKEFSKDFKAVYQSANEEIARDEFEKL
ref|YP_001319448.1|     MKEAIQASFPKSEIQRCVIHQLRYSFKYVNYKDRKEFAKDFKEVYTAVNEKAGHEKLMEL
                         :..:**  *   :*:::::*  *:::::* .   :*:.**.  *  .:*   :.  : ..:

ref|ZP_02851608.1|      EEKWGDKYEISIRSWRNNWDKLSVMFKYPEEVRKLIYTNNSMESYNRQLRKVTKSKSIFP
ref|YP_001307815.1|     EEKWGGKYLIAIKSWRNNWDELSTFFKYPPEIRKIIYTTNAMESYNRQLRKVTKSKSIFP
ref|ZP_02326599.1|      EEVWGSKYPLIRSWRNNWAELATFFKYPPEIRRLIYTTNMIESYHRQLRKVTKGKSIFP
RAAC03376               ERGWGARYPLCVKSWRDNWTELATFYRYPVEMRRIMYPTTNIIEGYHRQLRKATKGKSMFP
ref|YP_001664274.1|     KNKWQNLYPYAIKSWENNWDVLSPFYKFPEEVRKIMYTTNTIEGFHRQLRKVTKSKTIFP
ref|YP_001319448.1|     ENKWGKKYPYAIKSWDANWDVLSPFFKFPSEVRKIMYTTNMIEGLHRQFRKVTKTKSIFP
                         :. *      *      ::**  **   *:  ::::* *:*::**.*  :*.   :.   :****.**  *::**

ref|ZP_02851608.1|      TDESLLKMLYLATMDITKKWTMRTKNWAQILGQLSIYFEGRI-----
ref|YP_001307815.1|     NDESLLKILYLATIDITKKWTQGIKSWAQILAQTSIFFEGRL-----
ref|ZP_02326599.1|      SDEALLK----------------------------------------
RAAC03376               NDEALLKMLYLATMELTRKWTMRVANWGTILGQLAIYFGDRVTPYIP
ref|YP_001664274.1|     SDEALEKMLYLVTMNVLKKWTVRYKNWDIVLNQLIIMYPGRLEKYL-
ref|YP_001319448.1|     SDQALEKMLFLASQNIMKKWTLSHRNWDIVLNQLMIFFEDRLT----
                         .*::* *
```

FIG. 133

```
ref|YP_001516732.1|  ------------------------------KTRLNGICPYFTMFPLDFPYSILEE
ref|YP_318565.1|     --------------------------------------------------------
ref|YP_076090.1|     ------------------------------PHLRLNALCPYFTMFPLDFPTRYLAQ
RAAC02657            MRKRRIAMHVDPNRTDRGAAASQMELWSKRRSSDPRLRLNAISPYYTMFPLAFPLRVLAG
ref|YP_001185431.1|  --------------------------------------------------------
ref|ZP_01061333.1|   ------------------QVTPWADKSDSDPLHSLCSYLGAFPPSLAKYFIKY ref|YP_001516732.1|  HGSRGEWVLDPFCGRGTTIYASRLLGMPSIGIDSSPVATAISEAKLVNIKPGHIVSTAIK
ref|YP_318565.1|     --------------------------------------------------------
ref|YP_076090.1|     -ARPGEWVLDPFCGRGTTNYAARLHGLPTVGIDSSPVAVAIARAKLVQVTPDELIAEAER
RAAC02657            -AERG-WVLDPFCGRGTTNFAARLAGFPTVCVDINPIAVAIAQAKLASTTVEGVVERCQQ
ref|YP_001185431.1|  -------IIDPFCGRGTSMFAARKLGLKAWGIDSSPVATAIARAKLASCSKEDILDLARD
ref|ZP_01061333.1|   FTDENDLVFDPFSGRGTTLESRILNRKSIGSDLNPIALALSKAKSHKLKKKDIIDRIDE ref|YP_001516732.1|  ILKNAEEPSDIPTG----EFWELAFHKNVLNSLCKFRE-SFLRNCRSDSRKALRAIILGA
ref|YP_318565.1|     --------------------------------------------------------
ref|YP_076090.1|     ILAG-PEPADVPEG----HFWDLAYHPRTLLDICRLRE-ALLRDCEAPVRIALRGLILGI
RAAC02657            ILES-EAPGDVPDG----EFWSWCFHQKTLEDVCRLRQ-ALS-DVQTFRDIVLRALVLGV
ref|YP_001185431.1|  LLQN--AATDMFES----EFFSKLYTSQTLKDVCALREGLLSLAHETDASVMLRALVLGA
ref|ZP_01061333.1|   LESDYDYALYLPEAQSESDEIHLIFHQATIAQLCYLKD--ILLFSKSDIDEFLIGAILGI ref|YP_001516732.1|  LHGPRPKSKQS--YFSNQSQRTYAPKPNYAVNYWKRKGLLPEEVDVIEIIREKADRYFGL
ref|YP_318565.1|     --------------------------------------------------------
ref|YP_076090.1|     LHGPRTRRAPS--YLSNQMPRTYATKPDPAVRFWVRRGMRPEEVDVLDVLARRARYSFAA
RAAC02657            LHGPRNKGLPS--YLSNQMPRTYATKPDAAVRYWKSRGIHPVYVDVLDVVRRRAEHVLSH
ref|YP_001185431.1|  LHGPLNKSLDTAIYFSNQMPRTFASKPDYSVRYWDQRSLVPPAISVLDVLKRKLDR-IPT
ref|ZP_01061333.1|   MHGGERKDGTSG-YLSISMPNTFSMSPEYVRRFVQTKELNRVKRNVFDILKEKVERVFSK ref|YP_001516732.1|  EKSQGMG---KIIVGDSRNNK----YFQKTQSQVNWVITSPPYYGMSSYTPDQWLRSWFLG
ref|YP_318565.1|     ------------------------KFDWIITSPPYYGLRTYLPDQWIRNWFLG
ref|YP_076090.1|     LPPPVPG---CILQADSREPG---AIPVVDGGYRWVITSPPYLGMRSYQPDQWLRLWFLG
RAAC02657            VPDKVPG---FVRLADSRTLA---PEDFAMR-FRYVITSPPYFGMKTYVSDHWLRHWFLG
ref|YP_001185431.1|  LDEQFTGSFHQIIEGDSQLEI---TRAKVADDFSIVITSPPYYGMKTYVQDQWIRNWFLG
ref|ZP_01061333.1|   HKSPEKES--YIFFCDAKFISKSEKLKKYQGKVDLILTSPPYLGIVNYAKQNWIRSWFLD
                                               :.****** *.  .*   ::*:*  ***.

ref|YP_001516732.1|  DSSQVNYSSPEQLNHLSPDHFSSALKKVWENSSDICAQNATLVIRFGSINTRNVD-ALEI
ref|YP_318565.1|     GPSVVDYTSEGQLSHNGRDRFIADLRQVWANVGARCRPGATLVIRFGSIGERLVEDPAQL
ref|YP_076090.1|     GEPTVRYIHEGQVSHLQG-EYQRDLATVWRNVAARCRPGTRLIIRFGCLPTLPCN-PKQV
RAAC02657            GPPYVDYASDPQLGRPSLLAFIEGLREVWTRVSQVCEPGALLVVRFGAIPSYEVD-PIEV
ref|YP_001185431.1|  GASTVDYTSGPQLEHGGVTTFAESLGKVWRNMADTRADSLRMFIRFGIIPSAKID-AKKI
ref|ZP_01061333.1|   SDP------------------------------------------------------
                      . .

ref|YP_001516732.1|  IKKSLC--QTRWKIKNIKSAGFASQGRRQAIHINSKVSNPREEYDIWANL---
ref|YP_318565.1|     VSASLE--ETGWVTTEILHADNAARGRRQADTFHRKRSAPYDEVDVWA-----
ref|YP_076090.1|     LEETLARSGVPWRIVEVTGAGIPFRHRRQAVQFEKTRP-AHEEIDLVAVLGE-
RAAC02657            LRASLS--GTPWKERRLCDAGSASNGRRQADQFQFVRSRATLEVDLYASLEEA
ref|YP_001185431.1|  MQMSLEASGKEWKIISIRSAETAAEGKRQATQMKSKSS-AAIEYDFH------
ref|ZP_01061333.1|   --------------------------------------------------------
```

FIG. 134

```
ref|YP_001505049.1|    ----------------------------------------------------------
ref|YP_481774.1|       ----------------------------------------------------------
ref|YP_482514.1|       ----------------------------------------------------------
ref|NP_215436.1|       MYCBACTERIUMTUBERCULSISFREFZPHYPTHETICALRESLVASEMYCBACTERIUM
ref|YP_001680037.1|    ----------------------------------------------------------
RAAC01373              ---------------------------------------------------------- ref|YP_001505049.1|    ----------------------------------------------------------
ref|YP_481774.1|       ----------------------------------------------------------
ref|YP_482514.1|       ----------------------------------------------------------
ref|NP_215436.1|       TUBERCULSISSTRHAARLEMREFZPHYPTHETICALRESLVASEMYCBACTERIUMTUB
ref|YP_001680037.1|    ----------------------------------------------------------
RAAC01373              ---------------------------------------------------------- ref|YP_001505049.1|    ----------------------------------------------------------
ref|YP_481774.1|       ----------------------------------------------------------
ref|YP_482514.1|       ----------------------------------------------------------
ref|NP_215436.1|       ERCULSISHRAEMBCABPSSIBLERESLVASEMYCBACTERIUMTUBERCULSISHRVGB
ref|YP_001680037.1|    ----------------------------------------------------------
RAAC01373              ---------------------------------------------------------- ref|YP_001505049.1|    ----------------------------------------------------------
ref|YP_481774.1|       ----------------------------------------------------------
ref|YP_482514.1|       ----------------------------------------------------------
ref|NP_215436.1|       AAKISRESLVASEMYCBACTERIUMTUBERCULSISCDCEMBCADPSSIBLERESLVASE
ref|YP_001680037.1|    ----------------------------------------------------------
RAAC01373              ---------------------------------------------------------- ref|YP_001505049.1|    ----------------------------------------------------------
ref|YP_481774.1|       ----------------------------------------------------------
ref|YP_482514.1|       ----------------------------------------------------------
ref|NP_215436.1|       MYCBACTERIUMBVISAFEMBCALPSSIBLERESLVASEMYCBACTERIUMBVISBCGST
ref|YP_001680037.1|    ----------------------------------------------------------
RAAC01373              ---------------------------------------------------------- ref|YP_001505049.1|    ----------------------------------------------------------
ref|YP_481774.1|       ----------------------------------------------------------
ref|YP_482514.1|       ----------------------------------------------------------
ref|NP_215436.1|       RPASTEURPGBEAYHYPTHETICALPRTEINTBCGMYCBACTERIUMTUBERCULSISCG
ref|YP_001680037.1|    ----------------------------------------------------------
RAAC01373              ---------------------------------------------------------- ref|YP_001505049.1|    ----------------------------------------------------------
ref|YP_481774.1|       ----------------------------------------------------------
ref|YP_482514.1|       ----------------------------------------------------------
ref|NP_215436.1|       BEBAHYPTHETICALRESLVASEMYCBACTERIUMTUBERCULSISSTRHAARLEMGBAB
ref|YP_001680037.1|    ----------------------------------------------------------
RAAC01373              ---------------------------------------------------------- ref|YP_001505049.1|    ----------------------------------------------------------
ref|YP_481774.1|       ----------------------------------------------------------
ref|YP_482514.1|       ----------------------------------------------------------
ref|NP_215436.1|       QISRESLVASEMYCBACTERIUMTUBERCULSISHRAGBABRHYPTHETICALRESLVAS
ref|YP_001680037.1|    ----------------------------------------------------------
RAAC01373              ----------------------------------------------------------
``` continued →

FIG. 134 continued

```
ref|YP_001505049.1|    ------------------------------------------------------------
ref|YP_481774.1|       ------------------------------------------------------------
ref|YP_482514.1|       ------------------------------------------------------------
ref|NP_215436.1|       EMYCBACTERIUMTUBERCULSISFSCRESIGNIFICANCEE-IDENTITIESPSITIVE
ref|YP_001680037.1|    ------------------------------------------------------------
RAAC01373              ------------------------------------------------MDNDVHL ref|YP_001505049.1|    -----MNLKEWAESQGVAYVTAQRWFHAGKLPVPARKVG-GLILVG-EPDRPATSGTVVV
ref|YP_481774.1|       -----MNLKEWAESQGVAYVTARRWYAAGKLPVPARRVG-GLILVG-EPDQPTGDGLTAV
ref|YP_482514.1|       -YDVRVNLKEWAAANGVGYTTARRWYRDGLLPVPARKVG-GLVLVD-ESTVPAGRPVAVV
ref|NP_215436.1|       SGAPSMNLADWAESVGVNRHTAYRWFREGTLPVPAERVG-RLILVKTAASASAAAAGVVL
ref|YP_001680037.1|    -----MKLSEWAKKNGITYRTAWQWFKAGKLPVPAVQMPTGTILIQ--EGG-KHEGKVAL
RAAC01373              VYFISMKLSDWARKNGISYKTAWRWVKEGRMPVPFEQTPSGTILVH--EPEPSTTNAVAL
                           ::* :**       *:   ** :*   * :***   :       :*:         ..:

ref|YP_001505049.1|    YARVSSADQKSDLDRQVACVTGWATGQGLPVDRVVTEVGSALNGHRRKFLALLRDPAATT
ref|YP_481774.1|       YARVSSADQRPDLDRQVARVTAWATGQNLPVDKVVTEVGSALNGHRRKFLALLRDPDVAT
ref|YP_482514.1|       YARVSSADQKPDLDRQVARIVTWAASQNLAVGRVVTEVGSALNGHRRKFLGLLRDPAVAT
ref|NP_215436.1|       YARVSSHDRRSDLDRQVARLTAWATERDLGVGQVVCEVGSGLNGKRPKLRRILSDPDARV
ref|YP_001680037.1|    YARVSSADQKSDLDRQVSRLLTYANEQGWDVGEAVTEIGSGLNGRRPKLMKLLADPKVKV
RAAC01373              YARVSSADQKADLDRQIARLMEFAMAQKLVVVKAVTEIGSGLNGHRPKLMKMLSDPNAHT
                       ****** *::.*****::  : :*   :   * ..* *:**.***:* *:   :* **  . .

ref|YP_001505049.1|    IVVEHRDRFARFGAEYVEAALAANGRRLLVVDPAEVDDDLVRDITEILTSMCARLYGRRA
ref|YP_481774.1|       IVVEYRDRFARFGAEYVEAALSAQGRRLLVVDPGEVDDDLVGDVTEILTSLCARLYGRRA
ref|YP_482514.1|       IVVEHRDRFARFGAEYVEAALSAQGRRLLVVDPGEVDDDLVGDVTEILTSLCARLYGRRA
ref|NP_215436.1|       IVVEHRDRLARFGVEHLEAALSAQGRRIVVADPGETTDDLVCDMIEVLTGMCARLYGRRG
ref|YP_001680037.1|    IVVEHRDRLMRFGFEYVESALVAQGRRIVVVDQSELKDDLVQDMIEVLTSFCARLYGRRS
RAAC01373              IVVEHRDRLMRFGFEYVEAALAAQGRRILVVEPGEVKDDLVQDMVEVLTSFCARLYGRRS
                       ****:***:  *** *::*:** *:***::*.: .*   **** *:  *:**.:*******.

ref|YP_001505049.1|    AANRARRAV-------------
ref|YP_481774.1|       AVNRATRAV-------------
ref|YP_482514.1|       AANRAARAV-------------
ref|NP_215436.1|       ARNRAMRAVTEAKREPGAG---
ref|YP_001680037.1|    AANKAKKAMEAMQCED------
RAAC01373              ARHRAKRALEVLEREDSSGVSV
                       *  ::* :*:
```

FIG. 135

```
ref|NP_756021.1|        DNAADENINEMETHYLASEESCHERICHIACLICFTGBABEDNAADENINEMETHYLASE
ref|NP_709160.1|        ------------------------------------------------------------
ref|YP_405147.1|        ------------------------------------------------------------
ref|YP_001680296.1|     ------------------------------------------------------------
RAAC00337               ------------------------------------------------------------
ref|YP_342400.1|        ------------------------------------------------------------ ref|NP_756021.1|        ESCHERICHIACLIUTIGBABGDNAADENINEMETHYLASEESCHERICHIACLIGBABD
ref|NP_709160.1|        ------------------------------------------------------------
ref|YP_405147.1|        ------------------------------------------------------------
ref|YP_001680296.1|     ------------------------------------------------------------
RAAC00337               ------------------------------------------------------------
ref|YP_342400.1|        ------------------------------------------------------------ ref|NP_756021.1|        NAADENINEMETHYLASEESCHERICHIACLIAPECSCRESTGNIFICANCEE-IDENT
ref|NP_709160.1|        ------------------------------------------------------------
ref|YP_405147.1|        ------------------------------------------------------------
ref|YP_001680296.1|     ------------------------------------------------------------
RAAC00337               ------------------------------------------------------------
ref|YP_342400.1|        ------------------------------------------------------------ ref|NP_756021.1|        TIESPSITIVESGAPSRAFLKWAGGKYPLLDDIKRHLPKGECLVEPFVGAGSVFLNTDFS
ref|NP_709160.1|        ---------------RAFLKWAGGKYPLLDDIKRHLPKGECLVEPFVGAGSVFLNTDFS
ref|YP_405147.1|        ---------------RAFLKWAGGKYPLLDDIKRHLPKGECLVEPFVGAGSVFLNTDFS
ref|YP_001680296.1|     ---------------RPFLKWAGNKYRIIHRTRAVLPAGNRLIEPFVGSAAVFLNTSFK
RAAC00337               --MSRLVRPRGFAAGMKPFLKWAGGKYRLLPYIQRALPPGRRLIEPFVGSGAVFLNTSYD
ref|YP_342400.1         ---------------RPFLKWAGNKYRLLTRIISVLPPGKRLIEPFAGSAALFLNAEYE
                                       : ****** **  ::   *     **  *,  *:***,*:,::***:..

ref|NP_756021.1|        RYILADINSDLISLYNIVKMRTDEYVQAARELFVPETNCAEVYYQFREEFNKSQDPFRRA
ref|NP_709160.1|        RYILADINSDLISLYNIVKMRTDEYVQAARELFVPETNCAEVYYQFREEFNKSQDPFRRA
ref|YP_405147.1|        RYILADINSDLISLYNIVKMRTDEYVQAARELFVPETNCAEVYYQFREEFNKSQDPFRRA
ref|YP_001680296.1|     ENLLADCNGDLIRLYQTVKTGGEDFIAYCRSFFTEFNNRPERYYALREIFNTTDDGDLKS
RAAC00337               AYVLSDINADVIALYRVLSLHGEAFIEACRRLFVPENNCPEVYYALRDEFNASRDLVRRA
ref|YP_342400.1|        RYWVNDINPDLIALYQILQKEGKEFIHYAGCLFTPHNNTPKAYYRLRARFNTTADVAEKA
                         : * *:*  **, :,    .  ::  . :*.   *  .: ** :*   **  :  *     ::

ref|NP_756021.1|        VLFLYLNRYGYNCLCRYNLRGEFNVPFGRYKKPYFPEAELYHFAEKAQNAFFYCESYADS
ref|NP_709160.1|        VLFLYLNRYGYNGLCRYNLRGEFNVPFGRYKKPYFPEAELYHFAEKAQNAFFYCESYADS
ref|YP_405147.1|        VLFLYLNRYGYNGLCRYNLRGEFNVPFGRYKKPYFPEAELYHFAEKAQNAFFYCESYADS
ref|YP_001680296.1|     ALFIYLNRHSYNGLCRYNASGKFNAPACRYKKPYFPRRELRFFMAKARDAVFLCQDFTQT
RAAC00337               ALFVYLNRHGYNGLCRYNAEGRFNVPFGRYKRPYFPEREMRYFCEKARRAEFLCVDFREV
ref|YP_342400.1|        ALFVYLNRHGYNGLCRYSGSGIFNVPFGRYQRPYFPSKEMMAFHIKARRRAFTCLDFRKV
                        .**:****: ****** .  *   *.*:** * ***::****  *:    *  ***  *   *     * :  .

ref|NP_756021.1|        MARADDASVVYCDPPYAPLSATANFTAYHTNSFTLEQQAHLAEIAEGLVDRHIPVLISNH
ref|NP_709160.1|        MERADDASVVYCDPPYAPLSATANFTAYHTNSFTLEQQAHLAEIAEGLVERHIPVLISNH
ref|YP_405147.1|        MARADDASVVYCDPPYAPLSATANFTAYHTNSFTLEQQAHLAEIAEGLVERHIPVLISNH
ref|YP_001680296.1|     MGEARPGDVVYCDPPYVPLSRTSNFTGYSAGGFGEAEQWKLAELARQLADRGVSVLISNH
RAAC00337               MRMAEPGDVVYCDPFYVPLSKTANFRQYAAQGFGEAEQRDLARIAEELADRGIPVLISNH
ref|YP_342400.1|        LARIRRGTIVYADPPYTPLSQTACFTHYSGNGFGPEEQKALTQSAQRLAKRGTPVLISNH
                        :    .  :..*  *: *  *    .*   :*   *:. *. * *..* : :****** ref|NP_756021.1|        DTMLTREWYQRAKLHVVKVRRSISSNGGTRKKVDELLALYKP---
ref|NP_709160.1|        DTMLTREWYQRAKLHVVKVRRSISSNGGTRKKVDELLALYKP---
ref|YP_405147.1|        DTMLTREWYQRAKLHVVKVRRSISSNGGTRKKVDELLALYKP---
ref|YP_001680296.1|     DTDFTQKAYDAARIERFPVQRFVSCDGANRGKAGELLALF-----
RAAC00337               LTPFTERAYRRAECRQLQVRRATSCQGARRGYAPEVLALFAPRSR
ref|YP_342400.1|        DTFSVRQAYRNAQLTGFSVTRLISCKGTQRTPANEVLALF-----
                         *  . .  *  *  .      *  : *,.*    *    . : ***:
```

FIG. 136

```
emb|CAD18993.1|      MTNRTAVLSDIHGVLPALEAVLAEPEVRA-ADRVVLTGDIACGPQ-PAEVLDLLTALGD-
ref|ZP_00995572.1|   ---RVAVLSDVHGVLPVLEAVLAEPDVAS-ADLIVVTGDHTAGPM-PVETLDALTALDG-
RAAC00506            MPARVAALYDIHGNLAALDAVLQEVERAG-ADALVFGGDLAFGPQ-PRQVLERVMSLGG-
ref|YP_001115956.1|  ---KIAALSDIHGNLAALDAVLDDVRRRG-ADVIVNLGDIVSGALHPAETADRLIALD--
ref|ZP_02134324.1|   ---RIALISDIHGNDIALETVLKDMKSAGGIDQIICLGDVANLGPDPCSVVARLRDVN--
ref|YP_805441.1|     ---KIAALYDIHGNYPALKEVLKQVKKLS-PDLVVLGGDLIAGPM-PLETLSLLKHVSTT
                        : * : *:**   .*. **  :   . * :: **      *  ..   :  :.

emb|CAD18993.1|      -RVTWVAGNADRELVE----FRRGVRETIPDPIGPWAARQLRPDIILELLASLPLSVRLPVA
ref|ZP_00995572.1|   -RVVLVRGNADREAVA---IRSG--DDSPHPFALWAAHALREDQIAVLSALPHPVTIDIA
RAAC00506            -PVSFVRGNTDREVAERHGVEQGVRGWIAEVN-AWCHDQLTPDQREFLLSQKAHVTLHVE
ref|YP_001115956.1|  ---LPTIRGNEERQLLER-------TRDAMGLSDRWAHDTLHERHRAWLAALPERATLG--
ref|ZP_02134324.1|   --CPCVLGNHDAFLFDRDLIHQYTEVDYIIEAVDWCRDQLTQDDIDWMGDFHRVLEVLMD
ref|YP_805441.1|     FKTVGTMGNNDQDTVDIYAKKRVGLSRKATEQLTWIANQLSYKQVSFLRNLLPSISIG--
                         : **  :                             *    *     .    :

emb|CAD18993.1|      GLGTVLFCHATPRDDE----EVVVVDSRPDRWREVFDGLG--PDVDAVICGHTHMP-FVR
ref|ZP_00995572.1|   GFCEVLFCHGSPRDDD----EVVLVDSPPTAWQNALSIVP--DTVQTIVCGHTHMP-FVR
RAAC00506            GLGDVLFVHGSPRSDE    EAIRRDTPEAEILPMVAHVG--ESI---IVCGHTHIQ-FDR
ref|YP_001115956.1|  --DDVILVHGTPASDLDYFLETVTRDGCRAATPDEIAQRAEDEPASLILCGHTHVPRVAR
ref|ZP_02134324.1|   KAGSLIAFHGSPLSHM----DNILSRTPDAEVDRLTQGLN----GEILACGHTHIQ-MLR
ref|YP_805441.1|     ---NYFFCHAVKNDNT----TVFSPQQNKAYIETLFKGVQ----ESYIICGHTHIQ-FEL
                        : *.  ..      .              .        :  ******:  .

emb|CAD18993.1|      LAHGRLVVNPGSVGMPYG-RSGAEWALLGPG-VDLRRTPYDTDAAIARLTRDCGYPAIAE
ref|ZP_00995572.1|   LVDRRTVINPGSIGMPYG-RAGGAWALLDRGQVSLRHTEIDLDAVCARIVAESGYPDRAA
RAAC00506            MVAGKRVVNAGSVGLPSA-ARGACWALIGPE-IELRETLYDFERAAAEIR-KSGAPKAGE
ref|YP_001115956.1|  LADGRTIVNPGSVGLPA--------------------------------------
ref|ZP_02134324.1|   QHRGRLIINPGSVGLP-----------------------------------------
ref|YP_805441.1|     SLPNKKIINAGSIGMPFFSNQFGAQWLWLDDNRIEYKRTIFN QQAIQLISQTEYPFKNE
                       : ::*.**:*:* emb|CAD18993.1|      WAD----------
ref|ZP_00995572.1|   WADE---------
RAAC00506            FADDILNPPVAGP
ref|YP_001115956.1|  -------------
ref|ZP_02134324.1|   -------------
ref|YP_805441.1|     FIANNLRSTIS--
```

FIG. 137

```
ref|YP_001488901.1|    ------------------------RLPPQNIEAEQAVLGAVFLEPSALTLASEVLIPEDFYRM
ref|YP_001423303.1|    ------------------------RLPPQNIEAEQAVLGAVFLQPSALTLASEVLIPDDFYRM
ref|NP_391924.1|       ------------------------RLPPQNIEAEQAVLGAIFLQPSALTLASEVLIPDDFYRM
ref|NP_244897.1|       ------------------------RTPPQNIEAEQAVLGAIFLEDHALVTASERLAPEDFYRA
ref|ZP_01695451.1|     ------------------------RIPPQNIEAEQAVLCAIFLEPSAFITASEILTAEDFYRN
RAAC00022              MRNAMAAEETLWRDREAEAALRMPPHNIEAEQAVLGAMLISPDAVVEAMEILEADDFYRS
                                               * **:*:*********::.. *. *  *  .:**** ref|YP_001488901.1|    SHQKIYNAMLVLGDRGEPVDLVTVTSELANT-DLLEEVGGISYLTDIANSVPTAANIEYY
ref|YP_001423303.1|    SHQKIYNAMLVLGDRGEPVDLVTVTSELANT-DLLEEVGGVSYLTDIANSVPTAANIEYY
ref|NP_391924.1|       SHQKIYNAMLVLGDRGEPVDLVTVTSELANT-DLLEEVGGISYLTDIANSVPTAANIEYY
ref|NP_244897.1|       AHQRIYQVMLDLAEKGEPVDLVTVTAELQDR-KALDDVGGVAYLGDLANAVPTAANVEYY
ref|ZP_01695451.1|     AHQKIFQVFAKLNDAGKAVDLVTVAEELSAT-RQLEDAGGLSYLSELAASVPTAANIAYY
RAAC00022              AHQAIYRAIREVYEAGDPVDIITVASRLRTYGDVLDAVGGPEYLADIAAMMPTALHVVHY
                       :** *:..:   : *..:::.*     *:.  ::*  :***  ::  :* ref|YP_001488901.1|    AKIVEEKSILRRLIRTATTIAQDGYTREDEVEDLLSDAEKTIMEVAQRKNSGAFQNIKDV
ref|YP_001423303.1|    AKIVEEKSILRRLIRTATSIAQDGYTREDEVEDLLSDAEKTIMEVAQRKNSGAFQNIKDV
ref|NP_391924.1|       AKIVEEKSILRRLIRTATTIAQDGYTREDEVEDLLSEAEKTIMEVAQRKNTSAFQNIKDV
ref|NP_244897.1|       SKIVEEKSLLRRLIRVATNIAQEGYASEEEVDAILDDAEKTILDVAQRKNSSAFISIKDV
ref|ZP_01695451.1|     AGIVAEKALLRRLIRTATHTAQEGYTREDDVDELLDEAERSIMEVAQRKNAGDFKHIKDV
RAAC00022              AEIVREKALLRRIISAGTRIAEAAYEPDASAMEVLADAERLVLELSQHQRTRDFTHISDV
                       : ** **::***:*  .* **:  .*  :  .:  :* :**:   ::::*::.:   *  *.**

ref|YP_001488901.1|    LVQTYDNIEQLHNRKGDITGIPTGFSELDRMTAGFQRNDLIIVAARPSVGKTAFALNIAQ
ref|YP_001423303.1|    LVQTYDNIEQLHNRKGDITGIPTGFIELDRMTAGFQRNDLIVAARPSVGKTAFALNIAQ
ref|NP_391924.1|       LVQTYDNIEQLYNRKGDITGIPTGFTELDRMTAGFQRNDLIIVAARPSVGKTAFALNIAQ
ref|NP_244897.1|       LVETYDKIEMLQNQKGEITGIPTGFKDLDRMTAGFQRNDLIIVAARPSVGKTAFALNISQ
ref|ZP_01695451.1|     LVSTYDNIEMLHNRKGDVTGIPTGFYELDRMTAGFQRNDLIIVAARPSVGKTAFALNIAQ
RAAC00022              LQTTFERIEQLYESDCNITGVPTGYSDLDRMTSGFQKSDLIIVAARPSVGKTAFALNIAQ
                       *  *:: **  * : .*:::*: :**** :*:****************:* ref|YP_001488901.1|    NVATKTDESVAIFSLEMGSEQLVMRMLCAEGNINAQNLRTGNLTEEDWGKLTMAMGSLSN
ref|YP_001423303.1|    NVATKTDESVAIFSLEMGAEQLVMRMLCAEGNINAQNLRTGNLTEEDWGKLTMAMGSLSN
ref|NP_391924.1|       NVATKTDESVAIFSLEMGAEQLVMRMLCAEGNINAQNLRTGNLTEEDWGKLTMAMGSLSN
ref|NP_244897.1|       NVATKTDENVAIFSLEMGASQLVQRMLCAEGNIDAQRMRTGALTEEDWQKLTMAMGSLAR
ref|ZP_01695451.1|     NVGTKTEENVAIFSLEMGAEQLVMRMLCAEGNIDAQRLRTGALTDEDWRKLTMAMGSLSN
RAAC00022              NVAVRAGLPVAIFSLEMSKDQLVQRMLCAEAFIDGHKLRNGTLDDEDWPKLSMGVTTLSN
                       **..::  *******. *** ******. *:..:*.* * :*** **:*.: :*:.

ref|YP_001488901.1|    SGIFIDDTPGIRVSEIRSKCRRLKQENGLGMILIDYLQLIQGSGRSSDNRQQEVSEISRA
ref|YP_001423303.1|    SGIFIDDTPGIRVSEIRSKCRRLKQENGLGMILIDYLQLIQGSGRSSDNRQQEVSEISRA
ref|NP_391924.1|       SGIYIDDTPGIRVSEIRAKCRRLKQESGLGMILIDYLQLIQGSGRSKDNRQQEVSEISRE
ref|NP_244897.1|       AGIYIDDTPGIKVNEIRAKCRRLKQEKGLGMILIDYLQLIQGSNGRSCENRQQEVSEISRS
ref|ZP_01695451.1|     SGIYIDDTPGVRVTEIRSKCRRLKQEHGLGMVVIDYLQTTQGSARSRENRQQEVSEISRS
RAAC00022              SPIYIDDTPGTTVPFMRSKLRRLKLEHGLGFVVIDYLQLIHGRRMAGENRQQEISDISRS
                       : *:******  * *:*:* **** * *::*****:*   : :******:*:*** ref|YP_001488901.1|    LKSLARELEVPVIALSQLSRGVEQRQDKRPMMSDIRESGSIEQDADIVAFLYRDDYYDKE
ref|YP_001423303.1|    LKALARELEVPVIALSQLSRGVEQRQDKRPMMSDIRESGSIEQDADIVAFLYRDDYYDKE
ref|NP_391924.1|       LKSIARELQVPVIALSQLSRGVEQRQDKRPMMSDIREFGSTRQDADIVAFLYRDDYYDKE
ref|NP_244897.1|       LKGLARELEVPVIALSQLSRGVESRQDKRPMMSDIRESGSIEQDADIVAFLYRDDYYDKE
ref|ZP_01695451.1|     LKALARELEVPVIALSQLSRGVEQRQDKRPMMSDIRESGSIEQDADIVAFLYREDYYEQD
RAAC00022              LKQLARELEVPILALAQLSRSVEQRQDKRPMLSDIRESGSIEQDADVVAFLYRDDYYNPD
                       ** :****:**:**.****.**.*******:*****:*****:*****:****:  :

ref|YP_001488901.1|    SENKNIIEIIIAKQRNGPVGTVSLAFVKEYNKFVNLER-----
ref|YP_001423303.1|    SENKNIIEIIIAKQRNGPVGTVSLAFVKEYNKFVNLER-----
ref|NP_391924.1|       TENKNIIEIIIAKQRNGPVGTVSLAFVKEYNKFVNLER-----
ref|NP_244897.1|       TENQNIIEIIIAKQRNGPVGTVELAFIKEYNKFVNLDRHHDE-
ref|ZP_01695451.1|     TENKNIIEIIIAKQRNGPVGTVQLAFIKEYNKFVNLER-----
RAAC00022              TENPNVVEVIIAKQRNGPTGKIELVFLKNFNKFVNLERAHAEP
                       :** *::*:*********.*:: *.*:*::*****:*
```

FIG. 138

```
ref|YP_001213441.1|      -------MLNKVTLIGRLTQDPELRYTPGGVAVARFTLAVNRARLNKQGERETDFIDVVV
RAAC00027                MNAEGTSMLNRVILIGRLTADPELRYTNNGTAVASFTLAVDRMRSGPNGERQTDFINVVV
ref|YP_077145.1|         -------MLNSVVLIGRLTKDPELRYTPSGKAVATLRLAVDRGTVNQQGERETDFIDIVV
ref|NP_244917.1|         -------MLNRVVLVGRLTRDPELRYTPNGVAVANFTLAVNRPFSNQQGEREADFINCVV
ref|YP_149334.1|         -------MINRVILVGRLTRDPELRYTPSGVAVATFTLAVNRPFTNQQGERETDFIQCVV
ref|YP_001377189.1|      -------MMNRVILVGRLTKDPDLRYTPNGVAVATFTLAVNRAFTNQQGEREADFINCVI
                                *:* *:*:**** **:****  .* **:* :  ***:*     . :***::***: *:

ref|YP_001213441.1|      WQKQAETCANYIRKGRLVAVEGRLQVRSYDDSQGIRRKAAEVVAETVRFLDR--------
RAAC00027                WQKQAEIVAQYLQKGRLAAVDGRLQIRSYDNRDGQRVRVAEVVAETVRFLDRGPDQAQGS
ref|YP_077145.1|         WEKQAETVANYLQKGRLVAVQGRLQIRQYTTQDGQKREKAEVVATTVRFLDSARD-----
ref|NP_244917.1|         WRKQAENVANYLKKGSLAGVDGRIQTRSYDNNEGR-------------------------
ref|YP_149334.1|         WRRQAENVANFLKKGSLAGVDGRLQTRSYENQEGRRVYVTEVVADSVQFLEPKGT-SEQR
ref|YP_001377189.1|      WRKQAENVANYLKKGSLAGVDGRLQTRNYEGQDGRRVYVTEVLAESVQFLEPRNSGGEQR
                         *.:***  *:::** *,.*:**:* *,*       :* ref|YP_001213441.1|      ------------------------------------------------------------
RAAC00027                GYSAAG--------   AQTRQQRPTPSSAPPFEDDPFADDSQLTDISEDDLPF
ref|YP_077145.1|         ------------------------------------------------------------
ref|NP_244917.1|         ------------------------------------------------------------
ref|YP_149334.1|         GATAGGYYGDPFPFGQDQNHQYPNEKGFGRIDDDPFANDGQPIDISDDDLPF
ref|YP_001377189.1|      GSFNQQPSGAGFGNQGSNPFGQSGNSGFTK-NDDPFSNVGQPIDISDDDLPF
```

FIG. 139

```
ref|YP_001255315.1|  ----------------------------------------GAPSIKKRDGQYEPLQVEKTKK
gb|ACA43749.1|       ----------------------------------------    IKKRDGQYEPLQVEKTKK
ref|YP_001392092.1|  ----------------------------------------    IKKRDGQYEPLQVEKTKK
ref|ZP_02619122.1|   ----------------------------------------    IKKRDGQYESLQVEKTKK
ref|YP_074151.1|     -------------------------------PERASEFIAELR--------------
RAAC01051            MQMVHPSDTSTGLMERTGQGELRSGRASHALEEWRDRVKTFTVEKRDGRIEPLSLDKIFA
                                                                   : * ref|YP_001255315.1|  MVKLACEGIEGCDPLELELDSRIQFRDGMTTKEIQRTLIQTAIEKVIQNSKDNNGNNIKK
gb|ACA43749.1|       MVKLACEGIEGCDPLELELDSRIQFRDGMTTKEIQRTLIQTAIEKVIQNSKDNNGNNIKK
ref|YP_001392092.1|  MVKLACEGIEGCDPLELELDSRIQFRDGMTTKEIQRTLIQTAIEKVIQNSKDNNGNNIKK
ref|ZP_02619122.1|   MVKLACEGIEGCDPLELELDSRIQFRDGMTTKEIQRTLIQTAIEKVIQNSKDNNGNNIKK
ref|YP_074151.1|     ---------------------PLLHATTDRSQQMDLAARLAAEKTSVEEPD--------
RAAC01051            FLKRGCEAAEGCDPERLAADVWPQLRDGMRTSEIARVAIQAAVEKTSVAEPG--------
                                          :  :           :  *  **.     .  .

ref|YP_001255315.1|  TNANWQYVAARLLCFDLYKEAKISRHYNSFGYGDYYQLVKKLVKIK------LYGEYLIQ
gb|ACA43749.1|       TNANWQYVAARLLCFDLYKEAKISRHYNSFGYGDYYELVKKLVKIK------LYGEYLIQ
ref|YP_001392092.1|  TNANWQYVAARLLCFDLYKEAKISRHYNSFGYGDYYELVKKLVKIK------LYGEYLIQ
ref|ZP_02619122.1|   TNANWQYVAARLLCFDLYKEAKISRHYNSFGYGDYYELVKKLVKMK------LYGEYLIQ
ref|YP_074151.1|     ----WQYVAARLYLQKLYGEAARNRGYHQPGYGDFYELVRQLHAMGDEAGNRVYGAYMIE
RAAC01051            ----WQFVAARLLLFDAYKQASRNRGYRHLGYGDFYQLIVELERIG------RYGTYIRQ
                         **:*****   . * :*  .*  *,  ****:*:*: :*  :       ** *: :

ref|YP_001255315.1|  NYSDEEIKELAKYIVPERDELFNYEGLKLLNDRYLIKGNNGEILELPQERFMTIAMHLAI
gb|ACA43749.1|       NYSDEEIKELAKYIVPERDELFNYEGLKLLNDRYLIKGHNGEILELPQERFMTIAMHLAI
ref|YP_001392092.1|  NYSDEEIKELAKYIVPERDELFNYEGLKLLNDRYLIKGHNGEILELPQERFMTIAMHLAI
ref|ZP_02619122.1|   NYSDEEIKELAKYIVPERDELFNYEGLKLLNDRYLIKGHNGEILELPQERFMTIAMHLAI
ref|YP_074151.1|     AYSEEEIRELGRYIRPERDELFTYVGLLHLADRYLIKGFHGEILELPQERYMHIAMHLAS
RAAC01051            HYSEDEIAELAAYIKPERDYLFNYVGLKQLLDRYAIRNLDNGIMELPQELFMGVSMHLAM
                      :: .  ** .* **   * *** *:. .. *:***** :* ::**** ref|YP_001255315.1|  PEGDKKVFYAKKFYDLLSELKVTVATPTLGNAGTPFYQLSSCFISVVGDNLWSIYDVNQK
gb|ACA43749.1|       PEGDKKVFYAKKFYDILSELKVTVATPTLGNAGTPFYQLSSCFISVVGDNLWSIYDVNQK
ref|YP_001392092.1|  PEGDKKVFYAKKFYDLLSELKVTVATPTLGNAGTPFYQLSSCFISVVGDNLWSIYDVNQK
ref|ZP_02619122.1|   PEGDKKVFYAKKFYDLLSELKVTVATPTLGNAGTPFYQLSSCFISVVGDNLWSIYDVNQK
ref|YP_074151.1|     VESDR-VTWAKRFYDVLSRQEMTVATPTFRNAATPLPQLSSCFIDTVDDSLQSIYDTNQS
RAAC01051            KEBDK-VAWAKRFYDMLSTLQATVATPTLSNARKPFHQLSSCFIDMPEDDLVSIYATDEA
                      * *:  *  :*:*** **    ***** ** .*: ******.   *.*  ***  .::

ref|YP_001255315.1|  FAQVSKHGGALGIYTGKIRALNSEIRGHKNASGGVVPWIRLYNDTAVAVDQLGKRKGGAA
gb|ACA43749.1|       FAQVSKHGGALGIYTGKIRALNSEIRGHKNASGGVVPWIRLYNDTAVAVDQLGKRKGGAA
ref|YP_001392092.1|  FAQVSKHGGALGIYTGKIRALNSEIRGHKNASGGVVPWIRLYNDTAVAVDQLGKRKGGAA
ref|ZP_02619122.1|   FAQVSKHGGALGIYTGKIRALNSEIRGHKNASGGVVPWIRLYNDTAVAVDQLGKRKGGAA
ref|YP_074151.1|     FAQVSKHGGGMGIYIGKLRARGSAIRGRKGAAAGVIPWVRNYNDTAVAVDQLGARKGAVS
RAAC01051            FARVSKFGGGMGIYVGKIRARGSAIRNHPGASGGVVPWIRNFNNTAVSCNQLGMRAGAAA
                     **:***.**.:*** **:**  ** .*  .*:.**:**:*  :*:***  * *..:

ref|YP_001255315.1|  ITLDIWHKDIFDFLDLKTNNGDDRRKAHDIFPSVSIPDLFMKRLEKRESWSLFDPYIVEK
gb|ACA43749.1|       ITLDIWHKDIFDFLDLKTNNGDDRRKAHDIFPSVSIPDLFMKRLEKRESWSLFDPYIVEK
ref|YP_001392092.1|  ITLDIWHKDIFDFLDLKTNNGDDRRKAHDIFPSVSIPDLFMKRLEKRESWSLFDPYIVEK
ref|ZP_02619122.1|   ITLDIWHKDIFDFLDLKTNNGDDRRKAHDIFPSVSIPDLFMKRLEKRESWSLFDPYIVEK
ref|YP_074151.1|     IWLDVWHKEIFEFLALKLNNGDDRMRAHDIFPGVCVPDAFMRAVEQDADWHLFCPHEVRT
RAAC01051            VYLDVWHKDILDFLQLRTNNGDERMKAHDIFPGVCIPDLFMRRVEERGMWYLFCPYEVRK
                     : **:***:*::** *: **** :* :******.*: **.**:: :*:  * ** *: *..

ref|YP_001255315.1|  IMGYKLEDYFDDEDRKEFTNKYLECERNTNIPRDTVPTLDIMKKLMKSAVETGTPFIFFR
gb|ACA43749.1|       IMGYKLEDYFDDEDRREFTNKYLECERNTNIPRDTVPTLDIMKKLMKSAVETGTPFIFFR
ref|YP_001392092.1|  IMGYKLEDYFDDEDRREFTNKYLECERNTNIPRDTVPTLDIMKKLMKSAVETGTPFIFFR
ref|ZP_02619122.1|   IMGYKLEDYFDDEDCREFTNKYLECERNTNIPRDTVPTLDIMKKLMKSAVETGTPFIFFR
ref|YP_074151.1|     EMGFSLEDAWGEEWERRYR-LCVEAAHADKLDATVVRARQVAKAMLKSQYETGGPFLFFR
RAAC01051            VMGFSLEDSWGEEFERRYE-ACVENP---NLPRVEIPAIEIMKRIMQSAFETGTPFIFFR
                     **:.*** :.  .*  :*    **. . . :* :    : : :: * ::: *** **:***
                                                                      continued →
```

FIG. 139 continued

```
ref|YP_001255315.1|    DTVNKANPNKHKGMIYSSNLCHEIAQNMSESRLLEEEIIDGNGYSEIVQRVKAGDMVTCN
gb|ACA43749.1|         DTVNKANPNKHKGMIYSSNLCHEIAQNMSESRLLEEEIIDGNGYSEIVQRVKAGDMVTCN
ref|YP_001392092.1|    DTVNKANPNKHKGMIYSSNLCHEIAQNMSESRLLEEEIIDGNGYPEVVQRVKAGDMVTCN
ref|ZP_02619122.1|     DTVNKANPNKHKGMIYSSNLCHEIAQNMSESQLLEEEIIDENGYPEVVQRVKAGDMVTCN
ref|YP_074151.1|       DTVNRLNPNKHAGMVYCSNLCTEIAQNQSPTRLIEKTDDGE----VITYRWQPGDFVVCN
RAAC01051              DTANRLNPNKHAGMVYCSNLCTEIIQNMSPSRRIEETEEGG----IITMKTEAGDFVVCN
                       **.*: ***** **:*.**** ** ** * :: :*:        :. : :.**:*.**

ref|YP_001255315.1|    LNSINLSKVKKEE-FNECIPFQIRMLDNVISLNKLPVKEAKVTSDKYRAIGLGTSGYHHF
gb|ACA43749.1|         LNSINLSKVKKEE-FNECIPFQIRMLDNVISLNKLPVKEAKVTSDKYRAIGLGTSGYHHF
ref|YP_001392092.1|    LNSINLSKVKKEE-FNECIPFQIRMLDNVISLNKLPVKEAKVTSDKYRAIGLGTSGYHHF
ref|ZP_02619122.1|     LNSINLSKVKKEE-FSECIPLQIRMLDNVISLNKLPVKEAKVTSDKYRAIGLGTSGYHHF
ref|YP_074151.1|       LASINLSKVHTEEKIAEVVPLAIRMLDNVIDLNFYPVPQAKITNKKYRAIGLGVHGYHQM
RAAC01051              LSSLNLGRCRDLDSIREIVRRQIRAMDNVIDLNHYPVPQAAVTNRKYRAVGLGVSGYHQY
                       * *:**.:  :   :    * :  ** :****.**  ** :*  :*. ****:***. ***:

ref|YP_001255315.1|    LANNKIRWESDEHIKVADEIYEEIAYIAIKSSMELAKEKGSYPAFKDSEWETGKYFERRG
gb|ACA43749.1|         LANNKIRWESDEHIKVADEIYEEIAYIAIKSSMELAKEKGSYPAFKDSEWETGKYFERRG
ref|YP_001392092.1|    LANNKIRWESDEHIKVADEIYEEIAYIAIKSSMELAKEKGSYPAFKDSEWETGKYFERRG
ref|ZP_02619122.1|     LANNKISWESDEHIKVADEIYEEIAYIAIESSMELAKEKGSYPAFKGSEWETGKYFERRG
ref|YP_074151.1|       LAELGIHWESEDHLRKADEVFELLNYYAVKTSIELAAEKGCYPLCKGSDWETGEYFALRG
RAAC01051              LAEKGIPWESEAHVKHADELFEWINFFAIEASMELAREKGPYPLFEGSDWQTGRYFDLRG
                       **: * ***: *::  ***:*   : : *::*:*** *** **  :.*:*:**.** **

ref|YP_001255315.1|    YNS----ERWKKLQSNIKKYGMRNGYITAIAPTGSTSNIANTTAGIDPVFKKFFMEEKKG
gb|ACA43749.1|         YNS----ERWKKLQSNIKKYGMRNGYITAIAPTGSTSNIANTTAGIDPVFKKFFMEEKKG
ref|YP_001392092.1|    YNS----ERWKKLQSNIKKYGMRNGYITAIAPTGSTSNIANTTAGIDPVFKKFFMEEKKG
ref|ZP_02619122.1|     YNS----ERWKKLQSNIKKYGMRNGYITAIAPTGSTSNIANTTAGIDPVFKKFFMEEKKG
ref|YP_074151.1|       YES----DRWQALRRQAAEVGLRNAYLLAIAPTSSTSLLCGTTASVDPIYDRVYNEGKKD
RAAC01051              YRTRPGGPDWDGLRREVAEHGVRNAYLVAIAPTSSTSLIAGSTAGIDPVYARFFLEEKKN
                       *.:       *. *:  :   : *:**.*: *****.***  :..:**.:**::  :.: * **.

ref|YP_001255315.1|    SFTPKTAPDLNEENFWYYKEAHTIDQQWSIKACAVRQKHIDQAQSFNLYITPEIKAKEIL
gb|ACA43749.1|         SFTPKTAPDLNEENFWYYKEAHTIDQQWSIKACAVRQKHIDQAQSFNLYITPEIKAKEIL
ref|YP_001392092.1|    SFTPKTAPDLNEENFWYYKEAHTIDQQWSIKACAVRQKHIDQAQSFNLYITPEIKAKEIL
ref|ZP_02619122.1|     SFTPKTAPDLNEENFWYYKEAHTIDQQWSIKACAVRQKHIDQAQSFNLYITPEIKAKEIL
ref|YP_074151.1|       QVIPLAAPGLSPKTYLYYKPAHQIDQTWSIRAAGVRQRHIDQSQSFNLYIRPDIKGRDFL
RAAC01051              GVVPQTAPNLNDKTFWYYKEAHTIDQRWSIEACAARQRHVDQSQSFNLYITPGISARQFL
                       . * :**.*.  :.: *  * *.*...**:*::***** *  *..:::* ref|YP_001255315.1|    NMYIESWKQGVKTIYYVRNKSLEMD--ECTSCSS
gb|ACA43749.1|         NMYMESWKQGVKTIYYVRNKSLEMD--ECTSCSS
ref|YP_001392092.1|    NMYMESWKQGVKTIYYVRNKSLEMD--ECTSCSS
ref|ZP_02619122.1|     NMYMESWRQGVKTIYYVRNRSLEMD--ECTSCSS
ref|YP_074151.1|       NLYMQAWKNGLKTVYYVRSRSLEVTEAECEACQA
RAAC01051              DLYLLAWKRGLKTVYYVRSKSVEV--EDCVACSS
                       :;:*: :*:.:*:**:****.:*:*;       :* :*..:
```

FIG. 140

```
ref|YP_878438.1|         ------------------------------------------------------------
ref|ZP_02621211.1|       ------------------------------------------------------------
ref|YP_001392091.1|      ------------------------------------------------------------
ref|YP_001255314.1|      MBTULINUMASTRATCCGBABSRIBNUCLESIDE-DIPHSPHATEREDUCTASEBETASU
ref|YP_001560315.1|      ------------------------------------------------------------
RAAC01050                ------------------------------------------------------------ ref|YP_878438.1|         ------------------------------------------------------------
ref|ZP_02621211.1|       ------------------------------------------------------------
ref|YP_001392091.1|      ------------------------------------------------------------
ref|YP_001255314.1|      BUNITCLSTRIDIUMBTULINUMASTRHALLSCRESIGNIFICANCEE-IDENTITIESP
ref|YP_001560315.1|      ------------------------------------------------------------
RAAC01050                ------------------------------------------------------------ ref|YP_878438.1|         -----------IFNENGNR--GTESMINGNTTNLREWNRIKYNWANELYRTMLNNFWIPE
ref|ZP_02621211.1|       -----------IFNENGNR--GTESIINGSTTNLREWNRIKYNWANELYRNMLNNFWIPE
ref|YP_001392091.1|      -----------IFNEKGQR--GTESMINGNTTNLREWNRIKYSWASDFYRTMLNNFWIPE
ref|YP_001255314.1|      SITIVESGAPSIFNEKGQR--GTESMINGNTTNLREWNRIKYSWASDFYRTMLNNFWIPE
ref|YP_001560315.1|      ------MEKKKIFNEYGDR--GTDCLIKGNTTNLREWNRIKYDWARLIYRTMLNNFWIPE
RAAC01050                ----MQLKRTRLFNAEGDRDWGKRRIIGGNTTNMIELNNIKYEWAYKLYRAMMNNFWIPE
                                    :**   *:*   *.   :* *.***: * *.***.**   :** *:******* ref|YP_878438.1|         EISLNEDVKQFPYLTDGERNAFDKIISFLNFLDSVQSENLPNISRYITAPEVSSLLNVQT
ref|ZP_02621211.1|       EISLNEDVKQFSYLTDGERNAFDKIISFLNFLDSIQSENLPNISRYITAPEVSSILNIQA
ref|YP_001392091.1|      EISLNEDIKQFPYLTDGERNAFDKIISFLNFLDSVQSENLPNISRYITAAEVSSLLNIQT
ref|YP_001255314.1|      EISLNEDIKQFPYLTDGERNAFDKIISFLNFLDSVQSENLPNISRYITAAEVSSLLNIQT
ref|YP_001560315.1|      EISLQEDVKQFPYLTDGERNAFDKIIAFLNFLDSIQSENLPNISRYITAPEVSSLLNVQA
RAAC01050                EIPLADDARQYDLLSDDERRSYNKVLSFLIFMDSLLTHNLPNINEYITAPEVNLCLTVHA
                         **.* :* :*:   *:*.**.:::*:::** *:**: :.*****..****.**.   *.:::

ref|YP_878438.1|         FQEEIHAQSYSYILDTVTNPITRDKIYDQWREDKNLLERNKFIAGIYQSFNENPTTENFL
ref|ZP_02621211.1|       FQEEIHAQSYSYILDTVTNPITRDKIYDQWREDKNLLERNKFIAGIYQRFNENPTTENFL
ref|YP_001392091.1|      FQEEIHAQSYSYILDTVTNPITRDKIYDQWREDEHLLERNKFIAGIYEKFNKEPEIHNFL
ref|YP_001255314.1|      FQEEIHAQSYSYILDTVTNPITRDKIYDQWREDEHLLERNKFIAGIYEKFNKEPEIHNFL
ref|YP_001560315.1|      FQEEIHAQSYSYILDTVTNPVTRDRIYDIWREDKYLLERNKFIANIYQRFSDEPSDENFV
RAAC01050                FQEAVHSQSYGYVLDSVVNPATRDQIYNEWRNDDHLLRRNQFITDLFEEFIENPTDRNLM
                         *** :*:***.*:**:*.** ***:**: **:*. **.**:**:.::: * .:*  .*::

ref|YP_878438.1|         RTIMANYILEGIYFYSGFSFFYTLARQGKMTATSTIFKYINRDEITHLILFQNIIKELKN
ref|ZP_02621211.1|       RTIMANYILEGIYFYSGFSFFYTLARQGKMTATSTIFKYINRDEITHLILFQNIIKELKN
ref|YP_001392091.1|      RAIMANYILEGIYFYSGFSFFYTLARQGKMTATSTIFKYINRDEVTHLVLFQNIIKELKN
ref|YP_001255314.1|      RAIMANYILEGIYFYSGFSFFYTLARQGKMTATSTIFKYINRDEVTHLVLFQNIIKELKN
ref|YP_001560315.1|      RVVFANYILEGIYFYSGFSFFYTLARQGKMTATSTIFKYINRDEITHLVLFQNIMKELRV
RAAC01050                KTIVANYILEGVYFYAGFGFFFVLGRQGKMLGTVSEIKFIQRDELTHLAIFRNLYHEIIR
                         :.:.*******:***:**.**:.*.*****  .*  :  :*:*:***:***  :*:*: :*:

ref|YP_878438.1|         ENPDIFTESIMEEFRMMMKMGVEHEIKWGQYVTNNEILGINDNLIEKYIKYLSNLRLNAI
ref|ZP_02621211.1|       ENLDIFTESIIEEFRMMMKTGVEHEIKWGQYVTNNEILGINNNLIEKYIKYLSNLRLNAT
ref|YP_001392091.1|      ENSHIFTEELEEEFRQMMRMGVEHEIQWGQYVTNNEILGLNDELIEKYIKYLSNLRLVAI
ref|YP_001255314.1|      ENLHIFTEELEEEFRQMMRMGVEHEIQWGQYVTNNEILGLNDELIEKYIKYLSNLRLVAI
ref|YP_001560315.1|      EQKEMFTKGLEEELREMMRTGVEHEIAWGQYVTDNQILGINNELIDQYIKYLSNQRLRAV
RAAC01050                ENPGIVTPDMEEEFVEMMRTAVQHEIAWGQYVTQGKIVGLTDALIDAYIKYLANLRLQSL
                         *:   :.*   : **:   **:  .*:***  ******:.:*:*:.: **: *****:* ** ::

ref|YP_878438.1|         GLEVLYPEITEHPMEWIENFSKLNNTKTDFFEAKVTNYTKAAAFDFDDL
ref|ZP_02621211.1|       GLEVLYPEITEHPMEWIENFSKLNNTKTDFFEAKVTNYTKAAAFDFDDL
ref|YP_001392091.1|      GLKPLYPEINKHPMEWIDSFSKLNSTKTDFFEAKVTNYTKAAAFDFDDL
ref|YP_001255314.1|      GLKPLYPEINKHPMEWIDSFSKLNSTKTDFFEAKVTNYTKAAAFDFDDL
ref|YP_001560315.1|      GLEILYPEITKHPMEWIESFSNINSTKTDFFEAKVTNYTKAAVFDFDDL
RAAC01050                NLPILYPEIKEHPMPWMDSFAAINSHKTDFFEQRVTNYTKAGNLNWDDL
                         .*  *****.:*** *::.*: :*. ****** :*******.  :::***
```

FIG. 141

```
ref|YP_148023.1|         ------------------------------------------AEWLAQGSIAVPKLLLGHY
ref|YP_001126202.1|      ------------------------------------------AEWLAQGSVVVPKLLLDHY
ref|ZP_01697284.1|       -------------------------------------------------LTVPQLLLKKY
ref|YP_001421643.1|      -------------------------------------------------SIPNLLLTHY
gb|ABN10253.1|           --------------------------------------------------IPNLLLTHY
RAAC01009                MDLWARSRPRSDSVSPHALPNGALSARGGERMEPSGRQGGNSDYLSAPFVAVPCDLLRRF
                                                                          :*  ** ::

ref|YP_148023.1|         KQLGLGEGELVLLLHMQSFFE-EGVLFPTPAELAERMTVSAAECMEMVRRLLQKGMIAIE
ref|YP_001126202.1|      KQLGLSEGELVLLLHMQSFLE-EGIVFPTPAELAEKMTVSAAECMEMVRRLLQKGMVGIE
ref|ZP_01697284.1|       KQLGLNETELVLLLQVYSFLK-EGNAFPTPEDLAGRLTIPESMCVSILRRLIQHQFLSIE
ref|YP_001421643.1|      RQLGLNETELILLLKIKMHLE-KGSYFPTPFELQSGMSISAEECTSCLRMFIQKGFLFIE
gb|ABN10253.1|           KQLGLNETELILLLKIKMHLE-KGSYFPTPNQLQEGMSISVEECTNRLRMFIQKGFLFIE
RAAC01009                AQLGLHPHELVVLLQTLASGQTEGTTPELSPHELGERCGMSSKEVMACVERLVTEGPLAIG
                          **  ::**::        :*   :* :*  :.       :. ::  ::  * ref|YP_148023.1|         EHTDEQGIRNEKYTLEPLWEKLVHHLYTQAAQQGELGRQEEEESLYTVFEQEFGRPLSPF
ref|YP_001126202.1|      EHTDERGVRGEKYTLEPLWEQLVHHLYAQTVKDGQIGQQKEEESLYTIFEQEFGRPLSPF
ref|ZP_01697284.1|       EGEGEGGILYEKYSIMPLWAKLADEFIYEKKQDELEKSVNEETDLYTTFEQEFGRPLSPL
ref|YP_001421643.1|      ECEDHNGIKFEKYSLQPLWAKLYDYMQHSQNETQERTSEREQKSLYTIFEEEFGRPLSPL
gb|ABN10253.1|           ECEDQNGIKFEKYSLQPLWGKLYEYIQLAQTQTQERKAEGEQKSLYTIFEEEFARPLSPL
RAAC01009                ERYDDQGAHVTYFDLQPLWDKLKGRRRMVQPPP-------AEKDLVSLFEEEFGRPLSSL
                         *  .. *     : : *** :*                  :  .* : **:**.****.:

ref|YP_148023.1|         ECETLAMWIDQDGHEPAIIKAALREAVLSGKLNFRYIDRILFEWKKNGIRT---------
ref|YP_001126202.1|      ECETLSMWIDQDGHEPAIIKAALREAVLSGKLNFRYIDRILFEWKKNGIRT---------
ref|ZP_01697284.1|       ECETLAMWIDQDGQSPDLIKAALREAVISGKLNFRYIDRILFEWKKNGFKT---------
ref|YP_001421643.1|      ECETLAIWQDQDQHDAILIKHALKEAVLSGKLSFRYIDRILFEWKKNGLKT---------
gb|ABN10253.1|           ECETLAIWQDQDQHDAQLTKHALKEAVLSGKLSFRYIDRILFEWKKNGLKT---------
RAAC01009                ECDQLRAWLGEHGYPEWLVVEALKESVLANKYSFRYIDRVLYNWQKNNVRSRQDLEQYRA
                         **:  *  *  .:.       :: **:*:*::.* .******:*::*:**..::

ref|YP_148023.1|         ------------------------------------------------------------
ref|YP_001126202.1|      ------------------------------------------------------------
ref|ZP_01697284.1|       ------------------------------------------------------------
ref|YP_001421643.1|      ------------------------------------------------------------
gb|ABN10253.1|           ------------------------------------------------------------
RAAC01009                QYRERQAQWRGEPQAGQSKPRSRPASPRTAAREPVRDERYASFYELFPD
```

FIG. 142

```
ref|ZP_02175216.1|    ------------------------------------------------DKVFYPFAGFTKGE
ref|YP_464174.1|      ------------------------------------------------DKVFYPEAGFTKGE
ref|ZP_02321813.1|    ------------------------------------------------DKVFYPEAGFTKGE
ref|YP_753805.1|      -----------------------AMAGREIK----------LTNLDRVLWPEDGYCKRD
ref|ZP_01575281.1|    ------------------------------------------------DKLFWPEAGITKLE
RAAC00998             MLEMCSKGRKNCIQVSSLIATGSSAHARREVKRMKRHESPPTLTHGDKIYFPAAGLCKRD
                                                                      *::  :*    *  *  :

ref|ZP_02175216.1|    VVDYYRRVAPVLLPHLRDRPLTLKRYPEGVDGPHFYEKRCPRHRPDWFRTEAIWSEGNQD
ref|YP_464174.1|      VVDYYRRVAPVLLPHLRDRPLTLKRYPEGVEGPHFYEKRCPRHRPDWFRTEAIWSEGNQE
ref|ZP_02321813.1|    VVDYYRRVAPVLLPHLRDRPLTLKRYPEGVDGPHFYEKRCPRHRPDWFRTEAIWSEGNQD
ref|YP_753805.1|      LVEYYTAIFPYMLPHLSERPLVFTRYPRGIGEKSFYQKNAPEGLPQWIKTFTWAGS-DGD
ref|ZP_01575281.1|    YVKTMTKLAPFLIKYSKHRMLTSIRYPHGINDKSFFQKEKPQGTPEWVETVEFN------
RAAC00998             YMTYLAQIGEHLVRHLRIRFVTLVRCPDGVAGRRFYQRHLPPHAPPSLPRREVQG-----
                         :        :    ::   .*  :.      * *   *::  .  *      .

ref|ZP_02175216.1|    YIDYCVVDDLSSLVWLASIADLELHPSLSLVDDV--ERPTALVFDLDPGPPADLLACCEV
ref|YP_464174.1|      YIDYCVVDDLSSLVWLASIADLELHPSLSLVDDV  ERPTALVFDLDPGPPADLLACCEV
ref|ZP_02321813.1|    YIDYCVVDDLSSLVWLASIADLELHPSLSRVDDV--ERPTALVFDLDPGPPAELLACCEV
ref|YP_753805.1|      SKNYVLVQQTVDLMWLANLACIEIHPWLSQINSI--EYPDFIVFDLDPSEQSTFEQVISV
ref|ZP_01575281.1|    QKNYINLNSAATLVWLCTQAALELHTSFNVHEKP--NHPSSLVFDLDPDDDLHFEDVAEL
RAAC00998             ERPLIAIPDVETLLYYCNLGAIEFHAGLELVQGPQAGCPTALTFDLDPSDPRDFERVREL
                       :   .  *::   .    :*:*.  :          *    :.*****.    :    .:

ref|ZP_02175216.1|    ALLLRRLLAALGLEAFPKGSGSKGMCLYVPLSG-ATYADTKPFAHAVARLLERRHPQLVV
ref|YP_464174.1|      ALLLRRLLAALGLEAFPKSSGSKGMCLYVPLSG-ATYADTKPFAHAVARLLERRHPQLVV
ref|ZP_02321813.1|    ALLLRRLLAALGLEAFPKSSGSKGMCLYVPLSG-ATYADTKPFAHAVARVLERRHPQLVV
ref|YP_753805.1|      ARLLHELMDSLSLRVYPKTSGAKGLHLYLPIAEGFTYSQIRRVAQAMAEMVCQVIPDIAT
ref|ZP_01575281.1|    AGRIHETLEALGIMDFIKTSGATGLQIFVPVAAKFDYDTARSLNEFFAQYFAEKLRSTVT
RAAC00998             ALCLREVLRGLGLDGVAKTTGASGLQVLVPLEEPLPYAVTRPVVNFVAAYCASRWPDLAT
                      *   ::   :  . * .:     *  :*:.*::: :*:      *   :  . . .*      . ..

ref|ZP_02175216.1|    ERMAKALRGGKVLVDWSQNDPHKTTVCVYSLRARPRPTVSTPLRWAEVEKAVRTRDAGGL
ref|YP_464174.1|      ERMAKALRGGKVLVDWSQNDPHKTTVCVYSLRARPRPTVSTPLRWAEVEKAARTRDAGGL
ref|ZP_02321813.1|    ERMAKALRGGKVLVDWSQNDPHKTTVCVYSLRARPRPTVSTPLRWAEVEKAVRTRDAGGL
ref|YP_753805.1|      TERALKHRGPRVYLDYLQNGLGKTVCAAYSVRPHKGAPCSTPIEWQELES-IRPDQ----
ref|ZP_01575281.1|    IERMKKKREGKTYFDWQQMWTGKSMITAYSARAVKSAAVSAPIEWSELND-VRPEM----
RAAC00998             TERRVRHRGRRVYVDADPQHGPTRTLIAAYSVRAVEKALVSAPITWAELEYGVSPDA
                          .   *  ::  .*   *      ::    .** *.     .  *:*: * *::

ref|ZP_02175216.1|    VFEAAAVLRRVERVGDLFAFVLTLRQRLFA------------------
ref|YP_464174.1|      VFEAAAVLRRVERVGDLFAFVLTLRQRLFA------------------
ref|ZP_02321813.1|    VFEAGAVLRRVERVGDLFAFVLTLRQRLFA------------------
ref|YP_753805.1|      -FTIKTLPERLQQVGD--------------------------------
ref|ZP_01575281.1|    -FTLKNIINRLEQKGDIFE-----------------------------
RAAC00998             -FDLHVVPDRLERVGDWLELAARHPASRVRAIHDALPPPWRQTRVRSV
                       *       :   *:::  *.
```

FIG. 143

```
ref|NP_832076.1|       ----------------------------------------------------------------
ref|YP_001645033.1|    ----------------------------------------------------------------
ref|NP_844759.1|       ELREFZPCGBACTERIALNUCLEIDDNA-BINDINGPRTEINBACILLUSANTHRACISS
ref|YP_001375058.1|    ----------------------------------------------------------------
ref|YP_535778.1|       ----------------------------------------------------------------
RAAC02359              ---------------------------------------------------------------- ref|NP_832076.1|       ----------------------------------------------------------------
ref|YP_001645033.1|    ----------------------------------------------------------------
ref|NP_844759.1|       TRAREFYPDNA-BINDINGPRTEINHUBACILLUSTHURINGIENSISSTRALHAKAMRE
ref|YP_001375058.1|    ----------------------------------------------------------------
ref|YP_535778.1|       ----------------------------------------------------------------
RAAC02359              ---------------------------------------------------------------- ref|NP_832076.1|       ----------------------------------------------------------------
ref|YP_001645033.1|    ----------------------------------------------------------------
ref|NP_844759.1|       FZPDNA-BINDINGPRTEINHUBACILLUSANTHRACISSTRAREFZPDNA-BINDINGP
ref|YP_001375058.1|    ----------------------------------------------------------------
ref|YP_535778.1|       ----------------------------------------------------------------
RAAC02359              ---------------------------------------------------------------- ref|NP_832076.1|       ----------------------------------------------------------------
ref|YP_001645033.1|    ----------------------------------------------------------------
ref|NP_844759.1|       RTEINHUBACILLUSCEREUSAHREFZPDNA-BINDINGPRTEINHUBACILLUSCEREU
ref|YP_001375058.1|    ----------------------------------------------------------------
ref|YP_535778.1|       ----------------------------------------------------------------
RAAC02359              ---------------------------------------------------------------- ref|NP_832076.1|       ----------------------------------------------------------------
ref|YP_001645033.1|    ----------------------------------------------------------------
ref|NP_844759.1|       SAHREFZPDNA-BINDINGPRTEINHUBACILLUSANTHRACISSTRAREFZPDNA-BIN
ref|YP_001375058.1|    ----------------------------------------------------------------
ref|YP_535778.1|       ----------------------------------------------------------------
RAAC02359              ---------------------------------------------------------------- ref|NP_832076.1|       ----------------------------------------------------------------
ref|YP_001645033.1|    ----------------------------------------------------------------
ref|NP_844759.1|       DINGPRTEINHUBACILLUSANTHRACISSTRAREFZPDNA-BINDINGPRTEINHUBAC
ref|YP_001375058.1|    ----------------------------------------------------------------
ref|YP_535778.1|       ----------------------------------------------------------------
RAAC02359              ---------------------------------------------------------------- ref|NP_832076.1|       ----------------------------------------------------------------
ref|YP_001645033.1|    ----------------------------------------------------------------
ref|NP_844759.1|       ILLUSCEREUSWREFZPDNA-BINDINGPRTEINHUBACILLUSCEREUSNVH-REFZPD
ref|YP_001375058.1|    ----------------------------------------------------------------
ref|YP_535778.1|       ----------------------------------------------------------------
RAAC02359              ---------------------------------------------------------------- ref|NP_832076.1|       ----------------------------------------------------------------
ref|YP_001645033.1|    ----------------------------------------------------------------
ref|NP_844759.1|       NA-BINDINGPRTEINHUBACILLUSCEREUSHREFZPDNA-BINDINGPRTEINHUBAC
ref|YP_001375058.1|    ----------------------------------------------------------------
ref|YP_535778.1|       ----------------------------------------------------------------
RAAC02359              ----------------------------------------------------------------
``` continued →

FIG. 143 continued

```
ref|NP_832076.1|      ------------------------------------------------------------
ref|YP_001645033.1|   ------------------------------------------------------------
ref|NP_844759.1|      ILLUSCEREUSBBREFZPDNA-BINDINGPRTEINHUBACILLUSANTHRACISTSIANK
ref|YP_001375058.1|   ------------------------------------------------------------
ref|YP_535778.1|      ------------------------------------------------------------
RAAC02359             ------------------------------------------------------------ ref|NP_832076.1|      ------------------------------------------------------------
ref|YP_001645033.1|   ------------------------------------------------------------
ref|NP_844759.1|      VSKII-IGBAAPDNA-BINDINGPRTEINHUBACILLUSANTHRACISSTRAMESGBAAS
ref|YP_001375058.1|   ------------------------------------------------------------
ref|YP_535778.1|      ------------------------------------------------------------
RAAC02359             ------------------------------------------------------------ ref|NP_832076.1|      ------------------------------------------------------------
ref|YP_001645033.1|   ------------------------------------------------------------
ref|NP_844759.1|      DNA-BINDINGPRTEINHUBACILLUSCEREUSATCCGBAATDNA-BINDINGPRTEINH
ref|YP_001375058.1|   ------------------------------------------------------------
ref|YP_535778.1|      ------------------------------------------------------------
RAAC02359             ------------------------------------------------------------ ref|NP_832076.1|      ------------------------------------------------------------
ref|YP_001645033.1|   ------------------------------------------------------------
ref|NP_844759.1|      UBACILLUSANTHRACISSTRAMESANCESTRGBEALDNA-BINDINGPRTEINHUBACI
ref|YP_001375058.1|   ------------------------------------------------------------
ref|YP_535778.1|      ------------------------------------------------------------
RAAC02359             ------------------------------------------------------------ ref|NP_832076.1|      ------------------------------------------------------------
ref|YP_001645033.1|   ------------------------------------------------------------
ref|NP_844759.1|      LLUSCEREUSGGBAATDNA-BINDINGPRTEINHUBACILLUSANTHRACISSTRSTERN
ref|YP_001375058.1|   ------------------------------------------------------------
ref|YP_535778.1|      ------------------------------------------------------------
RAAC02359             ------------------------------------------------------------ ref|NP_832076.1|      ------------------------------------------------------------
ref|YP_001645033.1|   ------------------------------------------------------------
ref|NP_844759.1|      EGBAATDNA-BINDINGPRTEINHUBACILLUSTHURINGIENSISSERVARKNKUKIAN
ref|YP_001375058.1|   ------------------------------------------------------------
ref|YP_535778.1|      ------------------------------------------------------------
RAAC02359             ------------------------------------------------------------ ref|NP_832076.1|      ------------------------------------------------------------
ref|YP_001645033.1|   ------------------------------------------------------------
ref|NP_844759.1|      STR-GBAAUDNA-BINDINGPRTEINHUBACILLUSCEREUSELGBABKHUFAMILYDNA
ref|YP_001375058.1|   ------------------------------------------------------------
ref|YP_535778.1|      ------------------------------------------------------------
RAAC02359             ------------------------------------------------------------ ref|NP_832076.1|      ------------------------------------------------------------
ref|YP_001645033.1|   ------------------------------------------------------------
ref|NP_844759.1|      -BINDINGPRTEINBACILLUSTHURINGIENSISSTRALHAKAMGBEDRDNA-BINDIN
ref|YP_001375058.1|   ------------------------------------------------------------
ref|YP_535778.1|      ------------------------------------------------------------
RAAC02359             ------------------------------------------------------------
``` continued →

FIG. 143 continued

```
ref|NP_832076.1|       ------------------------------------------------------------
ref|YP_001645033.1|    ------------------------------------------------------------
ref|NP_844759.1|       GPRTEINHUBACILLUSANTHRACISSTRAGBEDRDNA-BINDINGPRTEINHUBACILL
ref|YP_001375058.1|    ------------------------------------------------------------
ref|YP_535778.1|       ------------------------------------------------------------
RAAC02359              ------------------------------------------------------------ ref|NP_832076.1|       ---------------------------------------------------SISATCC
ref|YP_001645033.1|    ----------------------------------------------------------
ref|NP_844759.1|       USANTHRACISSTRAGBEDRDNA-BINDINGPRTEINHUBACILLUSANTHRACISSTRA
ref|YP_001375058.1|    ----------------------------------------------------------
ref|YP_535778.1|       ----------------------------------------------------------
RAAC02359              ---------------------------------------------------------- ref|NP_832076.1|       SCRESIGNIFICANCEE-IDENTITIESPSITIVESGAPSMNKTELIKNVAQSADISQKD
ref|YP_001645033.1|    ---------------------------------------MNKTELVKNVAQSADISQKD
ref|NP_844759.1|       SCRESIGNIFICANCEE-IDENTITIESPSITIVESGAPSMNKTELIKNVAQSADISQKD
ref|YP_001375058.1|    ---------------------------------------MNKTELIKNVAQSADISQKD
ref|YP_535778.1|       ---------------------------------------NKAALIERVAEKTGLTKKD
RAAC02359              ---------------------------------------MNKRDLIRKTAEETGLSQKD
                                                               **  *:...*:.:.::**

ref|NP_832076.1|       ASAAVQSVFDTIANALQSGDKVQLIGFGTFEVRERSARTGRNPQTGEEIQIAAGKVPAFK
ref|YP_001645033.1|    ASAAVQSVFDTIANALQSGDKVQLIGFGTFEVRERSARTGRNPQTGEEIQIAAGKVPAFK
ref|NP_844759.1|       ASAAVQSVFDTIATALQSGDKVQLIGFGTFEVRERSARTGRNPQTGEEIQIAAGKVPAFK
ref|YP_001375058.1|    ASVAVQSVFDTITNALQNGDKVQLIGFGTFEVRERAARTGRNPQTGEEIQIAAGKVPAFK
ref|YP_535778.1|       ATVAVDAVFETIQDALVDGEKVQLIGFGNFEVRERAARKGRNPQTGEEIEIPASKVPAFK
RAAC02359              CEAVINTLFDTIRKTVESGEKVQIIGFGTFELRERAARTARNPRTGEAVEVPARRVPAFK
                       .  ..::::*:**   ::  .*:*:.:*:..*:*  :::.*  :***** ref|NP_832076.1|       AGKELKEAVK-
ref|YP_001645033.1|    AGKELKEAVK-
ref|NP_844759.1|       AGKELKEAVK-
ref|YP_001375058.1|    AGKELKEAVK-
ref|YP_535778.1|       PGKSLKDAVK-
RAAC02359              PGAELKQAVQV
                       .*  .**:**:
```

FIG. 144

```
ref|ZP_01667008.1|    ---------------------EIKWDGIRAVIYLASDNLRILSRNLKDVTRQYPEL
ref|YP_946103.1|      -MPNYSFMLATSGTTADLRCDDWLYELKWDGIRAIITGTESRIRLMSRNGNDLTAAYPEL
ref|YP_075626.1|      ---PFPPMLLER-AEAPFADDDWVYQVKWDGVRNLTLVEGGRVRHWSRRLRERTALFPEF
RAAC00997             -MPFFRPFEPISSTEVPVG-DAWIAQVKWDGVRAVAEVSGDGVQIWNRHGRLRTDRYPEI
ref|ZP_02854041.1|    MEFFQIQAMEPIPRQSVPTGDDWFYQIKWDGIRILTFFDGNSIKLRTKKGFKRTTEYPEL
ref|YP_753804.1|      ------RSMDPINCEQAFDSDDFLYQVKWDGVRMLVAVAGEQVSLLNKRGNLRSRQYPEL
                                             ::*****:*  :       :   .:.    :  :**:

ref|ZP_01667008.1|    MPLTQALAGHSVILDGEIVAFDINCRPS------------------FARLQNRMGLASDRT
ref|YP_946103.1|      TDRACWPDGD-FVADGEIVALGKGSRPD------------------FGRLQLRMNLVKAAD
ref|YP_075626.1|      DGLAAALPGRRAVLDGEIIVLQ-DGRPS------------------FSAVLERDLAGSTAG
RAAC00997             ASALRPFRGC--AFDGEVVALT-QGRPD------------------FYRVLRRDRAVASHE
ref|ZP_02854041.1|    NELTKEFGNTTWLLDGEIIVANQTDKSDHPKFTTTNESCEEVGANFFHVLKRDRTKNPT-
ref|YP_753804.1|      QNLPNLIRASTAVLDGEIVVLREGKPS------------------FPAVMQRDNCRNPMK
                                 ***::.                              *   :  * ref|ZP_01667008.1|    IARKTTEIPATYIIFDLLYIDGQSTLSLPYIERRRLLEELDLN---GPNWQTPAYKTG-Q
ref|YP_946103.1|      IERARATVPVQLMLFDLLYDDGTDLSGLPTHERRERLSGFAERWRVGCPLHLSAVLDH-D
ref|YP_075626.1|      AARRR---PATLMLFDLLEWDGRELYDVPLAERLALLEAVVPP---DEAWQVVSSFPGSD
RAAC00997             IEQLVREIPVWYAVFDVVRMGGEWVGDWPLAKRLDWMLEHLSG-----VEHVLTSEGEVD
ref|ZP_02854041.1|    -QKLLKTFPVRYKVFDLLMIDNQWLVNEPFIKRRELLNKHFNN-----NKFLQIIRSYSD
ref|YP_753804.1|      IQHLSKTLAISYMVFDLLYLNGRDLRSASLVDRLSQLAELFDN-----QGCLYLVESFSQ
                               :**:: ..   . . .*  :                  :

ref|ZP_01667008.1|    GRELLLASRRLGLEGIVAKKLDSIYLPGKRPGTWLKIKNVRRQEFVIGGWLPGQGTRTGM
ref|YP_946103.1|      VEDLMTSAAELGLEGVMAKKADSRYVIGRRSRSWIKLKLEQSQEVVVGGWRPGAGARAGT
ref|YP_075626.1|      GPALYAAAVARGLEGVVAKRRASRYVPGARSRDWLKVKRRSEMLAVVVGYTN----PTGR
RAAC00997             TEALFAATKQLGLEGIVCKRVDSTYAPGGKDGRWVKVKHERNAIAAVGGVVY----RDGA
ref|ZP_02854041.1|    GLSLFNITSQQNEGLEGIVAKKSNSIYHPGKKHSEWFKIKHLKYLQAYLGGVIVK--ENQ
ref|YP_753804.1|      GTTLFDSVQRAGLEGIVAKKKNSFYRPGKQHDDWFKIKCRCSQACLVGGYTLR----GKQ
                               *   **::.*:  *  *   *         *   *.*:*     * ref|ZP_01667008.1|    IGALLLGYYDRTPKEAAKAGQPQRLLFAGAVGTG-FTHTTLKKLQHLLK---PLEQAEPP-
ref|YP_946103.1|      FGALLLGIPD----------GDKLHYVGRVGSG-FKDWQLRDIMEKLE--PLAIVESP-
ref|YP_075626.1|      PGGLLLGAYR-----------DGRLRYIGRVGSG-LSGADLAAIRHHLPSGPCPLAEIPR
RAAC00997             PNALMLGLFD---------DKARLFHVGNAGAGRLPRRAWRQLVERVLS---HETSLQP
ref|ZP_02854041.1|    TKSLLLGQKS--------DLADYKLNYIGRASTG-LTQKELNMLKDFAFKNRVSNSPFGN
ref|YP_753804.1|      VNALLLG----------VMRDCSLSFAGKASNG-LDAEQLQILSETLPRLEVKDSPF--
                        .*:**          *  .*   *  : .:      :  .

ref|ZP_01667008.1|    FAESP-----PLKGAVFVKPALVGEVEFTEWTPGGTLRHP---------------------
ref|YP_946103.1|      FADIPR---EDAAGATWVSPELVAEVTFGEWTGPGRLRHPV-------------------
ref|YP_075626.1|      LRERFG---GDPGFVWVEPLLTVRVSFTEWTEEGRLRDPVVV------------------
RAAC00997             FARAP-----KAVRTCRFAHPVVAVKVRFAEWTPKGTMRHPVLLAELDIPATPAACSFAQA
ref|ZP_02854041.1|    LSKVDLELADSKESVVFLSPQLKLQVKYTNWTPGGNLRHPVI------------------
ref|YP_753804.1|      --------LEPTPAGSHYITPQLAVEVEYLEWTDSLHLRFPVI-----------------
                           :   *   :  .*  :  :**    :* * ref|ZP_01667008.1|    --
ref|YP_946103.1|      --
ref|YP_075626.1|      --
RAAC00997             DP
ref|ZP_02854041.1|    --
ref|YP_753804.1|      --
```

FIG. 145

```
ref|ZP_02330146.1|      ---MRVAIYIRVSTEEQAQYGYSIDAQKERLIAYCTSQGWTDYKIYIDDG
RAAC02419               MLLMTVALYCRVSTDEQAEHGFSIDNQKERLIAFCKSQGWDQYRLYIDDG
ref|YP_001210709.1|     ----TVACYIRVSTDEQAEQGISIPAQKSRLLAFCRSQGWNIYGFYIDDG
gb|AAD26564.1|AF124258_1 ------ALYIRVSTMEQAKEGYSIPAQTDKLKAFAKAKDMAVAKVYTDPG
ref|ZP_02184702.1|      -----VAIYVRVSTQDQAEEGYSIEEQIDKLTKYCDIKDWYVYEIYKDPG
ref|ZP_01828805.1|      ----------------------SKKDKLSSYCDIKDWNVYKVYTDGG
                                                          : .:*  :.  :.   . * * ref|ZP_02330146.1|      YTGTKMMRPALNRLIRHIEDDKIDLVVVYKLDRLSRKQLDVLYLLEEVFE
RAAC02419               YTGTNMDRPALQRLIKHIKEKKIDTVIVYKLDRLSRKQRDVLYLLEDVFD
ref|YP_001210709.1|     YSGKDLDRPAMRRLIGDTGAKKFDTVLVLKLDRLSRRQKDVLFLLEDVFE
gb|AAD26564.1|AF124258_1 FSGAKMERPALQEMISDIQNKKIDVVLVYKLDRLSRSQKNTLYLIEDVFL
ref|ZP_02184702.1|      FTGSTIDRPGMKKLVNDSKQHKFDTVLVYKLDRLSRSQKDTLYLIEDVFA
ref|ZP_01828805.1|      FSGSNTDRPALESLIKDAKKRKFDTVLVYKLDRLSRSQKDTLHLIEDVFI
                        ::*    **.:. ::  .    *:* *:* ******* *  :.*.*:*:**

ref|ZP_02330146.1|      KHNVGFKSATEPFETTTPFGKAMIGILAVFAQLERDMIVERTTIGRRQRV
RAAC02419               KNNVVFKSATEPFDTSTPLFGKAMLGILAVFAQLERDTIIERLSTGQKLRV
ref|YP_001210709.1|     PGGVGFKSVTEGFDTTTPFGKAALGMMAVFAQLERETIVERVRMAKKESA
gb|AAD26564.1|AF124258_1 KNNVDFISMQESFDTSTPFGRATIGMLSVFAQLERDTITERMHMGRTERA
ref|ZP_02184702.1|      KYNVDFVSLSENFDTSTAFGKAMIGILSVFAQLEREQITERMQMGKVGRA
ref|ZP_01828805.1|      KNGIEFLSLQENFDTSTPFGKAMIGLLSVFAQLEREQIKERMQLGKIGRA
                        .: * *   * *:*:*.:*:* :*:::*******:  *  **    .:  .

ref|ZP_02330146.1|      SKGEWYG-GRIPFGYRMNRETKQLEIVPEEAKIIKEIYKMYLQGN-SRLS
RAAC02419               KSGKFSG-GRIPFGYVYNSQTGKFEVSPHEAFLVREVYKKYLQGY-SLSD
ref|YP_001210709.1|     KQGRFMG-GPAPYGYRHNFETKRLEVDEVQAGTVRWIYDRYLSGAPNYRH
gb|AAD26564.1|AF124258_1 KQGYYHGSGIVPLGYDY--VHGELIINDYEAQIIQEIYDLYVNQGKGQQY
ref|ZP_02184702.1|      RSGKAMGWTRPPFGYEYT--EGKYIVDDFKAIVINKIYKEYLSGI-SITK
ref|ZP_01828805.1|      KAGKSMMWAKTSYGYDYHRDTGTITINPAQALAIKFIFESYLRGR-SITK
                         *         . **           :   :*  :. ::. *:    .

ref|ZP_02330146.1|      IAEWAAER----TKARVIDHSVIRDILSRPVYTGKLSNAGNVVDGKHEAI
RAAC02419               LSDWIESQ----TSARYWDHARIRDMLTRETYTGVMPYGTLRSTEIAPPI
ref|YP_001210709.1|     IAEELEHTGVPGPTNEKWNKAFVRKILTNPVYAGLIRHRENLYPGRHDPI
gb|AAD26564.1|AF124258_1 ITKRMVAK----YPDKVKTLTIVKYALTNPLYIGKISWDGKVYDGHHSPI
ref|ZP_02184702.1|      LRDKLNDEG--HLGKDIPWSYRAIRSILDNPVYAGYMNFKGEVYKGNHDAI
ref|ZP_01828805.1|      LRDDLNEK---YPKHVPWSYRAVRTILDNPVYCGFNQYKGEIYPGNHEPI
                        :  .        ::  *  . * *                    .* ref|ZP_02330146.1|      IDEKTWHAVQKETQER--KEGATP------LGEYLLTGLLKCGVCGG--P
RAAC02419               IERELWEQVQQEMVRR--REGFTP------KGEYLLSGLLRCAECGS--S
ref|YP_001210709.1|     VSPEKWQEVQKLIKSRGAVRAAAA------VHTGLLSGIIWCGECGARMR
gb|AAD26564.1|AF124258_1 IDKSMYDKAQEIIARMAQKGGEQHG-----NQLGLLLGITYCGKCGA---
ref|ZP_02184702.1|      ITKELFDKTKTELDIRQKQAYAQNNNPRPFQGKYILSGLARCGYCGAP--
ref|ZP_01828805.1|      ISKEEYDKTQSELKIRQRTA-AENVNPRPFQAKYILSGIAQCGYCGAP--
                        :   .  :.   ..:                    :*  *:   *. **.

ref|ZP_02330146.1|      IVHVKRITRKYGKEYLYELYACKNQHVR-----KKDRNNNCSLGYIRREK
RAAC02419               FIHVIRKK----GPYVYYLYGCRSQHQRPKKVPRRAPKQACTVGYRNREE
ref|YP_001210709.1|     VKNVWQNHPNTNPKKVTRYYVCYSQDRAGG---HMVRNPTCRCGYKHGGA
gb|AAD26564.1|AF124258_1 --EVFRYVSG-GKKYRYNYYMCRSVKKMLP---SLVKDWNCKQPSLRQEV
ref|ZP_02184702.1|      -LELMLGNIRKDGTRLKKYKCTNRIVKSR--VTFYNDNKKCTSGFYHMND
ref|ZP_01828805.1|      -LKIMLGVKRKDGSRLKKYECHQRHPRTLRGVTTYNDNKKCDSGFYYKDK
                                  .:                               .  * ref|ZP_02330146.1|      VEKFVIEQIKSYT--TDDVLIKQITNEKNKFKEN--DESALNNLESQLKK
RAAC02419               LESWVIEQVKRIARLDAEEFEHQIANIETNSDE---TEDTLRDLRKNLSD
ref|YP_001210709.1|     VEEQVLRELFCYS--YDRRLLRRALEEALAAADNRAFLRELAQARKDLAA
gb|AAD26564.1|AF124258_1 VEKKVIDSLKSLDFKKIERELKQVENKT---------KSKITTINNQISK
ref|ZP_02184702.1|      LEDYVINEVSKLQ--KNP---ETIFERTEIKN-----ENHTEIYEHRIVV
ref|ZP_01828805.1|      LEAYVLKEISKLQ--DDADYLDKIFSGDNAET-----IDR-ESYKKQIEE
                        :*  *:   .:                .                . :

```
ref|ZP_02330146.1|         VLTGLENLYDAIESGEIKASSISDRIRKLEEQRDVLENHIDEIKDNTPQN
RAAC02419                  IEHKLNRWYEAFEEGTIDATQLRDRIKHLEEERRRLQTNIEELQDTLVKD
ref|YP_001210709.1|        TEKKLERWYDAFEKGALEGDQLTERVKGLHQRKAYLRGQIAEMESRLKEG
gb|AAD26564.1|AF124258_1   KHNEKQKILDLYQYGTFDVTMLNERMKKIDNEINALTANIANLEGTKSES
ref|ZP_02184702.1|         IDKKIKRLSDLYMNDLINLEDMQFKAKALKDEKDHLLNKLNHSEHKLENV
ref|ZP_01828805.1|         LSKKLSRLNDLYIDDRITLEELQSKSAEFISMRGTLETELENDPALRKNK
                             .. :    . :    :   :    : .     *  .: .        :

ref|ZP_02330146.1|         ---ELNIQEFNIFIKEIGEAWDYLTEDEQKALIRKAFRSVTLYKD-KEIK
RAAC02419                  ---TQPQRVFN-AAKLIEEAWDYMTFDEKKNVLRAAISYIEIPRKGQPPV
ref|YP_001210709.1|        KERQTSVEEMMGILQDFPRIWENATAEERREIVVNTVKAVKV--------
gb|AAD26564.1|AF124258_1   --------LINKLETLKTFNWETETTENKILIIKEFVERIEL--------
ref|ZP_02184702.1|         -----KKDKAILFLKDIENNINDETYENKKKIINVLIKKVDVKANEIKVI
ref|ZP_01828805.1|         -----RKADMRKLLN--AEKVFSMDYENQKVLVRRLINKVKVTAEDIVIN
                                    :::    ::       .  : :

ref|ZP_02330146.1|         VEWN-
RAAC02419                  IHWNV
ref|YP_001210709.1|        -----
gb|AAD26564.1|AF124258_1   -----
ref|ZP_02184702.1|         WN---
ref|ZP_01828805.1|         WKI--
```

FIG. 146

```
ref|ZP_02309926.1|     ----FSKRLSELRKKKGFSQYKLADELGFSRGQVANYEQGTREPDYQTLLKIAEFFNVST
ref|ZP_01941236.1|     ----FSKRLSELRKKKGFSQYKLADELGFSRGQVANYEQGTREPDYQTLLKIAEFFNVST
ref|ZP_01926077.1|     ----FSKRLSELRKKKGFSQYKLADELGFSRGQVANYEQGTREPDYQTLLKIAEFFNVST
ref|NP_469419.1|       ----FSKRLSELRKKKGFSQYKLADELGFSRGQVANYEQGTREPDYQTLLKIAEFFNVST
ref|YP_001111866.1|    ---------------MTQEQLAQQLGFTRGQVSNYEQGSREPDFETLKKIADFFKVTT
RAAC02417              MMMTFGERLAQLRRSKGLSQYALAEQLKMTRGQIANYEQGTREPDIETLKKLADFFDVSI
                         :*  **::* ::***::*****:****  :** *:*:**.*:

ref|ZP_02309926.1|     DYL-LGR----DDNNLADTIAAHID--SNATEEDIKEILAYIEEKR-KEHANEKEINITE
ref|ZP_01941236.1|     DYL-LGR----DDNNLADTIAAHID--SNATEEDIKEILAYIEEKR-KEHANEREINITE
ref|ZP_01926077.1|     DYL-LGR----DDNNLAETIAAHID--SNASEEDIKEILAYIEEKR-KEHVNEEEINITE
ref|NP_469419.1|       DYL-LGR----DDNNLADTIAAHID--SNASEEDMKEILAYIEEKR-KEHANEEEIDITD
ref|YP_001111866.1|    DYM-LGR----TDD--------------PTPVDKLIELSALAGQQK-FDPMK-------E
RAAC02417              DFLVLGKPNVSDFNGLTNEVKRTLSALSQMSVEKQQEVADFAEYLRSKEEQPVVEYDVRE
                       *::  **:                    . :.  *:      :  :          :

ref|ZP_02309926.1|     IASKEDEEINKFVDE--NEDFKVVAARVM--------------
ref|ZP_01941236.1|     IASKEDEAVDKFVEE--NEDFKAVAARVM--------------
ref|ZP_01926077.1|     IASKEDDAVDKFVEE--NEDFKAVAARVM--------------
ref|NP_469419.1|       IAAKKDADVAKFVEE--NPDFKAVAARVM--------------
ref|YP_001111866.1|    LPPEAQRSLEDFID---------YLMRK---------------
RAAC02417              IAANMEKALYAHGDEDLIQHFEEIMRRVIRRYDERASQDQQNR
                       :..:  :   :  . :         *
```

FIG. 147

```
ref|ZP_02442523.1|    ---FQKRLKELRNAKGTSQIAIAAALGITDRGYRKYEAGDSEPTLSVIIALADYFDVSLD
ref|YP_001210714.1|   ---FAKRLSFLITKNKLSKQAVANAINVSRPAVSQFANGENLPSVEKLIALADFFDVSLD
RAAC03180             MSSFPERLSELLSATNSTKRALARAIGISERMIQYYITGAKSPTLDVLVAMADYFNVGLD
ref|YP_001664041.1|   -----KRIKELRKKKGITQKELASYLGISDRAVGYYESGQRTPPPDILQKIADFFNVSTD
ref|ZP_02589119.1|    ------RIKSLRKKENLTQKQLAEKIGVSQRMIGYYESEERFPPHDVLTKLADCFSVSAD
ref|NP_242309.1|      ---FPERLRYLRKKHGLTMKELGKKINVAESTISGYENGNRKPDMDTLVKMAEYFNSSTD
                         *:   *  .      :     :.   :.::          :      *  . : :*: *. . * ref|ZP_02442523.1|    YLCG--------------------
ref|YP_001210714.1|   YLVG--------------------
RAAC03180             YLAGRSDDPTPPPRSPSSGWDP
ref|YP_001664041.1|   YLLG--------------------
ref|ZP_02589119.1|    YLLG--------------------
ref|NP_242309.1|      YLLG--------------------
                      ** *
```

FIG. 148

```
ref|ZP_02442523.1|    --IFQKRLKELRNAKGTSQIAIAAALGITDRGYRKYEAGDSEPTLSVIIALADYFDVSLD
ref|YP_001562345.1|   ---FSQRLRQLREEKGLLQKDVAKILGITPSAYGYYEQGKREPSMEVLKKLSDFFNVSID
ref|YP_001210714.1|   --IFAKRLSFLITKNKLSKQAVANAINVSRPAVSQFANGENLPSVEKLIALADFFDVSLD
RAAC03525             MTLFSQRLTELLDRTGTTRRSFAQALGVSERMVQYYITGKKDPTVETLIAIADFFDVSLD
ref|YP_001180871.1|   MNLFRFRLKELREEKNISRSDLAEILGVSTQTIANYENGHREPNFDTLLKIADYFGVTVD
ref|ZP_02543721.1|    --MIGEKIKELRKNNKITQEQLGNAIGVSKMAISYFEKGKKSPGRESLEKIADYFNVTTD
                        :  ::   *    .    :   ..  :.::      :  *.  *  . :  ::*:*.*: * ref|ZP_02442523.1|    YLCGRSDDPAR-
ref|YP_001562345.1|   YLLGRTD-----
ref|YP_001210714.1|   YLVGRSDDPRR-
RAAC03525             YLVGRSENPERK
ref|YP_001180871.1|   YLIGRSE-----
ref|ZP_02543721.1|    YLLGRSEDPE--
                      ** **::
```

FIG. 149

```
ref|YP_001038857.1|    ------------------------------------------YKGKQVRTFIIDSEPWWVAKDVC
ref|YP_146372.1|       -----------------------------------NQLQKVFTYSGSQVRTIIKDDEVWFVAKDVC
ref|YP_001662865.1|    ------------------------------------------YEGNTVRTVMKDGNPWWVLKDVC
RAAC03224              MCFDPDRRGDLQLQDLHRRDTMQPVDMDGNQTMMEWMFEGHRIRVVMINDEPWWVAKDVC
ref|YP_006607.1|       ---------------------------------------------ENIIPVRVVLVNGEPWFVAKDIC
ref|ZP_02781438.1|     ------------------------------------------FDSVNVRVVYLNGDPWFVAKDVC
                                                                   ..  :*..  :.: *:*  **:* ref|YP_001038857.1|    DILELGDTHKAMERLDEDERNTIPVTDSLGRLQETYVVNEAGLYNLILGSRKQE-----A
ref|YP_146372.1|       EILDIADARKAVQRLDEDERSLIPVTDSLGRKQETFIVNEPGLYTLILGSRKSE-----A
ref|YP_001662865.1|    SVLDTGNSRDVMARLDSDEKG-VDIIDTPGGKQEVSIINESGLYSVILVSRKPE-----A
RAAC03224              EALQIANSRDAVSRLDEDEKNTVAITDGNRGNPNTTIINEAGLYQLTFTSRVDT-----A
ref|YP_006607.1|       DALXLVNSRKALSSLDDDEKNTVTLSDGNRGNPNMSIISESGLYTLILRCRDAVKQGTTA
ref|ZP_02781438.1|     VALEISNSRDALKALDADEKKTVALSYGIRGNPNHSLISESGFYKLIARSRKAVTPGTFA
                       *.: :::..:    ;  : :        : ::.*.*:* :   .*          * ref|YP_001038857.1|    KEFKRWITHEVIPQIRKTGIY---------------------------------------
ref|YP_146372.1|       KQFKRWVTHEVIPTIRKTGGY---------------------------------------
ref|YP_001662865.1|    KKFKRWVTHEVLPSIRRHGLYATDELLANPDFLIQ--ALQELKAERAKNAELTTTISIQE
RAAC03224              KRFRRWLAHEVLPSTRKTGEYKTPGRRQECDIAAKQVAVMEMKARTEQAKLLVDAVHRLE
ref|YP_006607.1|       WRFRKWVTNEVLPAIRKSGEY---------------------------------------
ref|ZP_02781438.1|     HRFSNWVFRNVIPGIRKTGAYGIP-WGALQDFSRRKEQYQLSASQKGRELQACKRKKREL
                        .*  .*: .:*:* **: * * ref|YP_001038857.1|    ------------------------------------------------------------
ref|YP_146372.1|       ------------------------------------------------------------
ref|YP_001662865.1|    QQIAEM------------------------------------------------------
RAAC03224              HRLSDLLIERILIASTNLMAGYDAIGIPTDGPSFTEPGRTRFPDLKPYWKPF
ref|YP_006607.1|       ------------------------------------------------------------
ref|ZP_02781438.1|     EEEEKRL-----------------------------------------------------
```

FIG. 150

```
ref|ZP_02378091.1|      ------------------------DYLPAYATTGSAGLDLRACLDAPLTLKPGETALVPT
ref|ZP_02454559.1|      ------------------------DYLPKYATTGSAGLDLRACLDAPVTLKPGDTALVPT
RAAC02915               MCVVVMGGWEMEVKVQIVSPLLTADDLPQYATQGSAGMDLRACLEAPRVVRPGEIVPVPT
ref|YP_001211829.1|     ------------------------AISLPRYATDGSAGLDLPACLDEPLAVPPGARVKVPT
ref|ZP_02091210.1|      ------------------------VPAYATPCAAAADLCAVLDAPLTVAPMQRVLVPT
ref|YP_518738.1|        ------------PSITIVESGAPSAPKLPQYATPGAAGVDLQASLDQELTIEPGQTVKTPT
                                                 :*  *** *:* ** * *:    .: *   . :**

ref|ZP_02378091.1|      GLAIHLADPGYAALILPRSGLGHKHGIVLGNLVGLIDSDYQGELMISTWNRGQTEFVLNP
ref|ZP_02454559.1|      GLAIHLADPGYTALILPRSGLGHKHGIVLGNLVGLIDSDYQGELMISTWNRGQTEFALNP
RAAC02915               GLAIQLPRRDAVALVYARSGLAAKHGIALANGVGVIDSDYTGEIVVPLHHFGSKEFVLQP
ref|YP_001211829.1|     GIAIEIPHRNIAGLVFPRSGLASKHGISLANAVGVIDSDYKGEIVIAVFNQSDQEYLIKP
ref|ZP_02091210.1|      GLAIELPGAHSVALVYARSGLSIKHGLCMANGVGVVDSDYRGELKVPMVNLGAEAYTIQP
ref|YP_518738.1|        CLAIELPHAGVGAFVFARSGLASKYGLALANGVGVIDSDYRGEILVAVINQGSEPFVVKD
                         :**.:.     .:: .****.  *:*: :.* **::**** **:  :.   :  : ::

ref|ZP_02378091.1|      FERLAQLVIVPVVQAQFNIVDDFAASDRGAGGFGSTGR-
ref|ZP_02454559.1|      FERLAQLVIVPVVQARFNLVDDFAQSERGAGGFGSTGR-
RAAC02915               KERIAQLVIAPIYVARLVAVDHLGPTARGAGGFGSTGRV
ref|YP_001211829.1|     GERVAQLVFVPVFTATLDVVENLNCSSRGEGGFGSTGRI
ref|ZP_02091210.1|      GERVAQLCIAPVYTAAFVPAEELGDTQRGVGGFGSTGK-
ref|YP_518738.1|        GDRIAQMVFLPVFIGEFYLADQLDETGRGCGGFGSTG--
                         :*:**:  : *:   .  : .:.:   : ** *******
```

FIG. 151

```
ref|YP_079090.1|        ------------------------GAPSMSDRQAALDMALKQIEKQFGKGSIMKLGEQTETRIST
ref|YP_001421272.1|     ---------------------------MSDRQAALDMALKQIEKQFGKGSIMKLGEKTDTRIST
emb|CAD56684.1|         ---------------------------MNDRQAALDMALKQIEKQFGKGSIMKLGEQTEKRIST
ref|NP_243249.1|        ---------------------------MSDRKAALDMALRQIEKQFGKGSIMKLGEQAEQRVST
ref|ZP_02850845.1|      ---------------------------MSDRRAALEMALRQIEKQFGKGSIMKLGESTHMQVET
RAAC02943               MFGSRRRRGSRAYALEEIEGWCVMGDKKAALEQALRKIEKEFGKGSIMRLGLAAAMTVET
                                                   *.*:*: ::*:***:*       :.* ref|YP_079090.1|        VPSGSLALDAALGVGGYPRGRIIEVYGPESSGKTTVALHAIAEVQQGGGQAAFIDAEHAL
ref|YP_001421272.1|     VPSGSLALDTALGIGGYPRGRIIEVYGPESSGKTTVALHAIAEVQEKGGQAAFIDAEHAL
emb|CAD56684.1|         IPSGSLALDIALGVGGYPRGRVVEVYGPESSGKTTVALHAIAEVQQQGGQAAFIDAEHAL
ref|NP_243249.1|        ISSGALALDIALGVGGYPRGRVIEVYGPESSGKTTVALHAIAEVQRNGGQAAFIDAEHAL
ref|ZP_02850845.1|      VPSGSIALDIALGIGGCLPRCRIIECYGPESSGKTTVALHAIAEVQRIGGQAAFIDAEHAL
RAAC02943               VPTGSIALDIALGVGGLPRGRIVEIYGPESSGKTTVALHVVAEVQKLGGQAAFIDAEHAL
                        :..:*::* *: **:* ***********.:. ********** ref|YP_079090.1|        DPVYAQKLGVNIDELLLSQPDTGEQALEIAEALVRSGAVDIVVIDSVAALVPKAEIEGDM
ref|YP_001421272.1|     DPVYAQKLGVNIEELLLSQPDTGFQALEIAEALVRSGAVDIVVVDSVAALVPKAEIEGDM
emb|CAD56684.1|         DPVYAQKLGVNIDELLLSQPDTGEQALEIAEALVRSGAVDIIVVDSVAALVPKAEIEGEM
ref|NP_243249.1|        DPVYAKKLGVNIDELLLSQPDTGEQALEIAEALVRSGATDVIVIDSVAALVPKAEIEGEM
ref|ZP_02850845.1|      DPLYASKLGVNIDELLLSQPDTGEQALEIAEALVRSGAVDIIVIDSVAALVPKAEIEGDM
RAAC02943               DPVYAQKLGVNIDELLISQPDTGEQALEIAEALVRSGAVDVVVIDSVAALVPKNELEGDM
                        :.***:*:*********:*******:*:*:*******  ::* ref|YP_079090.1|        GDSHVGLQARLMSQALRKLSGAINKSKTIAIFINQIREKVGVMFGNPETTPGGRALKFYS
ref|YP_001421272.1|     GDSHVGLQARLMSQALRKLSGAINKSKTIAIFINQIREKVGVMFGNPETTPGGRALKFYS
emb|CAD56684.1|         GDSHVGLQARLMSQALRKLSGAINKSKTIAIFTNQIREKVGVMFGNPETTPGGRALKFYS
ref|NP_243249.1|        GDSHVGLQARLMSQALRKLSGAINKSKTIAIFINQIREKVGVMFGNPETTPGGRALKFYS
ref|ZP_02850845.1|      GDSHVGLQARLMSQALRKLGGAISKSKTIAIFINQLREKVGVMFGNPETTPGGRALKFYS
RAAC02943               GDSHVGLQARLMSQALRKLAGAISKSKTIAIFINQIREKVGVMFGNPETTTGGRALKFYA
                        ******************.***.***.**********:****.********:*******:

ref|YP_079090.1|        SVRLEVRRAEQLKQGNDVMGNKTKIKVVKNKVAPPFRTAEVDIMYGEGISKEGEIIDLGT
ref|YP_001421272.1|     SVRLEVRRAEQLKQGNDVMGNKTRIKVVKNKVAPPFRTAEVDIMYGEGISKEGEIIDLGT
emb|CAD56684.1|         SVRLEVRRAEQLKQGNDIVGNKTRIKVVKNKVAPPFRAAEVDIMYGEGISKEGEILDIAS
ref|NP_243249.1|        SVRLEVRRAETLKQGNDMVGNKTKIKVVKNKVAPPFKQAEVDIMYGFGTSREGSILDIAS
ref|ZP_02850845.1|      SVRLEVRRIETIKQGNDMVGNRTRIKVVKNKVAPPFKQAEIDIMYGEGISREGSLVDIGV
RAAC02943               SVRLEVRRVEAIKQGNDVVGSRTRIKVVKNKVAPPFRQCDVDIMFGEGISREGSLIDIAT
                        ********  * :*****::*.:*:**********:  .::***:*****:**.::*:.

ref|YP_079090.1|        ELDIVQKSGAWYSYQEERLGQGRENAKQFLKENKDILLMIQEQIREHY-------------
ref|YP_001421272.1|     ELDIVQKSGWYSYEEERLGQGRENAKQFLKENKDIMMMIQEQIREYY-------------
emb|CAD56684.1|         ELDIVQKSGWYSYNDERLGQGRENAKQFLKENTDIRQEIAGQVREH--------------
ref|NP_243249.1|        ELDIVQKSGAWYSFNDERLGQGRENAKQFLKENPEAAEEIESRIREHYGLN---------
ref|ZP_02850845.1|      EMDIVQKSGAWFSYNGDRLGQGRENAKQFLKDHPEVAAVIEKQIRE--------------
RAAC02943               EIDVVQKSGAWYSFGEERLGQGRENAKQYLKEHPEIAEQIEAAVREYFHVNPAKPLVAAA
                        *:*:*****:*:*   :************::**::   :   *  :**

ref|YP_079090.1|        ---------------------
ref|YP_001421272.1|     ---------------------
emb|CAD56684.1|         ---------------------
ref|NP_243249.1|        ---------------------
ref|ZP_02850845.1|      ---------------------
RAAC02943               AEDADDDADDAFDEFDAF
```

FIG. 152

```
ref|NP_242725.1|        ------------------------MKAAFTSDIHGNAQALEAVLTDIESKQVDQIIVLGDICFR
ref|ZP_01696769.1|      ------------------------MKLAFISDIHGNAHALEAVLEDIEQKRADKIFVLGDLCFR
ref|YP_175539.1|        ------------------------MRFAFLSDIHGNATALEAVLNDLQTKQIDQTYILGDLCFR
RAAC02234               MIARMETRTMDVTTMGRGVSMRLAFFSDVHGNELALDAVIADLRQVGCDGVYVLGDLAFR
ref|ZP_02170975.1|      ------------------------MRLALLSDIHGNEAALRAVLEDLSRKNASHVAVLGDISYR
emb|CAJ73252.1|         ------------------------MKILIISDIHGNEAALKAVLEET----ADMIFCLGDIVNY
                                                *:  ::**:***  ** **: :   .    ***:

ref|NP_242725.1|        GIEPKRSLELVRSLQVPVVKGNADEWVVRGIRKGEVPDSVLEVMRIEREWTYGKLDESDI
ref|ZP_01696769.1|      GPEPQRAYEMVMALNTEVIKGNADEWVYRGVGMNEVPEKAYEMMNRERDWTVSRMEQNAV
ref|YP_175539.1|        GPEPKRVLELVQASGARVIKGNADEWLVRGFKDGEVPVERLEMFNKERDWTLGRLSQEDL
RAAC02234               GYAPKACVEKVAEVADKVIRGNADEWVVRGVRPGEVPDERRAGMDEEAAFARGLLAREEL
ref|ZP_02170975.1|      GPKPKECLDLIRELHGKVIKGNADEWLIRGIREGELPQQAFAIMQREQAWSYGKMTDEGL
emb|CAJ73252.1|         GPYPKECIEKIRKLTDKIVRGNHDNAIGKNMECG-CSEKYKALSDQGKIFTKTILDAGEK
                        *  *:   : :            :::**  *:  : :..   .  .       ::    :

ref|NP_242725.1|        DFLKQLPTVHTFSLSDTWNVLCFHATPTSLFDIVTPTAADHVVKEKLMAQNQANLYLYGH
ref|ZP_01696769.1|      ESLHQLPEEVKYEYGG-IKIHGFHATPYSLFENVPPDSENSKLKEKLMQED-ADIYLYAH
ref|YP_175539.1|        DYLKNLPTELVIDDGQDLVIHAFHASPSGLFTAIDGD-ETEKIENELMVRDEADIYIYGH
RAAC02234               EYLANLPLLLQ-EESPFGRWLAFHATPLDPFPVVAADAPDDDIESRIVAGQDARLYLYGH
ref|ZP_02170975.1|      HYLNQLPTELEIPLTNRIQLYATHAFPDDLFKVIPEHAENSAFDAFFEHNPRAMYYAYGH
emb|CAJ73252.1|         EFLANLPLTLNTEACGVTFLLSHGSPGGDIYKYLRPEVSDSEMEDELKGVR-ANIVLLGH
                         . * :**   .          :   .:  :           ..  :    *       .* ref|NP_242725.1|        IHLPYVRFIDGKIVANLGSVGLPFDGVCQASYLLVDGAEEQFSVTIQRVSYDIHSVCEQI
ref|ZP_01696769.1|      IHLPFIRTFDGKTFVNLGSVGLPFDGIAKASYAMVEIGDHDYQVSKVRVSYDVQKTIGLF
ref|YP_175539.1|        THHPYVRSLHGKNVINTGSVGMPFDGHPLASYIILDIEDGSHSVQLNRVPYNREHVVEIY
RAAC02234               IHVPYVRDIRGRTVVNLGSVGMPFDGVPQASYVILHVDEDVFRVEHRRVPYDVEAACRRY
ref|ZP_02170975.1|      IHIPHMRNITGNTLLNTGSIGLPFDGNPDASYVMLERTNDSISTSFHRVAYDIEKAVFDL
emb|CAJ73252.1|         THLPVVRKVGEITVVNPGSVGQPRDGIPLASYAIWKDG----ALEIKRVPYDIDATARGL
                         * * :*.  .  . * **:* * **     ***  : .        **.*:  . .

ref|NP_242725.1|        EASDYPNPTF--LQNVLKHGKP-
ref|ZP_01696769.1|      EASDYPNKDK--LIDILTRAK--
ref|YP_175539.1|        KQSGYPNTEA--MSAVI------
RAAC02234               DEIGYPAAEM--MKRVLRTARPV
ref|ZP_02170975.1|      KDTDYPEDAAPLLESIYRTGK--
emb|CAJ73252.1|         QHTTIPADHVARLEEILRKGR--
                          .  *        :   :
```

FIG. 153

```
emb|CAK51299.1|         ---------RVRFLDTRPLRSSQSFRDLWIGTSVSQVGGQIANMAVLAQVWDLTGSPVGT
emb|CAI78402.1|         ---------RVRFLDTRPLRSSQSFRDLWIGTSVSQVGGQIANVAVLAQVWDLTGSPVGT
ref|YP_001362100.1|     --------------VDTRPLRSSPAFRRLWIGTTAAAFGGQVAVVAVLYQVWNLTGSTVWT
RAAC01662               MPMTLQAVFRSAMLDTTPLRTSPAFLRLWIGSGISTLGGTMTPFAVMLQVYRATHSTLDV
ref|YP_832554.1|        ------------LADITPLRESPDFRRLWLGSAVSNLGSQLTLVAVSLEVYRLTQDSLYV
ref|YP_712120.1|        ------------LADLSPLREHPAYRRLWVGETISALGSQITATAVLLQVFAVTRSSFQV
                                      *  ***   : **:*    : .*. ::  **  :*:  * ... .

emb|CAK51299.1|         GAIGLATGLPMVLFCLLGCTLADTFDRRAVVRATTAGQLLAAAGLCAQALADNRN--VLL
emb|CAI78402.1|         GAIGLATGLPMVLFGLLGGTLADTFDRRAVVRATTAGQLLAAAGLCAQALADNRN--VLL
ref|YP_001362100.1|     GAIGIATAVPTIVGGIVGGTLADTLDRRRLVLVTTTVSVLAALSLALQAVAGAAT--VLL
RAAC01662               GLTGLASVLPGALFVLLGGSVGDRVDRRKLALLATSGQMLVSALLAVQALIAWSA--LWL
ref|YP_832554.1|        GLLSIFALVPLVLGGLGGSIADAHDRRKVALLATTMLWLTTAGLAAQAWLGLGN--VWL
ref|YP_712120.1|        GLVSLVALVPLVAGGLFGGATVDAVDRRRIAMITSGGLAVVSAAFLLLTLAGAVDDVAWP
                         *    .: : :*      :.**::  *  ***  :.  ::     :.:   :   :

emb|CAK51299.1|         LLALVAMGTSSGALGAPARRTFPVRLLPGDQVAAGLALTNVSFQAAMLAGPAMAGLIIAH
emb|CAI78402.1|         LLALVAMGTSSGALGAPARRTFPVRLLPGDQVAAGLALTNVSFQAAMLAGPAMAGLIIAR
ref|YP_001362100.1|     VLVLVAAQTSAAAVGAAARRTFISRLLPSDLVRAGVALNHIGFQIAMLTGPAVAGVVLAA
RAAC01662               IYALLCAQSVLGAINAPARRTFVPRLLPKEQVRAGQTLNTLAIRFGEVAGPSLAGVIASF
ref|YP_832554.1|        LYVLVAVQSGAQAINQPARSAIIPALVRKELLPAANALSMITFGLGMTAGPLLAGVLVAW
ref|YP_712120.1|        LMCLVAVQSALLAADQPARRAMTPNLIPLEHLPAASALAQIGCTAAGVFGPLIAGVSVAA
                         :  *:.   :      *  ..**  :: .  *: : :  *. :*    .   **  :**:  :

emb|CAK51299.1|         WDLSAAYATQAVAMVLSMLTVLRLFAMRPEGADAAGGRRRPERG----------GWRIVL
emb|CAI78402.1|         WDLSAAYATQAVAMVVSMLTVIRLFAMRPEGADAAGGRRRPERG----------GWRIVL
ref|YP_001362100.1|     GGLRAAYLTDAVGLTVSLYGVLRLPAIRPQ-SLADTGTARAARGGLPAVRATWEGWRYLL
RAAC01662               AGLGWCYACDAATFLAALYAIYRLFPMLPEANAKQRSMLLDSVME----------GLRFLG
ref|YP_832554.1|        VGFGWTYTLDVASFAFAFWALLRLPPMPPGKTTHRAGLRSVVEG----------FRFLG
ref|YP_712120.1|        GGFSIAYAIDLVTFAAPLYGLARLFAMPPRGGGRGAGVASVAEG----------LRFLR
                         .:    *   :  :    .:  :***.: *    .             *   :

emb|CAK51299.1|         RRPTLWGSMATDLSATLLAMPVALFPLVNEIRFGGNPQTLGLFLSAVAVGGITAGLLSGT
emb|CAI78402.1|         RRPTLWGSMATDLSATLLAMPVALFPLVNEIRFCGNPQTLGLFLSAVAVGGITAGLLSGT
ref|YP_001362100.1|     RRPVLRGCLATDLAATVLAMPIALFPAINAQRFDGEEATLGLFLSAIAVGGLLAGFTSGT
RAAC01662               RSRALLGAMLADLSVTVLGVPTALLPALVSERFGGRPETLGLMMGATGIGGLVILALSGP
ref|YP_832554.1|        TRPNLRMTFVIDLVAMIFAQPRALMPAIGAVMIGGGEATVGVLLASTAVGAFLAGLFSGP
ref|YP_712120.1|        GQPVLLMTFVVDIIAMVFGMPRALFPALAEGRFGGGSATAGAMYSAVAVGSLLAAGLSGP
                         *    : *:. ::.  * **:*  :   :.*     * *  : .: :*.:      **.

emb|CAK51299.1|         VTRWHRGGLVQMSAAGVWGLALACFGLAGPLW------------LALGCL-AVAGAADTV
emb|CAI78402.1|         VTRWHRGGLVQMSAAGVWGLALACFGLAGPLW------------LALGCL-AVAGAADTV
ref|YP_001362100.1|     LTRARRTGRVMLIAAATWGTSLTTFALVDSLP------------ATLACL-AVAGAADTV
RAAC01662               VRHIRSEGKAILVACAAWAIAAGGLGLAPFVW------------LCVALL-GLMGAADSI
ref|YP_832554.1|        LGGIRRQGSAVVWSVMGWGASIAGFGLVVVLAGRSGADGVTWWLLPAALCCALAGIADSV
ref|YP_712120.1|        LGGVRRQGLAVVVSIVLWGGAIAGFGLAHDIA------------LGLALL-ALAGAADMV
                          :    :   *  . : :   *.:     :.*.    :                 .:  * ** :

emb|CAK51299.1|         SVVTRSALVQLETPDAYRGRVSSVEHVIGVAGPELCNFRCGLLASATSASFSLVFGGLSA
emb|CAI78402.1|         SVVTRSALVQLETPDAYRGRVSSVEHVIGVAGPELGNFRGGLSASATSASFSLVFGGLSA
ref|YP_001362100.1|     AVISRGTIVQLSTPDAFLGRVSAAEGTVGVAGPGLGNARAGAVAGVTSTAVSSLTGGLAC
RAAC01662               LVVMRSTLIQQGTPDGLRGRISSVDYLVGTGGPQLGNLRAGLVGSLLPPGASIAVGGLST
ref|YP_832554.1|        SAVFRTTILQAATPDHLRGRLQGVFVVVVAGGPRIGDMLAGGGTKLLSEGWVLLLGGLL-
ref|YP_712120.1|        SAILRNAILNVATPDEMRGRLQGVFLVVVTGGPRLGDLEAGSVAAVTSPAFSVVSGGLAG
                         .:  *   :::: *     :...    :   ..   :   . .     *** emb|CAK51299.1|         ILAIAAV----------------------
emb|CAI78402.1|         ILATAAV----------------------
ref|YP_001362100.1|     VLAVAVIAATTPALRR-------------
RAAC01662               LAAILCVGWFVPELRRAQAEEGVGASD
ref|YP_832554.1|        --CIAVAWTV-------------------
ref|YP_712120.1|        IGCLLLATAAVPALIRYDARAAV------
                              .:
```

FIG. 154

```
ref|ZP_02620185.1|    -----------MALYAISDLHLSLN------------CDKPMDVFGDHWMNHDNRIKENW
ref|YP_877450.1|      -----------MALYAISDLHLSLN------------CDKPMDVFGDHWMNHDNRIKENW
ref|YP_001512273.1|   ------------MATFATGDLHLSGY------------SNKPMDIFGEHWTEHDKKIMESW
ref|ZP_01188667.1|    -------------IYATGDLHLSFENKVTPGDWEKVSQYKPMSLFGDKWVEHYRKIYKNW
RAAC02171             MISWNGQGGTTVAIYAIADLHLDTS            QSKPMDVFGHFWRDHAEKTAHHW
ref|YP_001275096.1|   --------------VWSISDLHLSFA----------RPKPMDIFGSRWKDHPERIAAAW
                                  :::*.**.              *.:** .* :*  .:*    * ref|ZP_02620185.1|    INKITNEDTVLIAGDISWSMKMEDGMADLEWIHKLPGRKIISKGNHDYWWGS--ISKLNS
ref|YP_877450.1|      INKITNEDTVLIAGDISWSMKMEDGMADLEWIHKLPGRKIISKGNHDYWWGS--ISKLNS
ref|YP_001512273.1|   QKNVKDEDAVLIPGDISWAMTLEDAKIDLNWIADLPGQKYLIRGNHDYWWGS--LTKLNS
ref|ZP_01188667.1|    KAEVTCKDLVLVPGDISWAMKLEEAVYDLEFIGSMPGKKIFIRGNHDYWWSG--ISKVRS
RAAC02171             QDQIHDDDIVLIPGDISWAMKLEEAAPDLVWIGRLPGRKVLIRGNHDFWWGG--IQRVRK
ref|YP_001275096.1|   RARVKPDDVVLLAGDTSWAMKLQDALVDLQWIAALPGRKIISRGNHDYWWSSSERTNRVRR
                        .:  .* **:.** **:*.::::  ** :* :**:* : :****:**..    ::.

ref|ZP_02620185.1|    LY-DDMLFIQNNFFIYEDYAICGTRGWTPP-ADKYS-EHDDKIYKREQIRLKISLDAAK-
ref|YP_877450.1|      LY-DDIRFIQNNFFVYEDYAICGTRGWNPP-TDKYS-EHDDKIYKREQIRLRISLDAAK-
ref|YP_001512273.1|   LF-DSMHFIQNNFFTYKQYAICGTRGWNCPNHYKFT-EHDGKIFTREVNRLELSLKAAK-
ref|ZP_01188667.1|    ILPDGCFALQNDCLEFEGVSITGTRGWICPNEDNFT-EHDEKVYKREVNRLKLSLESIK-
RAAC02171             ALPPRMYALQNDCLVLDNVCFAGTRGWTLPHHPSYNAEQDEPILKREILRLELSLKAAV-
ref|YP_001275096.1|   SLPPGIDILEASAIDIGEAVVCATRGWNTPETPGFQESTDRPYYERELMRLDTALAAAQH
                      :: . :    . .****  *  : .*   ** **  :*  :

ref|ZP_02620185.1|    -KAGYEKIIVMIHYPPVNDKFQKNELTEIFNEYNVEKVIYGHLHGP-SLKTIFEGKHEGV
ref|YP_877450.1|      -KAGFEKTIVMVHYPPVNDKFEKTELTETFNEYNVEKVTYGHLHGP-SLKNIFEGEHEGV
ref|YP_001512273.1|   -EKGYEDIIVMLHYPPTNDKLEPSIFTEMLEKYKVKQVVYGHLHGETSYDAGLKGEYNGV
ref|ZP_01188667.1|    -NTD-KKKIVMMHYMPVNENHEHNCFIKVMIDYNVDICIYGHLHGEDSHKTRIPEEKWGT
RAAC02171             -KEG-KPILCLMHYPPVDSNHPHSEFHELLAAYGVRACVYGHLHGP AHRFAFNGEIDSV
ref|YP_001275096.1|   LASGKRPIIVMIHFPPFAGRRP-TETARRIAAAKAAACVYGHLHRPEDWAVATQGLVDGV
                         . .  : ::*: *    .  .:: :   .   :*****     .:

ref|ZP_02620185.1|    EYIMTSCDYIDFDPIKI-------
ref|YP_877450.1|      EYIMTSCDYIDFDPIKI-------
ref|YP_001512273.1|   YYNLVSCDYACF------------
ref|ZP_01188667.1|    RFYLVSSDFLNFKPLRI-------
RAAC02171             RYQLVSCDYLQFIPWKIPEEWLQP
ref|YP_001275096.1|   YYQLTSCDYLGFGP----------
                         : :.*.*:  *
```

FIG. 155

```
sp|P80579|THIO_ALIAC    ------------------------------------------------------------
RAAC01696               ------------------------------------------------------------
pdb|1NW2|A              EFTHIREDXINFRMALICYCLBACILLUSACIDCALDARIUSPDBNWFCHAINFTHECRY
pdb|1NSW|A              ------------------------------------------------------------
pdb|1RQM|A              ------------------------------------------------------------
ref|YP_703612.1|        ------------------------------------------------------------ sp|P80579|THIO_ALIAC    ------------------------------------------------------------
RAAC01696               ------------------------------------------------------------
pdb|1NW2|A              STALSTRUCTUREFTHEMUTANTREFTHIREDXINFRMALICYCLBACILLUSACIDCAL
pdb|1NSW|A              ------------------------------------------------------------
pdb|1RQM|A              ------------------------------------------------------------
ref|YP_703612.1|        ------------------------------------------------------------ sp|P80579|THIO_ALIAC    ------------------------------------------------------------
RAAC01696               ------------------------------------------------------------
pdb|1NW2|A              DARIUSPDBNWGCHAINGTHECRYSTALSTRUCTUREFTHEMUTANTREFTHIREDXINF
pdb|1NSW|A              ------------------------------------------------------------
pdb|1RQM|A              ------------------------------------------------------------
ref|YP_703612.1|        ------------------------------------------------------------ sp|P80579|THIO_ALIAC    ------------------------------------------------------------
RAAC01696               ------------------------------------------------------------
pdb|1NW2|A              RMALICYCLBACILLUSACIDCALDARIUSPDBNWHCHAINHTHECRYSTALSTRUCTUR
pdb|1NSW|A              ------------------------------------------------------------
pdb|1RQM|A              ------------------------------------------------------------
ref|YP_703612.1|        ------------------------------------------------------------ sp|P80579|THIO_ALIAC    ------------------------------------------------------------
RAAC01696               ------------------------------------------------------------
pdb|1NW2|A              EFTHEMUTANTREFTHIREDXINFRMALICYCLBACILLUSACIDCALDARIUSSCRES1
pdb|1NSW|A              ------------------------------------------------------------
pdb|1RQM|A              ------------------------------------------------------------
ref|YP_703612.1|        ------------------------------------------------------------ sp|P80579|THIO_ALIAC    ---------------------------------ATMTLTDANFQQ-AIQGDKPVLVDFW
RAAC01696               --------------------MQVSTLG-GIPMATMTLTDANFQQ-AIQGDKPVLVDFW
pdb|1NW2|A              GNIFICANCEE-IDENTITIESPSITIVESGAPSATMTLTDANFQQ-AIQGDKPVLVDFW
pdb|1NSW|A              -------------------------PSITIVESGAPSATMTLTDANFQQ-AIQGDKPVLVDFW
pdb|1RQM|A              ------------------------------ATMTLTDANFQQ-AIQGDGPVLVDFW
ref|YP_703612.1|        ------------------------------TVTITDDSFQQDVISSDKPVLVDFW
                                                         *:*:  *   *:  * ******* sp|P80579|THIO_ALIAC    AAWCGPCRMMAPVLEEFAEAHADKVTVAKLNVDENPETTSQFGIMSIPTLILFKGGRPVK
RAAC01696               AAWCGPCRMMAPVLEEFAEAHADKVTVAKLNVDENPETTSQFGIMSIPTLILFKGGRPVK
pdb|1NW2|A              AAWCGPCRMMAPVLEEFAEAHADKVTVAKLNVDENPETTSQFGIMSIPTLILFKGGRPVK
pdb|1NSW|A              AAWCGPCRMMAPVLEEFAEAHADKVTVAKLNVDRNPETTSQFGIMSIPTLILFKGGRPVK
pdb|1RQM|A              AAWCGPCRMMAPVLEEFAEAHADKVTVAKLNVDENPETTSQFGTMSIPTLILFKGGEPVK
ref|YP_703612.1|        ATWCGPCKMIAPVLEEIAGEHSEKLTIAKLDIDANPGAARDFQVMSIPTLILFKDGKPIN
                        *:*****:*:******:*   *:*:*:***::  ** ::  :*:********.*.*::

sp|P80579|THIO_ALIAC    QLIGYQPKEQLEAQLADVLQ
RAAC01696               QLIGYQPKEQLEAQLADVLQ
pdb|1NW2|A              QLIGYQPKEQLEAQLADVLQ
pdb|1NSW|A              QLIGYQPKEQLEAQLADVLQ
pdb|1RQM|A              QLIGYQPKEQLEAQLADVLQ
ref|YP_703612.1|        TIVGFKGKAALLKELADVL-
                        ::*  :  *  * :*****
```

FIG. 156

```
ref|ZP_02850022.1|    MNKLTTD---AAFREAVQGDGITVVVFKTTWCADCHYIDPFMPDVEQQYNGKFSFEEIDRD
RAAC01724             MEEIRTS--ERYREAVQ-SGRVVVEFYATWCPDCRRIEPYLGEWEEKYREQFTMVRVNRD
ref|NP_244119.1|      MEQIKTL---EQFQQVKN-QENVVFLFSADWCPDCRVIEPFLPELEQTY-DEYQFYYVNRD
ref|YP_001422284.1|   MKKIEST--EELQKAVQ-DDWAVFMFSADWCPDCRFVEPFLPELEADF-PEFTYYYVDRD
ref|YP_815236.1|      MEEIKELTPEKLKEITA-NGKVVLLFLATWCPDCRFLDPFLPQIEKDN-SDAKFYKIDRD
ref|NP_965472.1|      MEETKELTPEKLKETTK-NGKVVLLFSATWCPDCRFLDPFLPQIEKDN-PDAKFYKIDRD
                      *::            ::    .*. * : **.**: ::*:: : *    .   ::**

ref|ZP_02850022.1|    ELPDLCSELNILGIPSFIAFRNGKELIRYVNKLRKTREEIEQFLDRA--
RAAC01724             EVPDLAEELQILGIPTFLVYDQGREVKRLFSRDAKSKEQVEQFLDQAYA
ref|NP_244119.1|      DFIELCQELDIFGIPSFLFYSNGEERSRFVSKDRKTKEEIERFLTEA--
ref|YP_001422284.1|   QFIDTCAEWEIYGIPSFVVFNGGKEVNRFVSKDRKTKEEIEQFLTDSLA
ref|YP_815236.1|      GSIDVAKELNIFGIPSFVVYQDGKEIGRLVNKDRKTKEEVENFLN----
ref|NP_965472.1|      GSIDVAKELNIFGIPSFVVYQDGKEIGRLVNKDRKTKEEVENFLN----
                      :  .  *  :*  ***:*:  :   *.*   * ..:  *::*::*.**
```

FIG. 157

```
ref|YP_001212789.1|  -MRAAIYLRVSTEDQAKHGYSLPDQRTACREKAAALGAG--EVMEFADEGISGELLDRPG
ref|YP_001211675.1|  -MRAAVYVRVSTEDQARHGYSLCEQKEACRCRAVDLGAK--TVLEFADEGVSGATLDRPG
ref|ZP_01666637.1|   ----AIYARVSTDEQARTGYSLCDQVNQCRKKLLSLGLS--NIKEYIDDGYSGEFLDRPA
ref|ZP_02326197.1|   -MHAAIYVRVSTGLQAVEGTSLETQLDYCLRKAFELGISQNDTHIYREEGASCEDLDRPA
RAAC01817            MMWTAIYTRVSTEHQAQAGHGLDVCREACVQYALSLGVAPHDIRLYEEAGGSGEDMDRPE
ref|ZP_01126596.1|   MKTAATYARVSSDQQKGAN-TIASQTAALIEFAREQGFTVPDEWIIEDEGFSGASLLRPG
                         *:* ***:     *     .    :    *                : *  **  : **

ref|YP_001212789.1|  LSALREAVKACQLDLVVCFDPDRLARKLAEQLIITDEIEKAGVRLEFVNF-EWQNTPDGR
ref|YP_001211675.1|  LQGLRELIRSGQIDLVVVRDPDRLSRKLSEQLILTEEIEKAGVRLEFLDF-DWKDTPDCR
ref|ZP_01666637.1|   LSRLRDDLRAGLIKTVMVYDPDRLSRNLTNQLIIADEIEKYGAKLEFITG-SYDASPEGR
ref|ZP_02326197.1|   LNRLRQDVASGTFSVLILTHPDRLTRDLTDKLFICRELESRNIRLVFVDT-EYKNTPEGQ
RAAC01817            LLRLLDDVRRGLVDRVVVKHPDRLSRNVADKAIVVRELSACGVKLHFVDVPNWDESDEAV
ref|ZP_01126596.1|   LERLRDLAAEGQIQAVLIISPDRLSRKYAYQVLLTEEFARHGVEAIFIKA-PHSATPEDQ
                      * *  :      *  ..  ::    ****:*. : : ::  *:     . . *:     . ::

ref|YP_001212789.1|  LFYALRGAIAEYEKEKIRERTVRGKLQKARLGGLPVQADSYGYIYD--------NGTVKP
ref|YP_001211675.1|  LFYAIRGAJAEFEKEKIRERMARGKTQKAKQGSMPIGFYNYGVVYEPE------TGKVRL
ref|ZP_01666637.1|   LFFSIRGAIAEFEKEKIRERSLRGKRAKVLSGKPLFGRDPYGYTCDRD------TGQYVT
ref|ZP_02326197.1|   LFFNLMSVIAQYELSLIKKRTVRGRLKAVEKENKIMPMRTAPYGYDII------GSKLVI
RAAC01817            LLFHVTSSIAEYELRCIRRRTLAGKLKAVR-GGKVMPSGVDPYGYRYE-------DGRYVV
ref|ZP_01126596.1    LMLQFQGMIAEYERAQILERSRRGKRHRAKSGFTSVLGG-APYGYRYIRKMPFTPARYEI
                     *:    .. **::*   * .*  *:  .            .     *           .

ref|YP_001212789.1|  HPVESEVVKMIFRWFTTEDIGVNGVAARLSEQGIPTRKGRP-AWQRCVVKTILTNPMYVG
ref|YP_001211675.1|  HETEAKVVEEIFKWFVQEDIGINGVAKRLNEAEVPSRKGK--RWHKCVVRQVLVNPVYKG
ref|ZP_01666637.1|   NEEEAKIVRLIFKLYTENRYSVAKLHAQLKAMGVVNRSGK--PFSLSVLDHILANEMYAG
ref|ZP_02326197.1|   NEEEARFVRYIYEWYVHQRWTIRQIGEKLVELGAIPKRKESRSWSASSIQRILTSEIYTG
RAAC01817            VPEEAEIVRLIYQWYGIDGMSLRAIAEREDAMGVPTKTRQSARWHHSTVARILDNPLYRG
ref|ZP_01126596.1|   DAAEAAVVRLVFEKYTVDGLSIGAIARLLREMGPPTRRRVT-RWERSVVWGMLRNPAYKG
                       * .*. ::.  :    :    :     *     :       :  : :*.   * * ref|YP_001212789.1|  TPYYNRRDCRGTCYNK-------HLPPEKRVKVKEKPGEEWIAVPVPAIIDRETWEKAQE
ref|YP_001211675.1|  TWQYKD--------------------------------TCTPVPAIIDEAVWLKAQE
ref|ZP_01666637.1|   TKWYFQKYQKTVG-----------QKKRKVLKRNVNEWVSIDVPAIIDKETFQKAAE
ref|ZP_02326197.1|   RYYYNRRKTGKVKGQK--------TPSGSNRKLLEWRKEEDWIRVEVPAIIDTGIYEQAMQ
RAAC01817            TWYYNRRTRKRQGVRG------ARRGRGRQVVAVRDPGEWIAVSVPPVVDPDLARSVAL
ref|ZP_01126596.1|   TACFNKTQVGPROKVTKPFRLSGRSVHGEKTSAHERPREEW1EVPVPALVSEEFFALAAE
                                                                    : : **.::.    .

ref|YP_001212789.1|  KIKAARRLWSGWSREEYLLSGLISCADCGNTMHGAVKTKSGG------------------
ref|YP_001211675.1|  KIRGARRLWAGQRKHDYLLSGIVTCGECGQTMTG-VYSKWWN------------------
ref|ZP_01666637.1|   VRRQNKVTAKRNTKFFYLLSGIIKCPKCGYAMRG---TRFPK------------------
ref|ZP_02326197.1|   Q-RQRNRKKSGHVKESYLLRGLIRCGECGRSWQATSYS---------------------
RAAC01817            R-KQGS-PRCCSTSAHTFLSGKLVCAECQRAWRHEACRTAGGIVRKFRRPPAERGADPCA
ref|ZP_01126596.1|   RLADNKRFAPRRTIEPSLVQGLVSCRKCGYALYRASTRTSAR-------------------
                         ::  *  :  *  .*  :

ref|YP_001212789.1|  ------------------------------------------------------------
ref|YP_001211675.1|  ------------------------------------------------------------
ref|ZP_01666637.1|   ------------------------------------------------------------
ref|ZP_02326197.1|   ------------------------------GRADP------------------------
RAAC01817            YRCARVPADEIERAVWRELVRRMRALGIGRELAAGGRASPGDPLMEDVARLRREMRAAVE
ref|ZP_01126596.1|   ------------------------------------------------------------ ref|YP_001212789.1|  ------------SRERGYTCVKTAAGAS---------- ---------------NQGC
ref|YP_001211675.1|  ------------KKDRRYPCFKGYQGAR-----------------------------HRGC
ref|ZP_01666637.1|   ------------RNNKDYAYYVCSAYVN-----------------------------AYEC
ref|ZP_02326197.1|   ----------MSGAKKKYLCYRCPNKTFATFG------------------------TTRLI
RAAC01817            RRDRARELYLRGHLDRTAALRAMSEEARRLREGRAEACRLCHARQRRLNAWEDLWTALET
ref|ZP_01126596.1|   ------------KIHYYRCLGSDGWRHLG-------------------------------GSV ref|YP_001212789.1|  RPIKRVPAEIVEKAVW--------------------------------
ref|YP_001211675.1|  LPSKYVLAGYVESAVWEQVKDWLQDPGALASEAYASSPRVED-------
ref|ZP_01666637.1|   DNRRCVPSQELDEAVWQEIVNMFKKSG---------------------
ref|ZP_02326197.1|   CTAPSLKAFWLDQNVWKSVL----------------------------
RAAC01817            HDGVELRRLWLEAAVSRVEMDASGGEVVLTLFARIGEQTGARVDDTLAT
ref|ZP_01126596.1|   CDSRPIRQDLLDHIVWQEVMRLIADPGL---------------------
                          :    ::   *
```

FIG. 158

```
ref|YP_001514193.1|  ----------------------------------------------------------
ref|YP_001317996.1|  ----------------------------------------------------------
ref|YP_001090064.1|  ----------------------------------------------------------
ref|ZP_01995293.1|   ----------------------------------------------------------
ref|YP_517020.1|     ----------------------------------------------------------
RAAC01840            MTHGGGVLRFARLSRVSSSSRGGRSHDQALSDRVGGGDQIVAGGRGDRRRSRLRGGHPPH ref|YP_001514193.1|  ----------------------------------------------------------
ref|YP_001317996.1|  ----------------------------------------------------------
ref|YP_001090064.1|  ----------------------------------------------------------
ref|ZP_01995293.1|   ----------------------------------------------------------
ref|YP_517020.1|     ----------------------------------------------------------
RAAC01840            TLRRVSSSSRSGRRGRPARAGSGGRSPGELPRLHGSLDCRSAGRHHELCPSAAAQRRLHR ref|YP_001514193.1|  ----------------------------------------------------------
ref|YP_001317996.1|  ----------------------------------------------------------
ref|YP_001090064.1|  --------------------ATEPHSPHRIBSYLTRANSFERASECLSTRIDIUMDIFF
ref|ZP_01995293.1|   ----------------------------------------------------------
ref|YP_517020.1|     ----------------------------------------------------------
RAAC01840            VRERRRGELRRRPGSLSGRVVLRAPRARRVCRGRSRRPRVARRAVRGLAGQAHARVRGVR ref|YP_001514193.1|  ----------------------------------------------------------
ref|YP_001317996.1|  ----------------------------------------------------------
ref|YP_001090064.1|  ICILEQCD-BEMBCAPUTATIVENICTINATEPHSPHRIBSYLT----------------
ref|ZP_01995293.1|   ----------------------------------------------------------
ref|YP_517020.1|     ----------------------------------------------------------
RAAC01840            IAARGHGHGAPRPAPRSKARDAKSYGRDRRGEEPANARRGRAAPGLRGRRAHRRLLGIRS ref|YP_001514193.1|  ----------------------------------------------------------
ref|YP_001317996.1|  ----------------------------------------------------------
ref|YP_001090064.1|  ---------------RANSFERASECLSTRIDIUMDIFFICILESCRESIGNIFICANC
ref|ZP_01995293.1|   ----------------------------------------------------------
ref|YP_517020.1|     ----------------------------------------------------------
RAAC01840            QRLGHRRGGAFGPGSRRRHPVDARRTLFAPRAGRVRGIRWRDAPGARGASCSRMSKAISR ref|YP_001514193.1|  -----------------------------KNLTLLTDLYQLTMMNGYLKNGADENVVFD
ref|YP_001317996.1|  -----------------------------RNHTLLTDLYQLTMMNGYFENNSHEDTVIFD
ref|YP_001090064.1|  EE-IDENTITIESPSITIVES----GAPSRNLTLLTDLYQLTMLNGYFEKNIHEDIVVFD
ref|ZP_01995293.1|   -----------------------------RNLTLLTDLYELTMMQGYYEKGQNEN-VIFD
ref|YP_517020.1|     ------------------------------VALLTDLYQLTMMQGYYQNGYENKEAVFD
RAAC01840            AKDGDEGMDIKERARARVEEIGALPVYRDRHLTLLTDLYQLTMMYGHFRAGRHETRVVFD
                                                  :******:***: *: .  .:  ..:**

ref|YP_001514193.1|  LFFRTNPCNNSYTMIAGIEQVIDYIENLKFDEESLVYLKGLNLFDDEFIDYLRNFKFTGT
ref|YP_001317996.1|  LFFRKNPCNNSFTIIAGIEQVIDYIENLGFTEEDIQYLRSLNLFGEAFLDMLKQFTFTGT
ref|YP_001090064.1|  MFFRKNACDGGYTIVCGIDQVVEYIDNLHFSDEDLEYKLNLNLFSDKFLKFLKEFKFTGD
ref|ZP_01995293.1|   VFFRQNPCNNGYSVCAGLDQVIDYIKNLHFTYDDVDYLRGLGIFKEDFLHYLSGFHFSGD
ref|YP_517020.1|     LYFRKIPSGGGYVIAAGLEQVVEYIENLRFSSEDMAYLRGLNIFDEGFLNLLKDFRFHGD
RAAC01840            LFYRKNPCGNGYVIAAGLEQVVWYIYNLAFSEDDLAYLRSLGMFSEDFLSYLRHFRFRGD
                     ::*   .....: :  .*:::  ** *  :.: **:.*:*  *: *  *  * * ref|YP_001514193.1|  IYGVDEGTVMFPYEPILRVKAPVIQAQLIETTLLNIVNFQSLIATKAARICSAAD-----
ref|YP_001317996.1|  IYGVQEGSIMFPHEPILRVKASVLQAQLIETALLNMINFQSLIATKASRIVEAAK-----
ref|YP_001090064.1|  IYAVEEGTIMFPNEPLITVKAPLYQAQLIETALLTIVNFQSLIATKASRVCFAAQ-----
ref|ZP_01995293.1|   IYAIPEGTVVFPKEPLLKVVAPIMEAQLVETAILNIINHQSLIATKTSRIVFAAN-----
ref|YP_517020.1|     IDAVPEGTVVFPYEPLVRVKGRILEAQLIETALLNIINFETLIATKASRVVAAAG-----
RAAC01840            VYAVPEGTVVFPNEPILRVEGPIAEVQLIESAVLAFINHQSLIATKARRIVEAARTNVRH
                     :  .: **::**::** **:: * . : :.**:*:::* ::*.::*****: *:    **
``` continued →

FIG. 158 continued

```
ref|YP_001514193.1|    -GDPVFEFGLRRAQGPDAGVYGARAAVIGGCVGTSNVLAGKRFDIPVVGTHAHSWIQSFD
ref|YP_001317996.1|    -GDPVFEFGLRRAQGPDAGIYGARAAVIGGCVATSNILAGKLFDLPVVGTHAHSWIQKFD
ref|YP_001090064.1|    -GDPVFEFGLRRAQGPDAGIYGARAAVVGGCAGTANVLAGKMFDIPIIGTQAHSWVQKFD
ref|ZP_01995293.1|     -GDGIMEFGLRRAQGPDAGLYGARAAMIGGCVGTSNVLAGQMFDVPVMGTHAHSWIMSFP
ref|YP_517020.1|       -GGSVMEFGLRRAQGPDAGILGSRAAFIGGCQFTSNVLAGKRYGIPLSGTQAHSWIQCFP
RAAC01840              PGSTVIEMGLRRSQNADAAVFGARAAFIGGCVATSNVLAAQSYNIPVAGTQAHSWIQSFP
                         .  ::*:****:*..**.: *:*.:*  *:*:**.:  :.:*: :**:  * ref|YP_001514193.1|    SELEAFRAYARSYPNSTTLLVDTYNVLHSGVPNAITVFNELKEQGYEPK--GIRIDSGDI
ref|YP_001317996.1|    SELEAFRAYAKAYPDKCLLLVDTYDTLKSGIPNALTVFNELREKGYEPK--GIRIDSGDL
ref|YP_001090064.1|    NELEAFQAYADVYPDKCLLLVDTYDVLNSGVPNAIKVFKNISEKGYKPM--GIRLDSGDL
ref|ZP_01995293.1|     DEYTAFKTYAEMYPDNCTLLVDTYDTLKSGVPNAIRVFQEFKDAGKPLIKYGIRLDSGDL
ref|YP_517020.1|       DELEAFRAYARTFPDQCLLLVDTYNVLKSGVPNAIKVGLELEAEGHRFL--GIRIDSGDL
RAAC01840              SEYEAFQAYRAAFPDNTVLLVDTYDVLRSGVPNAIRVGLEMKAAGQSLK--AIRIDSGDL
                        .*  **::*    :*:.  ******:.*.**:***: *  ::    *    .**:****:

ref|YP_001514193.1|    AYLSKEARKMLDAAGLPNVKITASSDLDEDVINNLKLQGAAIDFWGVGTNLITSKSCPAL
ref|YP_001317996.1|    AYISKQARRMLDDAGYEKVGIVASSDLDEDTIDSLKLQGASINSWGVGTNLITSKDCPAL
ref|YP_001090064.1|    AYLSKEAKKQLDNAGFSDISITASNDLDEYTITSLKAEGATINSWGVGTKLITSFDSPSL
ref|ZP_01995293.1|     AYLSKEARKMLDEAGFPEATICASNDLDEFLLHDLKMQGAAIDSWGVGTNLITSKDCPSF
ref|YP_517020.1|       TYLSREARKMLDQAGLEHARIVASNDLDEHTISAIRAQGAAIDSWGVGTHLITSKDTPAL
RAAC01840              AYLSKRARQMLNDAGLADVQIIASSDLDEYTIRDLLTQGAEIDAWGVGTRLITSEDCPSL
                        :*:*:.*:: *:  **  .    * **.****    :   :;** *: *****.****  . *::

ref|YP_001514193.1|    GGVYKLSAIE-VDGQIIPKIKISENPEKITNPGYKKVVRIYDKENKKAQADLIMLDSEEI
ref|YP_001317996.1|    GGVYKLSAVE-KSGTLIPKMKLSDNPGKITNPGYKKVIRIYEAENNRAQADLILLEEEEI
ref|YP_001090064.1|    GGVYKLAASC-EKGVLEPKIKISENPEKINNPGYKKVIRIYN-EDNKAEADLIMLHDEVI
ref|ZP_01995293.1|     GGVYKLAAIQNEEGEFVPKIKISENTEKITNPGNKTIYRIYEKASGKIKADLICFADEVI
ref|YP_517020.1|       GGVYKLSAEG-QKGVFEPRLKVSENISKITNPGIKKIVRFYD-RRGKAMADLIALEDEHF
RAAC01840              GCVYKLVAQQ-FGDRMEPRIKISENPNKITNPGKKKVLRLYV--NGSATADLIALDEEVY
                       * ****  *            :  :::*:*:*    .*  *.:  *:*          ****  :  .* ref|YP_001514193.1|    NTNEPLTIFHPIYTWKKKTFRN--YETKDLLVPIYEQGKLVYERKTIKEIRKHAQSELDS
ref|YP_001317996.1|    DTTKPLTIFHPLYTWKKKTFSN--YKVREMLMPIYEDGKLVYPRKTVNEIRAYVRQELST
ref|YP_001090064.1|    DESKPLEIFHPTYTWKTKVFTN--YKVKELLKPLYIKGRCKYNKKAVLEIKNHVQYELST
ref|ZP_01995293.1|     DPKQDLLLFDPMDTWKKTKLAGGTYNVREILLPIFKNGECLYKSPTLKEIAAYCREEKDT
ref|YP_517020.1|       E--EPLTIFDPIETWKRKTLTD--FKTRELLRPVFRGGRRVYELPYLKDIQTYAQHECET
RAAC01840              DPSEPLELFHPIHTYKRKVVQN--YEMEELLRPVFVGGELVYELPTVQEIQARVETQLSA
                       :  :*  :*.*  *:*  . . .  :: .::* *:: *.  *      :  *     .  : .:

ref|YP_001514193.1|    LWPEYRRLNRPQLYKVDLSKKLWDLKNQMMDQFR-
ref|YP_001317996.1|    LWPEYKRLNRPQLYKVDLSQKLWSLKHNMIQSLKK
ref|YP_001090064.1|    IWEQYKRLSKPHIYKVDLSRNLWYLKTQMI-----
ref|ZP_01995293.1|     LWDETKRLFYPHRVYVDLSQKLYAVKQSLLDQ---
ref|YP_517020.1|       LWDEVKRLVNPHRYIVDLSPKLFELRQSLLLE---
RAAC01840              FSSEVRRHLNPHEYHVDLSKPLWDLKQRLLHEWRR
                       :   :  :*   *:    ****  *:  ::    ::
```

FIG. 159

```
ref|YP_604970.1|                           ------ ----- ---   -AHQGGEERWPSNTMLAYRNAAALGVDMLDTDLHA
ref|NP_295807.1|                           --------------------------AHQGGEALWPSNTLTAYRGAVALGVDLLEMDLHA
RAAC01875                                  MARAVEEFVEGRMQMDGTRRPRVRIFAHRGASREAPENTLPAFQIALRQGADVIETDVHW
ref|YP_076566.1|                           --------------------PRPVVLAHQGASGHAPSNTMEAFRLALEQGADILELDVHM
ref|YP_644758.1|                           --------------------------FAHRGASARAPENTLEAFRLGVEAGAGGLEMDLHM
ref|YP_357266.1|                           --------------------PRPRLFGHRGNSGDFPENTLPAFSDALACGTPYLELDVRA
                                                                     .*:*   *.**: *:    *.  :: *::

ref|YP_604970.1|                           TRDGALVLSHDETLDRLTDTQGRIADMTLAQVLAADAGYAFTPDGGKTFPFRGQGVRVAQ
ref|NP_295807.1|                           TRDGALVLSHDATLDRLTDTQGRIADLTLEQVLRADAGYTLTPAGGCSGFPFRGQGVQVAQ
RAAC01875                                  TKDRELVICHDPRIDAVSDGTGAIADMTYEELLRYDFGYRFTRDGGRTYPYRGCGIRMAT
ref|YP_076566.1|                           TRDGVVVVSHDETIDRMSDGTQLIKEMTLAELRRYDFGYRFTPDGGLTYPYRGKGVTIPT
ref|YP_644758.1|                           TRDGEIVVIHDHTVDRTTDGSGAVREMSLRELRRLDAGYRFSPDGGRSHPYRGRGLRVPT
ref|YP_357266.1|                           TKDDEVVVIHDESLLRTCGIDRPVAGLTFAELQNYDAGATFTPDQGRSYPHRGCGIRVPL
                                           *:*   :*: **  :     :  :: ::    * *  ::    *  .*.** *: :.

ref|YP_604970.1|                           LAEVLAAFPNMPLTIEIKQTSPSLAAPFCKALRDAGVTDHVIVASFSDKALNEFRAACPE
ref|NP_295807.1|                           LKDVLREFPNTPLIIELKQASPSIAAPFCAELRRAGATGRVIAASFSDAALNEFRRLCPE
RAAC01875                                  LREALRAFPGAHFNVDLKPKCPHVG-LFLRMLEEEDSLERVTLASFHHRTLVEARARCPR
ref|YP_076566.1|                           LEEVLQAFPEVPVNIEIKQADPPMEAQLWELIQRYGAEDRVLVASFHGTVAKRWRDLAGD
ref|YP_644758.1|                           LREVYEAFPRAAVNMEIKEPVPGIERRVLEVIDGAGARGRTLVAAFDHGIVRRFREASGG
ref|YP_357266.1|                           LADVLQAFPRALFNIEIKQETPAMETATLEVIRRADMTEQVLLAAENDAVMARLRPLCQT
                                              * :.  **    .  :::*  * :        :    :.  *:    .  *  .

ref|YP_604970.1|                           V--ITSMTEKELRPLVLLSKVGLA--HLAPLPGRAAQVPVRSGN----IEVVTPAFVRAM
ref|NP_295807.1|                           V--MTSMTERELRPLVLLSKVGLS--ALAPTPGQVAQVPVRSGG----IEIVTPAFVRAL
RAAC01875                                  L--KTSASPFEVARLAAMARAGWERGGRARMPFQAVQVPLRQYG----VRVVIPRFIEFA
ref|YP_076566.1|                           R--VATSAPVEHMYLVAAHYLSHLD-RLYAPAHDAFQVPVAQKAGPLTVRFDTERFLRMA
ref|YP_644758.1|                           E--VATSASRLEVVAFYALVRLGLW--RFARPGYAALQIPVRRRG----IELITPSLVAAA
ref|YP_357266.1|                           AGIPTSFSYGELVSFFTWLQAGGQ--SPYHPPAQALQIPETYEG----QTLVTPQSIAAA
                                              ::  :  :         *      *:*      . *    :

ref|YP_604970.1|                           HARGVAVHVWTINDPAEMRRLIAMGVDGIITDRPDL----------
ref|NP_295807.1|                           HARGVAVQVWTIDDEAEMRRLVQMGVDGVITNRPDL----------
RAAC01875                                  HRLGLEVDVWTVDDPNVIRGLIRQGVDGVTNSPQILQKLLLELEQ
ref|YP_076566.1|                           ERVNVAVHYWTINDEDEMRRLYQLGAHGIITDYP------------
ref|YP_644758.1|                           HALGVRVDAWTINEPEEMRRLLGLGVDVVMTDRPE-----------
ref|YP_357266.1|                           HTLGIEIHVWTVNQAQDMERLLRMGVDGVMSDRPAV----------
                                           .  .: :. **:::   :. *   *.. :::: *
```

FIG. 160

```
ref|ZP_01034116.1|       --------------------------------------------MRSVELFVGAG
ref|ZP_02297879.1|       --------------------------------------------MRAIELFAGAG
RAAC02539                MRHYAFRRMLTMWTRWMAIETVLFRKQLVGFEGNRHDLKNSYSGERSVRMRSVELFVGAG
gb|ABY83631.1|           --------------------------------------------MKSVELFAGAG
ref|YP_208280.1|         --------------------------------------------MKSLEIFSGAG
ref|YP_001516905.1|      --------------------------------------------KLSCLELFTGAG
                                                                     :  .:*:* *** ref|ZP_01034116.1|       GLGIGVSQAGFRPAAVMDWDRWACDTLRENKERGLDPIAHWPI-HEGDIRQFDFGTVDGT
ref|ZP_02297879.1|       GLGMGVSRAGFTPQAVVEWDRWCCDTIRENREKGIASLAGWPMPIEGDVRGVNFRGFEGK
RAAC02539                GLAMGISNAGFRHVGLYEWDRYACDTIRFNKERNVGPVRDWPI-YQLDVRSVDFTQYRG-
gb|ABY83631.1|           GLAMGCEIAGFEHLAVVEWDKWACDTVRENKKSGFPLLSDWDL-FEGDVREFDWSKIPKG
ref|YP_208280.1|         GLAKGLELAGFQHASFTELNKDACNSLRSNFNP--------KLVYQGDVADFDLSSQFG-
ref|YP_001516905.1|      GLAKGLEKAGVQHTAFVEWNKDACTTLANNYSA--------QLVHNVDIRTFKFSQFGH-
                         **. *  .**.    .. : :: .*::  *  .        :  :.*:  ..

ref|ZP_01034116.1|       VDLVTGGPPCQPFSMGGRHRAFLDGRDMFPQAIRAVRELRPRAFIFENVKGLTRSSFANY
ref|ZP_02297879.1|       LDLVTGGPPCQPFSLGGKHQAHADRRDMWPEAVRAVRETRPRAFIFENVKGLTRESFATY
RAAC02539                IELLAGGPPCQPFSLGGKHRGREDHRNMFPEMLRAVREIQPKVVLIENVKGLLRESFAKY
gb|ABY83631.1|           IDLLAGGPPCQPFSTGGKHKANSDSRDMFPATAEAIRQIRPKAFIVENVKGLTRATFATY
ref|YP_208280.1|         IEVIAGGPPCQPFSLGGKHLAHEDRRDMFPHAVRYVEYYRPKAFIFENVKGLLRKSFADY
ref|YP_001516905.1|      VDIVSGGPPCQPFSMGGKHKGNMDKRDMFPYACKAISVCTPKAFVFENVKGLLRKSFSSY
                         ::::.:******.:.    * *;*:*    . :   *:..:.****** * .*: * ref|ZP_01034116.1|       LEYIRLQLTYPDLVAKRDEEWLAHLARLEDHHT--KGTEKGLRYRVVMRVLNSANYGVPQ
ref|ZP_02297879.1|       VSHIVLQMTYPDIVAKSFEGWEGHLQRLERHHTS-RRRVTGLEYRVVYRVLNAANHGVPQ
RAAC02539                FEYILLQICYPEIVPKENFDWTDHLSRLEQQHT--KGRYHGLSYRVVFRLLNAADYGVPQ
gb|ABY83631.1|           FQYIQLQLEFPEVAPRNGEDWSEHLKRLQEEKTSGKNKGRGLTYNVLATLVNAADYGIPQ
ref|YP_208280.1|         FEYILLRLTYPNLGYLQNEDWKGHLTRLKEIEFN---LYKGIKYNVVSYQLLNAADYGVPQ
ref|YP_001516905.1|      FEYILLRLRYPDLSLQASERWEDILARLEKIHTS--GKYDGIKYNVVFRLVDAANYGVPQ
                         ..:* *::  :*::    *   ** **:  .     *:  *:* :::::*:**

ref|ZP_01034116.1|       RRERVFLVGFRADTGTFWHFPKPTHSRDALLWSQWRDEVYWDLHRVARK--NRP-EGGAA
ref|ZP_02297879.1|       RRERVVFVGFRSDLDIKWAFPAETHSLDALLWDQVHGD-YWDRHRVRKA--DRN-IGDRY
RAAC02539                KRERVFIVGFRSDLNIEWSFPNPTHSFDALLYDQWVTGDYWKRHGLEMP--TVP---SQM
gb|ABY83631.1|           KRERVFIVGFRDDLEIEWSFPKPTHSYDALIYDQWVTGDYWKRHGLEMP--TVP---SQM
ref|YP_208280.1|         KRERVVIVGIRADLDIDWKFPKRTHSEDRLNWEKYVTGEYWEKHNE-------PKRFNKD
ref|YP_001516905.1|      RRERVFIVGIREDLNIEWSFPEESHSLDSLLWSQFITGAYWIRNAVNFLEIEHLDQRTQQ
                         :****.:**:*:*  .   *.*  :* **   :    **   :

ref|ZP_01034116.1|       KAR--SLKIADRPLD-EPWLTVRDAISDLPDPEHAPGTARGFHDHRFQPGARSYAGHTGS
ref|ZP_02297879.1|       RQR--AARLGQQPDT-LPWRTTRDAIADLPDPEREPKQSMTYLNHRFQPGARSYPGHTGS
RAAC02539                KKRIESLRMGLRLIQGAPWVTVRDAISGLPDPESE--QDCGVPNHRFNPGARVYPGHTGS
gb|ABY83631.1|           VSR--IAKLRKNPPDTLPWKTVRDAIADLPDPETK--AAKMIRNHGFQAGARTYPGHTGS
ref|YP_208280.1|         IAEKLQKKYGIFEPEKKPWQTVRDTLSDIPHP-LGN---HKITGHEYRDGARIYPGHTGS
ref|YP_001516905.1|      RAKQLMQQPSLFSPSLEPWKTVRDQIGKLPAPDIQG---SFDNEHVLREGARSYPGHTGS
                          .    :          ** *.**  .  :* *    *    . *** *.***** ref|ZP_01034116.1|       PLDEPAKTLKAGVIIGVPGGENMLRRPDGSVRYFTIRESARLQTFPDDMVFHGSWTDTMRQ
ref|ZP_02297879.1|       PLDEPAKTLKAGVIIGVPGGENMLLRPDGSVRYFTVRESARLQTFPDDFRLHGSWSEAMRQ
RAAC02539                PLDEPAKTLKAGDHGVPGGENMLVKPDGTVRYFTVRESARLQTFPDEYVFSGSWTESMRQ
gb|ABY83631.1|           PLDLPAKTLKAGANGVPGGENMLVRDDGSVRYFTVRESARLQTFPDSYRFHGSWTETMRQ
ref|YP_208280.1|         GIDEPSKTIKAGGHGVPGGENMIKYDDGTVRYFTSYEAKLLQTFPEEFVISGAWGEAMRQ
ref|YP_001516905.1|      YIDMPSKALKAGDHGVPGGENMIRYQDGRIRYYTTFEAKRIQTFPDNYRISGSWTEAMRQ
                          :* *:*::*** *****  .. :** :**:*:    *::  :****:.   :.*:**

ref|ZP_01034116.1|       LGNAVPCQLARIVASGVRHKL----------
ref|ZP_02297879.1|       LGNAVPVELAHVVASSVNAHLQFKAS-----
RAAC02539                LGNAVPVRLAHFITKDIRTRLEWSVADAGKAV
gb|ABY83631.1|           LGNAVPVHLAYCVASSVAEKL----
ref|YP_208280.1|         IGNAVPVKLSEILGKHL-------------
ref|YP_001516905.1|      IGNAVPVELGYRIANSL--------------
                         :*****. *.    : .:
```

FIG. 161

```
gb|ABO14793.1|        ---MKKQRAFLKWAGGKYGLVEDIQRHLPPARKLVEPFVGAGSVFLNTDYDHYLLADINP
ref|YP_001443312.1|   ---MKKQRAFLKWAGGKYGLVEDIQRHLPPARKLVEPFVGAGSVFLNTDYDHYLLADINP
ref|ZP_01815366.1|    ---MKKQRAFLKWAGGKYGLVEDIQRHLPPARKLVEPFVGAGSVFLNTDYEQYLLADINP
ref|YP_205672.1|      ---MKKHRAFLKWAGGKYSLVEEIQRHLPDARKLIEPFVGAGSVFLNTDYDHYLLADINP
ref|ZP_01042597.1|    ---MKRNRAFLKWAGGKYGLVEPIKACLPEGRKLIEPFVGAGSVFLNTDYDRYLLNDINP
RAAC02543             MQSMPIRRSYLQWPGGKSHIVSALRAFLPPGRRLIEPFVGASSVFLNTDYPEYLLGDANP
                         .*::*:*.***   :*. ::  **.*:*:****,****.* * ** gb|ABO14793.1|        DLINLYNLLKERPEEYTSEAKRWFVAENNRKEAYLNIRAEFNKTDDVMYRSLAFLYMNRF
ref|YP_001443312.1|   DLINLYNLLKERPEEYISEAKRWFVAENNRKEAYLDIRAEFNKTDDVMYRSLAFLYMNRF
ref|ZP_01815366.1|    DLINLYNLLKTDPETYIAEAKRWFCPENNRKEVFLDIRAQFNDTDNVMYRSLAFLYMNRF
ref|YP_205672.1|      DLINLYNHLKDEPERFIEDARALFQPEYNKKEVYLALRVEFNQCTDTYRRSLLFLYMNRH
ref|ZP_01042597.1|    DLITLYQFVKRRPKTFIADARRLFTARNNQSDAYYALRKSFNESNDPYYRSLLFLYLNRH
RAAC02543             DLILVHRTLQAYGEAFIGACRELFVPENNAPERYYALRQEFNATQNLWRRAILFVYLNRH
                      ***  ::. ::    : :*  .:  *  .. *  : :  :*.**    :  *;*:*:**.

gb|ABO14793.1|        GFNGLCRYNKKGGFNVPFGSYKKPYFPEAELEFFAEKAKKATFVCEGYPETFSRARKGSV
ref|YP_001443312.1|   GFNGLCRYNKKGGFNVPFGSYKKPYFPEAELEFFAEKAKKATFVCEGYPETFSRARKGSV
ref|ZP_01815366.1|    GFNGLCRYNKKGGFNVPFGSYKKPYFPEAELEFFAEKAKKATFVCEGYHETFSRARKGCV
ref|YP_205672.1|      GFNGLCRYNKKGGFNVPFGSYKKPYFPEKEMVFFAEKAKKATFVCEGYMDTFKRARKGAV
ref|ZP_01042597.1|    GYNGLCRYNSRGIFNVPFGDYRKPYFPEAEIEVFAEKAKRAKFVCSSFEQVFRRARKGDV
RAAC02543             GTHGLMRYNRRGAFNTPFGYRRKIYFPEAEMRLFAEHAKRASFVHADFRDIMSQARPCDV
                      * : * :* .*  :* **** *; .*::*.   .: :  : * * gb|ABO14793.1|        VYCDPPYAPLSNTANFTSYAGNGFTLDDQAALADIAEKAATERGIPVLISNHDTTLTRRL
ref|YP_001443312.1|   VYCDPPYAPLSNTANFTSYAGNGFTLDDQAALADIAERAATERGIPVLISNHDTTLTRRL
ref|ZP_01815366.1|    VYCDPPYAPLSNTANFTSYAGNGFSLDDQAALADVAEKAATERGIPVLISNHDTTLTRRL
ref|YP_205672.1|      VYCDPPYAPLSTTANFTSYAGNGFSLDDQAALADIAEKAAFERDIPVLISNHDTTLTRRL
ref|ZP_01042597.1|    IYCDPPYAPLVQASNFTSYATGGFSLDEQSELARHAIRAACKRHIPVLISNHDTPLTRAL
RAAC02543             VYCDPPYVPLSDTANFTEYAPGGFSWHDHMALAGYARELA--RRGVTVEISNHRTPATESL
                      :****.   ::*.  .:  ::      *   *  :.* **** *. *. * gb|ABO14793.1|        YHGAELNVVKVKRTIS-RNGSGRNKVDELLALFRAP
ref|YP_001443312.1|   YHGAELNVVKVKRTIS-RNGSGRNKVDELLALFRAP
ref|ZP_01815366.1|    YHGAELNVVKVKRTIS-RNGAGRNKVDELLALF---
ref|YP_205672.1|      YHGATLNTIKVKRTIS-RNGAGRNKVDELMALFHAP
ref|ZP_01042597.1|    YERAKISSLKVARNIS-QKGDARKPVAELLALF---
RAAC02543             YRGAQLVSVRAPRNIGVQHRQAARTAEEILAIFWPP
                      *. * :  ::. *.*. ::    . .  *::*:*
```

FIG. 162

```
ref|YP_001275109.1|    ------------------------RRERKRVIAFGWYGGKYSHLDWLLPLLPFCHHY
ref|ZP_01514022.1|     ------------------------KRSKKRILAFGWYGGKYSHLDWLLPLLPSCHHY
ref|YP_001633718.1|    ------------------------QRRTRRLIAFGWYGGKYSHLDWLLPLLPCHHY
ref|ZP_01631840.1|     ---------------------------KKIAFGWYGGKYSHLDWLLPLLPTITHY
gb|AAZ73681.1|         --------------------------KNKLIAFGWYGGKYSHLDWLLPLLPKTTHY
RAAC02564              MGVMLLSFIEGLPPFTALMIDHVSTARQKPRRKRIAFGWYGGKYSHLSWLLPLLPRAHHY
                                                  : :***********.******   **

ref|YP_001275109.1|    CEPFGGSAAVLFNREPSPVETYNDIDGEVVNFFRVLRDDPERLVRAIGLTPFSREEFAIA
ref|ZP_01514022.1|     CEPFGGSAAVLLNREPSPVETYNDIDGDVVHFFRVLRDEPERLVRAIGLTPFSREEFAIA
ref|YP_001633718.1|    CEPFGGSAAVLLNRDPAPVETYNDIDGEVTNFFRVLRDQPDQLTRAIALTPFSREEFALA
ref|ZP_01631840.1|     CEPFGGSAAVLLNREPAPVETYNDIDGQVVNFFRVLRDQRDELIQAIGLTPFSREEFRIA
gb|AAZ73681.1|         CEPFGGSASILINREPSPVETYNDIDGELVNFFRVLRDEKNELIRAIAFTPFSRSEFELA
RAAC02564              CEPFGGSAAVLLNRDPSPVETYNDLDGEVVNFFRVLREQRDALIEAIALTPFSREEFVRA
                       ********::*:**:*:****:::.:******::  * ..:.  * ref|YP_001275109.1|    CEIDPA-LDPVERARRFYVRARQVRTGLAQSATLGRWANCKNTSRSGMAGAVSRWLGAVE
ref|ZP_01514022.1|     CEIDPS-LDPVECARRFYVRARQVRTGLAQSATLGRWANCKNTSRAGMAGAVSRWLGAIE
ref|YP_001633718.1|    CEIDPS-LEPIERARRFYVRARQVRTGLAQSASLGRWANCKQTSRSGMAGAISRWFGAIE
ref|ZP_01631840.1|     IAKDETGLSDLEKARRFYVRARQVRTGLAQTASIGRWAHCKLTSRAGMAGAVSRWLGSVE
gb|AAZ73681.1|         ISKDTTNLSNLERARRFFIRARQVRTGLAQTASSGRWAHCLLTSRAGMAGAVSRWLGSID
RAAC02564              TVEPTGGLTELERARRFYVRARQARMALAQTATPGRWAACRNTSQRGMAGNVSRWLGSAA
                           *   :*  ****::****.*  .***:*:  **** *  **:  ****  ****:*:

ref|YP_001275109.1|    DLPEIALRLLRVQIENRPATEVIRLYDSADTLFYCDPPYIHETRGDDNAYAYEMNYEEHC
ref|ZP_01514022.1|     DLPDIALRLLRVQIENRPSIEVIRLYDSPDTLFYCDPPYVHDTWGDNNAYAYEMNNEEHR
ref|YP_001633718.1|    DLPDIAIRLLRVQIENRPALEVIRLYDSPDTLFYCDPPYVHETRGDNNAYAYEMSNEEHQ
ref|ZP_01631840.1|     HLPEIVQRLLRVQIENDTAIDIIQRYDSSETLFYCDPPYPHDSRGDSKAYAYEMTDDEHR
gb|AAZ73681.1|         DLSKTVQRLQRVQIENSSSFDIIRRYDSEETLFYCDPPYPHNTRGDSKAYAYEMTDEEHR
RAAC02564              NLAEIAARLVRVQIEHRPAMDVIRAYDSPDTLFYCDPPYIHATRTDPRAYRYEMSDEEHM
                        *..*. ** *****:  .::::*: *** :********* *  :  * .** ***. :**

ref|YP_001275109.1|    ELAMSLNSVRGLVAISGYECDLMNDLYPSSRWYKSVAPSKTIHSTKDKRTEILWTNY
ref|ZP_01514022.1|     QLALVLNSVQGFVAISGYDCDLMNDLYPSPNWYKNIAPTKTIHSTK-----------
ref|YP_001633718.1|    QLADVLNSVQGFVAISGYDCDLMNELYSPPKWIKHVGPTRTIHSTKDQRTEILWTNY
ref|ZP_01631840.1|     QLAGVLRSVKGKVALSGYDCTLMQELYG--DWNCIKAPQKQCHSIKELRQEVLWVNY
gb|AAZ73681.1|         KLAEIVHNIKGKVAVSGYECTLMNELYG--DWKQISAPTKSCHSVKKPRTERLWINY
RAAC02564              ELARVLHNVRGKVAISGYHCDLMDELYR--DWRCIDAPPKQCHASKRWRQEALWVNY
                       :**  :..::* **:*** * **:.** *      . *  *  *: *
```

FIG. 163

```
ref|YP_853610.1|       ------------------------FESQADIRVIVINGEPWFIASDVCRAIGIANHRDAVR
ref|YP_512277.1|       ------------------------FESQADIRVIVINGEPWFIASDVCRAIGIANHRDAVR
ref|ZP_01959153.1|     ------------------------NSTPIRVQVINNEPWFVAKDVCDVLGISKYRDAIA
ref|YP_001038857.1|    ------------------------GKQVRTFIIDGEPWWVAKDVCDILELGDTHKAME
ref|YP_001662865.1|    ------------------------GNTVRTVMKDGNPWWVLKDVCSVLDIGNSRDVMA
RAAC02566              MPFCPADIALRRGRSLMQQTWAVFANGAQVRVFWVDGEPWFDAVGVCEAMGLRNIEKAIR
                                                :*.   :.:**:   .**  : :  ...:

ref|YP_853610.1|       KLDDDEKG-VASTDTPCGEQESIIISESGLYTLILRCRDAVTPGTIPYRFRKWVTGEVLP
ref|YP_512277.1|       KLDDDEKG-VASTDTPGGEQESIIISESGLYTLILRCRDAVTPGTIPYRFRKWVTGEVLP
ref|ZP_01959153.1|     RLDDDEGC-PIEVDTLGGMQKMAAVNESGLYTLILQSR---KPEAKP--FRKWVTSEVLP
ref|YP_001038857.1|    RLDEDERNTIPVTDSLGRLQETYVVNEAGLYNLILGSR---KQEAKE--FKRWITHEVIP
ref|YP_001662865.1|    RLDSDEKG-VDIIDTPGGKQEVSIINESGLYSVILVSR---KPEAKK--FKRWVTHEVLP
RAAC02566              RLDDDEKG-LVTVDNAGGREEILVVRESGMLRLALAGR---EPHARA--FQRWVREVLP
                       :.     *.*   ::    : *:*:  : *  *    :       *::*:. **:* ref|YP_853610.1|       -QIRRTGSYIKNSLPQEERIKMVA------------------------
ref|YP_512277.1|       -QIRRTGSYIKNSLPQEERIKMVA------------------------
ref|ZP_01959153.1|     ------------------------------------------------
ref|YP_001038857.1|    -QIRKTGIYALEPKQLLAVAIIEAQKIIEEQDR----------------
ref|YP_001662865.1|    -SIRRHGLYATD--ELL-------------------------------
RAAC02566              LAIRGQRPNALEEQLRLEKVSLIVEILAAYQDRLSDGGIEHLAKTIANLLT
```

FIG. 164

```
ref|YP_375842.1|        ------------------MSKAELVEKIAAQAKLTKVDAERAVNAFINVVTSSLKGGD
ref|YP_001131112.1|     ------------------MSKAELVEKIAAQAKLTKVDAEKSVNAFINVVTSSLKAGD
ref|ZP_00591928.1|      ----------------LMSKAELVEKIASQAGLTKADAERAVNSFVSVVTDSLKAGE
ref|YP_001003150.1|     ------------------MNKADLAEKVAAETGVSKRVATDAVSAVFTGIEESLASGE
ref|NP_046614.1|        --------------- GAPSMNKTELIAKVAEKQGVSKKEGAPSVEKVFDTISEALKSGE
RAAC02589               MCCLTGLERMRDLLEKERELVNKGELVAEVQARVGLPKSQVLQVLNTFCEVTTERLQAGE
                                          :.*  :*   ::   .   :.*      :. .     . * .*:

ref|YP_375842.1|        DVTLVGFGTFTTGDRAARQGRNPQTGKAITIPAKKVVKFKPGKALKDEV-
ref|YP_001131112.1|     DVTLVGFGTFTTGDRAERQGRNPQTGKTITIPAKTVVKFKPGKALKDEV-
ref|ZP_00591928.1|      DVTLVGFGTFSVGERAERQGRNPQTGETITIAARKAVKFKPGKALKEEVD
ref|YP_001003150.1|     DVSIPGFGKFAVVARPERQGRNPQTGELIDIPAGMNVRFKPGAPLKRSVD
ref|NP_046614.1|        KVSIPGFGTFEVRERAARKGRNPQTGEEIDIPATKAPAFKPAKALKDAV-
RAAC02589               EVSLPPLGKFQYVMRSARRCRNPQTGEMIDVPEKATVRFRPSGALKGRVN
                        .*::    :*.*       *.  *: ******: *  :.         *:*. ,** *
```

FIG. 165

```
ref|YP_001127101.1|    ------------------------------------YLIPTVIEQTNRGERAYDIYSRLLKD
ref|YP_148915.1|       ------------------------------------YLIPTVIEQTNRGERAYDIYSRLLKD
ref|YP_080797.1|       SIGNIFICANCEE-IDENTITIESPSITIVESGAPSIPTVIEQTNRGERAYDIYSRLLKD
ref|YP_001488316.1|    ------------------------------------IPTVIEQTNRGERAYDIYSRLLKD
ref|ZP_02848186.1|     -----------------------------------VPIVVEQTNRGERSYDIYSRLLKD
RAAC02045              ----------------MSSTWPQGEGGCCMYYPIPYVIEQTSRGERTYDIYSRLLKD
                                                            :*  *:*.:******** ref|YP_001127101.1|    RIIFLGSPIDDQVANSIVSQLLFLAAEDPEKDISLYINSPGGSITAGLAIYDTMQFIKPD
ref|YP_148915.1|       RIVFLGSPIDDQVANSIVSQLLFLAAEDPDKDISLYINSPGGSITAGLAIYDTMQFIKPD
ref|YP_080797.1|       RIIMLGSAIDDNVANSIVSQLLFLEAEDPEKDISIYINSPGGSITAGMAIYDTMQFIKPQ
ref|YP_001488316.1|    RIIMLGSAIDDNVANSIVSQLLFLEAEDPEKDISIYINSPGGSITAGMAIYDTMQFIKPK
ref|ZP_02848186.1|     RITFLGSAIDDDVANSVIAQLLFLAADDPEKDIHLYINSPGGSVTAGMAIYDTMQYIKPD
RAAC02045              RIVILGTPIDDQVANSIVAQLLFLAADDPEKDIQMYINSPGGSVTAGMAIYDTMQHIRPA
                       :::: *:*:**::::* *::* :******:*:*******.*:* ref|YP_001127101.1|    VSTICIGMAASMGAFLLAAGAKGKRFALPNSEVMIHQPLGGAQGQATEIEIAAKRILFLR
ref|YP_148915.1|       VSTICIGMAASMGAFLLAAGAKGKRFALPNSEIMIHQPLGGAQGQATEIEIAAKRILFLR
ref|YP_080797.1|       VSTICIGMAASMGAFLLAAGEKGKRYALPNSEVMIHQPLGGAQGQATEIEIAAKRILSLR
ref|YP_001488316.1|    VSTICIGMAASMGAFLLAAGEKGKRYALPNSEVMIHQPLGGAQGQATEIEIAAKRILSLR
ref|ZP_02848186.1|     VSTICMGMAASMGSLLLTAGAKGKRFALPNAEVMTHQPLGGVRGQASDIKIHADWILKTK
RAAC02045              VSTICIGMAASMGAFLLAAGEKGKRYALPNAEIMTHQPLGGVEGQASDIKIHAEWILKTK
                       *****.* *******.:**:** ****.****:*:******. ***::*: *. **   :

ref|YP_001127101.1|    DKLNRILAENTGQPIEVIERDTDRDNFMTAQKAQEYGIIDRVL-------
ref|YP_148915.1|       DKLNRILSENTGQPIEVIERDTDRDNFMTAQKAMEYGIIDRVL-------
ref|YP_080797.1|       DKLNKTLAERTGQPLEVIERDTDRDNFKTAEEAKEYGLIDKVL-------
ref|YP_001488316.1|    DKLNQVLAERTGQPIEVIERDTDRDNFKTAEEALQYGLIDKVL-------
ref|ZP_02848186.1|     QKLNEIYVERTGQPYEKIDRDTDRDNFMSAEDALNYGLIDKVI-------
RAAC02045              DKLNRLLSERTGQPLEVIERDTDRDHFMTAEEAKAYGLIDEVLHPLHPVR
                       :***.:  *.**** * *:*****:* :*:.*  **:**.*:
```

FIG. 166

```
ref|YP_866618.1|    ------IKAPKKLIEVALPLDDINAAAREKSIRHG-HPSTLHLWWARRPLAAARAVLFA
ref|YP_342704.1|    ------EIKTPKKLIEVALPLDDINTAAAREKSIRHG-HPSTLHLWWARRPLAAARAVLFA
ref|NP_384606.1|    ------VRTPKKLIEVALPLDAINEAAAREKSIRHG-HPSTLHLWWARRPLAAARAVIFA
ref|YP_911114.1|    ------IKSPRKLIEVALPLDAINAACAYEKMPGIGAHPRGIHLWWARRPLAAARAVLFA
ref|YP_115396.1|    ------VKAPKKLIEVALPLDAINEASAREKSIRHG-HPSTLHLWWARRPLAAARAVIFA
RAAC02635           MYVVPKVKAPKKLIEVTLPLDDINAEAAREKSIRHG-HPSTLHLWWARRPLAAARAVLFA
                         :::*:*****:****.**.*.**   *.** :***************:**

ref|YP_866618.1|    QMVNDP----GGERG--YYAGKTKAQADAEREELFKIIRELVLWENTNNEEVLNKARAAI
ref|YP_342704.1|    QMVNDP----GYQQGEGFKYGVNKKEAEIKREKLFQIIRDLVKWENTNNEEVLNRAREAI
ref|NP_384606.1|    QMVNDPSWKWELEHPGEIPPNNIKASWAASRNRLFAIIKDLVEWENTTNEVVLEKARAEI
ref|YP_911114.1|    QLVNDP----GYQQGCGFKYGKNKKEAAIERKRLFKIIEELVLWENTTNEEVLERARVEI
ref|YP_115396.1|    QMVNDP----GYQQGGGFRYGVNKEKAQLERERLFKIIEELVQWENTNNEAVLSRARAEI
RAAC02635           QLVNDP----GGERG--YKPGMTREQAQKERERLFGIMRRLVKWENSNDEEVLREAREEI
                    *:****           :  :      .*:.**.*:.  *::.* .: * ref|YP_866618.1|    RKSWRETCELNK----GKSGFDPDKLPAFHDPFAGGGAIPLEAQRLGMESHASDLNPVAV
ref|YP_342704.1|    WESWRETCHLNRNHPQAAELFNPDKLPAFHDPFAGGGAIPLEAQRLGLESYASDLNPVAV
ref|NP_384606.1|    RKSWRETCDLNKDHPQAAGLFNPERLPAFHDPFAGGGALPLEAQRLGLASYASDLNPVAV
ref|YP_911114.1|    RRSWREVCELNKEHPQAAELFNPEKMPAFHDPFAGGGAIPLEAQRLGLEAYASDLNPVAV
ref|YP_115396.1|    WKSWRETCELNKNHPCAABLFNPDKLPAFHDPFAGGGAIPLEAQRLGLESYASDLNPVAV
RAAC02635           WKSWRETCEMNK----GLPGFDPDKLPAFHDPFAGGGSIPLEAQRLGLEAYASDLNPVAV
                     .****.*.:*:       *:*.:::*********: :***** ::****** ref|YP_866618.1|    LINKAMIEIPPKFAGRKPVGPIPEGEKQG------RMESDWPGATGLAEDVRRYGHWMRE
ref|YP_342704.1|    MINKAMIEIPPKFAGQRPVGPLPQGEKQG------KLMDDWSGARGLAEDVRRYGHWMRE
ref|NP_384606.1|    LINKATIEIPPKFAGRPVNPEARTSRD-------AWSKQWFRAQGLAEDVRYYGRWMRM
ref|YP_911114.1|    LINKAMIEIPPKFAGRPPVGPEIENKQGKSL----ELPKIWPGATGLAEDVRRYGSWMRD
ref|YP_115396.1|    TINKAMIEIPPRFAGRAPVGPVPPSPDGRGVGGEGLFAQDWAGAKGLAEDVRRYGAWMRS
RAAC02635           LINKALIEIPPKFSGRPPVNPEARSKVG-------LLEQEWKGASGLADDIRYYGEWMRD
                    **.***:*:*:.**.*             .  *  * ***:.:*  * ref|YP_866618.1|    EAFKRIGHLYPQVEITAEMAKERPDLKGIVGQKLTVIAWLWARTVRSPNPAFSHIAVPLV
ref|YP_342704.1|    EAFERIGNLYPRIKITQEMVAERPDLKPYQGQELTVIAWLWARTVKSPNPAFSHADIPLA
ref|NP_384606.1|    VAQKRIGHLYPPVEITSDMAKERPDLRPLVGQQLTVIAWLWARTVKSPNPAFRHVDVPLA
ref|YP_911114.1|    EAQKRIGHLYPPVEVTEEMARERSDLKPLVGKKLTVIAWLWTRTVKSPNPAFTHVNVPLV
ref|YP_115396.1|    EAEKRIGHLYPQVEVTRELAQGRQDLQPLVGQKLTVIAWLWARTVKSPNPAFSHVEVPLA
RAAC02635           EAFKRIGHLYPQVELPPEYG---------GGKATVIAWIWARTVKSPNPAYSHVDVPLV
                     * :***:***.:::.. :          * : *****:*:***.*****:  *:**.

ref|YP_866618.1|    SSFLLSTKKGKEAYIEPVVD--------------ANSYYFSVKKGTPS-------KDSAR
ref|YP_342704.1|    SSFLLSTKKGKESYVNPLVE--------------GHNYQFEVCMGVPP-------AEARN
ref|NP_384606.1|    SSFVLSTKTGAEAYVDPVID--------------KDTYHFAVRSGRAP-------SQARE
ref|YP_911114.1|    SSYILANKDGKEVYVKPVIE--------------GDKYYFLIKNGTPT-------TEAKD
ref|YP_115396.1|    STFVLSSKAGKEAYVQPMISPLPLGEGLGVRAGSEGYYRFTVQVAGTPGFDKADYARAKS
RAAC02635           RSFWLSTKKGKEVWVEPVIHE-----------DGSGYHFEVRTEGKP---------KIE
                     :: *:.*.*  *   ::.*::           * *. :

ref|YP_866618.1|    GTSAGK-RGGFRCIFSDAPIDYNYIRDEGSAGRIGTRLMAIVAEGVRGRIYLSATPELEI
ref|YP_342704.1|    GTKLGR-GANFTCLLSDTPIDPKYIYAQAQSGNLGQRLMAVVAEGKSGRIYLTPTAEMEQ
ref|NP_384606.1|    GTKFSR--GNFRCLLSQAPIDGDYIKAEAKAGRMGERLMAIVAEGRNGRIYLSPSSDQEN
ref|YP_911114.1|    GTKATVRGANFRCIVSGAVIGSDYIKTEGKAGRIGQRLMAIVAEGTRGRVYLPPTLDAET
ref|YP_115396.1|    GTKLAR-GANFECLLSNTPIEPNHIYTEANAGRMGARLMAIVAEGARGRVYLPPLPEHEA
RAAC02635           GTVNRR---GGTCIMSGSPIPFDYIRAEGKAERMGQRLMTVVVEGPRGRLYIAPTDDMEG
                    **         . *:.*  * :*  .:*   *:.* *.:*. :*:...  :  * ref|YP_866618.1|    IANSAK-PEWSPDVKLHGKCR-VNVSNYGLDVYSDLFTPRQLVALTTFSNLVQEARVKAV
ref|YP_342704.1|    AASAAS-PDWKPDALMPENPRWFSPPMYGMKSYGDLFTPRQLVALNTFSDLVQEACYKAI
ref|NP_384606.1|    IASAAH-PDWKPDVEFFQQALGFRVGNYGMTKWSDLFTARQLVALTTTFTELIAEVRKQIV
ref|YP_911114.1|    VAKDAA-PTWRPSGDVPERLTGGTCVPYGLKEWGDIFTPRQLVALTILSDLLSEVRELVR
ref|YP_115396.1|    IARQAQ-PEWKPEVAMPDNPRWFSPPLYGKNYGDLFTPRQLVALTTFSDLVIDAIERCR
RAAC02635           MALSLKEPDGLPQTQLPKRALGFRVQEYGMTMHKHLFTNRQLVALKTFSDLVVEAREKVY
                     *      *         *         **:   .:** ****** .:::*:  :.

```
ref|YP_866618.1|    NDAKITGMADDGMGIDEGGFGAGAYGDAVAVYLGFIVDKVSESLSTICTWSSSPKNE---
ref|YP_342704.1|    ADAKAAGMTDDGIGIDDGGRGATAYGDALAVYLTFAINKLADRGSTICTWDSSRSS----
ref|NP_384606.1|    ADAIAAGMIDDQTGLDKGGEGASAYAEAVSVYLAIALSRLTDICNALCRWEVTKT-----
ref|YP_911114.1|    EDALASGLSDSEKGLGDGGSGVIAYAEAVSVYLAFAINRCADFCNSVTRWVPGNQ-----
ref|YP_115396.1|    RDAAAAGLPDDGVPLDAGGTGATAYAQAVGVYLAIAISRFSDRNNSICTWDSGPTGTKAS
RAAC02635           EDALSSGMTDDGIGLEDGGIGARAYADAVAVYLGLVLDKCADYWSSICSWNSPKE-----
                     **  :*: *.   :   ** *. **.:*:.***  :  :.:  ::   .:: * ref|YP_866618.1|    --------LIVSTFRRQAIPMTWDFGEANPFANSSGSLEKIVPAVSKVIKTSLCGSVDGN
ref|YP_342704.1|    ---------TRNTFGRQAIPMTWDFAEPNPLSDSTGNFMGGIGWANDVLSRMIP-SSGGI
ref|NP_384606.1|    --------QVRNLFSRQAIPMLWDFAENNVFGGAAGDYIISLGNMVKALE-KLPARDPGV
ref|YP_911114.1|    --------KVMNLFGKQAIPMTWDYPEAAILADTVGGFAPASKYVADCIG-KLSPAAVGF
ref|YP_115396.1|    TGGSARTASLRNLFARQAIPMAWDFGEANPFSDSGGGFSSAFEWIEPAVR-SLRGGCAGY
RAAC02635           --------LVRNTFSRQAIPMVWDFAEANPFSDSTGNWMGMVDWVWKAVENAPIKTTLGE
                          . * :*** : *     :..: *.           :          * ref|YP_866618.1|    AIQFDARTVNLS-DRVVSTDPPYYDNIGYADLSDFFYVWSRRALKSIFPSLYSTLAVPKA
ref|YP_342704.1|    AVQQDAATQNISAEKVISTDPPYYDNIGYADLSDFFYVWMRRSLKSFYPSLFATMAVPKA
ref|NP_384606.1|    SRQQDAQTQSISAGKAISTDPPYYDNIGYADLSDFFYVWLREPLRSIYPGLFATVVTPKA
ref|YP_911114.1|    ASQADAQTQSISMAKIISTDPPYYDNIAYADLSDFFYVWLRKSLRLFLPGLFSTITVPKV
ref|YP_115396.1|    GDGADAQTQTLSRDKVVSTDPPYYDNIGYADLSDFFYVWLRRSLKPIFPGLYATLAVPKA
RAAC02635           AHLADAQTQSISVGKIVSTDPPYYDNVGYSDLSDFFYVWLRRSLNPILPGLFATLMTPKE
                      .   **  *  :*  ::*********.:*:******** *..* .  : *.*.::*: .**

ref|YP_866618.1|    EELVATPYRHGSKEEAEAFFMNGMICAINNFANQAHPSFPVTIYYAFKQSETK-ETGTTS
ref|YP_342704.1|    EELVAIPYRHGTKEKAETFFLDGMTQAIHNMADKGHPAFPVSIYYAFKQSETK-EGATSN
ref|NP_384606.1|    EELVATPARHGGSEAAELFFLGGMTAAMQRLAELAHPSTPVTIYYAFKQSETESDTGTSS
ref|YP_911114.1|    EELVAAPYRHGTKQKAETFFLTGMTEAIHNLAEQAHPEGPVTIYYAFKQSETSGQDGTSS
ref|YP_115396.1|    EELVATPYRHGSKEAAEAFFLDGMRRALKNLAEQAHPAFPVTIYYAFKQSETTDAAGTSS
RAAC02635           DELVAAPERHQSKGDANSFFIHGMSKAMSTLANSTHPGFPVTIYYAFKQSDTE-NEGTSS
                    :**** * **   .  *: **: **   *:  :*:  **  **:********:*   .*:.

ref|YP_866618.1|    TGWETFLEAVIQAGFGITGTWPMRTERGARSIGIGANALASSIILVCRKRDNSAESISRR
ref|YP_342704.1|    TGWETFLEAVIRAGFSIDGTWPMRTEMSNRMIGSGTNALASSVVLVCKKREIEAESISRR
ref|NP_384606.1|    TGWETFLDAVIRSGLALTGTWPMRTELGNRMRGQDSNALASSIVMVCRPRPATAETVSRR
ref|YP_911114.1|    PGWVTFLSAVLSAGFAIVGTWPLRSEQEFRMIGMGANALASSIVLVCRKRSADAPSVSRR
ref|YP_115396.1|    TGWETFLQAVLDAGFALTGTWPMRTELGNRMIGAGTNALASSIVLVCRQRATDAPTASRR
RAAC02635           EGWVAFLEALLQAGFAVTGTWPLRTEMSNRMRGLDSNALASSIVIVCRRRPANAETISRR
                      :.*:: :*:..: ****:*:*    *  * .:****:::: *   * : *** ref|YP_866618.1|    QFQRELREILPEALETMIGG---KEGASP-------VAPVDLAQASIGPGMAVYSKYAAV
ref|YP_342704.1|    DFQRELREQMPDALEAMIGG---ETGTTP-------IAPVDLAQAAIGPGMAIFSKYEAV
ref|NP_384606.1|    AFLRELNQVLPEALDEMTRG--SGDDRSP-------VAPVDLSQAIIGPGMAVFSKYAAV
ref|YP_911114.1|    EFIRELNGVLPEALDEMTKG--SGEERSP-------VAPVDLSQAIIGPGMAVFSKYSAV
ref|YP_115396.1|    EFLRELNATLPEAIADMIGADPSPQPLSPRERGYGRVAPVDLSQAIIGPGMAIFSQYAAV
RAAC02635           AFLRELNTVIPDALSDMMHG---GPDRSP-------IAAVDLQQAAIGPGMAVFSKYAAV
                     * ***. :*:*: *  .  :*          :*.*  ******::*:* ** ref|YP_866618.1|    LNQDGNPMSVHDALILINREITDFLTPDSGSFDNDTLFCSTWFDQYGWKAGPFGEADTLS
ref|YP_342704.1|    LNQDGSRMSVHDALILINRAITEYLSPESGSFDADTQFCSSWFDQYGWSTGPFGEANVLA
ref|NP_384606.1|    LEADGTPMTVQAALRLINR----FLAEDD--FDHDSQFCLHWFEQYGWKEGRFGEADTLA
ref|YP_911114.1|    LEADGTPMSVRTALQLINR----FLAEDD--FDPDTQFCLHWFEQYGWNENLFGEADVLA
ref|YP_115396.1|    LEADGTPMTVKTALALINR----FLAEDD--FDHDTQFCLHWFEQQGWASGKYGEADVLA
RAAC02635           LEADGSPMTVKTALQLINRVVDAYLHASEAEVDADTLFCINWFDQFGWSEADFGRADVLA
                    *: **. *:*: ** ****     :*    .. .* :* ** **:* **      :*.*:.*:

ref|YP_866618.1|    RAKGTSVDGVQEAGVVQSGGGKVRLFKWDEYPDDWDPKKDNRTPVWEALHHLIRALNKDG
ref|YP_342704.1|    QAKGTTVDGVNTAGVVESGGGKVRLLKWAEYEADWDPIKDNRTPIWEACHQMIRSLNNQG
ref|NP_384606.1|    RAKGTSVDGVKQSGVIYASGGIVRLLKWAEYPSDWDPVGDGRLPVWEALHHLIRIFKSEG
ref|YP_911114.1|    RSKSTSVDAMKEAGVLQSGSGKVRLLKWAEYPSDWDPRTDKRMPVWEALHQLIRALKQGG
ref|YP_115396.1|    RAKGTAVDALVAAGVAESAKGSVRLLKWPEYPADWSPESDTRTPIWEALHQLIRALNQAG
RAAC02635           RAKGTSVDAVRAAGVLTADHGKVRLLRWQDYPSDWSPGKDYDTPVWEALHHLIRALQQDG
                    ::*.*::.: :   :  : *   * ***::. :*  :   *:*** *:::** ::. * continued →
```

FIG. 166 continued

```
ref|YP_866618.1|    ESVSGGLLARMPERAEAIRQLAYHLYTLCERKKWADDARAYNELITSWHGIAAASHEVGH
ref|YP_342704.1|    ESAAGELLAKMPEKGEPIRQLAYHLYTLCERKKWAEDARAYNELIGSWHAIVTASHEVGH
ref|NP_384606.1|    ESGAGNVLAAVAAKAEPARQLAYRLYTLCERAGWAEDARAYNDIITSWSAIESAAAAA--
ref|YP_911114.1|    ESASGALLAALGGKAEAVRQLAYRLYTLCERLGQAEDARAYNELITSWTGIESVA-----
ref|YP_115396.1|    ETEAGRLLARMPARAEPIRALAYRLYTLCERKGWAEDARAYNELVTAWSGIEQAANEAGV
RAAC02635           EQAAGALLAGMYSVSESIRSLAYRLYTLCERKGWAEDARAYNELIASWDAIAEVAQKAGL
                    *   :* :** :    .*. * ***:******    *:******::: :* .*   .:

ref|YP_866618.1|    LGTQCTLDL-
ref|YP_342704.1|    SGSQAELGLD
ref|NP_384606.1|    ----------
ref|YP_911114.1|    ----------
ref|YP_115396.1|    VGAQMQLEL-
RAAC02635           SGSQLTLDVE
```

FIG. 167

```
ref|NP_244431.1|      MNLIPTVIEQTNRGERAYDIYSRLLKDRIIMLGTAIDDNVANSIVAQLLFLQAEDPDKDI
ref|YP_176521.1|      MNLIPTVIEQTNRGERAYDIYSRLLKDRIIMLGSGVDDNVANSIVAQMLFLQAEDPEKDI
ref|ZP_02171648.1|    MNLVPTVIEQTNRGERAYDIYSRLLKDRIIMLGTPIDDNVANSIVAQLLFLAADDPDKDI
RAAC00088             MSLIPYVIEQTSRGERSYDIYSRLLKDRIIFLGTPIDDDVANAVVAQLLFLAADDPDKDI
ref|ZP_02848186.1|    MNLVPIVVEQTNRGERSYDIYSRLLKDRIIFLGSAIDDDVANSVIAQLLFLAADDPEKDI
ref|ZP_02210735.1|    MALVPTVVEQTGRGERAYDIYSRLLKDRIIFLSDEVNDTTASLVVAQLLFLEAEDPDKDI
                      *  *:*  *:*.:**********:*.   ::*  .*.  :::* *::* ref|NP_244431.1|      SLYINSPGGSITAGMAIYDTMQYIKPNVSTICIGMAASMGAFLLAAGAKGKRFALPNSEV
ref|YP_176521.1|      SLYINSPGGSITAGMAIYDTMQFIKPDVSTICIGMAASMGAFLLTAGAKGKRMALPNSEV
ref|ZP_02171648.1|    SLYINSPGGSITAGMAIYDTMQFIKPKVQTICIGMAASMGAFLLTAGEPGKRYALPNSEV
RAAC00088             QMYINSPGGSVSAGLAIYDTMQHTKPDVSTMCVGMAASMAAVLLAAGAKGKRYALPNSEV
ref|ZP_02848186.1|    HLYINSPGGSVTAGMAIYDTMQYIKPDVSTICMGMAASMGSLLLTAGAKGKRFALPNAEV
ref|ZP_02210735.1|    HLYINSPGGSVTAGMAIYDTMQYIKPDVSTICIGMAASMGAFLLNAGAKGKRFALPNSEI
                      :********::**:*******.***.*.*:*:******.: ** **   *** ****:*:

ref|NP_244431.1|      MIHQPLGGTRGQASDIETHTRRILEMRETLNRILAERTGQPLEQIAKDTDRDNFMTAEKA
ref|YP_176521.1|      MIHQPLGGMQGQAADMEIHARRIIQMREKLNQIMAERSGQPYERIARDTDRDNFMTAEQA
ref|ZP_02171648.1|    MIHQPLGGAQGQASDIEIHAKRIVEMKEKLNQILAERTGQDIEQIRKDTDRDNFLSAAQA
RAAC00088             MIHQPLGGARGQASDIEIHARHILKTRERLNRILAERTGQPLERVAQDTDRDNFMSAEEA
ref|ZP_02848186.1|    MIHQPLGGVRGQASDIKIHADWILKTKQKLNEIYVERTGQPYEKIDRDTDRDNFMSAEDA
ref|ZP_02210735.1|    MIHQPLGGAKGQATDIEIHAKWILKIKERLNKILSERTGQPIEKIQEDTERDNFMSAQEA
                      ******  :*:*::**:   *::  :: **.*  :  *::.:**:* .* ref|NP_244431.1|      REYGLIDKVI--
ref|YP_176521.1|      KEYGLIDKVI--
ref|ZP_02171648.1|    KEYGLIDEVM--
RAAC00088             KAYGLIDEVIYR
ref|ZP_02848186.1|    LNYGLIDKVI--
ref|ZP_02210735.1|    KEYGLIDEVI--
                        *****:*:
```

FIG. 168

```
ref|YP_146448.1|      --ERSIALYCRVSTDEQAREGISLDEQQERLKAYCRAMGWSEEPLLFIDDGYSAKNLDRP
ref|ZP_02848045.1|    ---RFVALYCRVSTDEQAREGVSLDEQVERLKAYCRAMGWSEQVQIYIDDGYSAKNLDRP
ref|NP_977168.1|      -SSQFIALYCRVSTDDQAKEGVSLEEQQERLEAYCRAMGWGEDVVVYVEDGYSAKSTDRP
ref|ZP_02261191.1|    -SSQFIALYCRVSTDDQAKEGVSLEEQQERLEAYCRAMGWGEDVVVYVEDGYSAKSTDRP
RAAC00111             MTERHLALYVRVSTEEQAASGHSLREQEEQLVEYARSHGFPR-YELYCDDGYSGKSLNRP
ref|NP_981890.1|      -SKRRVATYIRVSTEEQANEGFSLGAQEDYLKQYANTKGYEV-YDIYIDDGYSGKDYNRP
                        : *:*  ****:**  .*  **     * : *    *..: *:      :: :****.*. :**

ref|YP_146448.1|      ELNRLLKEVKKGTISKILVTKLDRLSRRLLDLLKLIDMFQEHNVSFISISES-FDTNTPS
ref|ZP_02848045.1|    ELKRLLHAVKSGAVSRIMVTKLDRMSRRLLDLLNIIDLFQDHEVSFVSISES-FDTNTPS
ref|NP_977168.1|      HLKRLIEDVKAGEIKKIIVTKLDRMSRKLLDLLTLIDLFQEHDVSFVSISES-FDTNTPS
ref|ZP_02261191.1|    HLKRLIEDVKAGEIKKIIVTKLDRMSRKLLDLLTLIDLFQEHDVSFVSISES-FDTNTPS
RAAC00111             AMERLRADIRAGCVLGVVTTRIDRLTRSVADFARLVDEMNLHGVFYRSTRQN-FEISTAM
ref|NP_981890.1|      EIQRLFKDLYQEKFTGILVKSVDRISRRVSDVTKLIDDVLAPRKCYVLVSDNNLDSSTTG
                       ::**     :          :::.. :**::*  : *.  ::*  .         :. :: .*.

ref|YP_146448.1|      GRLTLQVLGAVAEFERERIRERVFENMLHAARQGKWLTQSPYGYRLQNKELVIYEPEAQI
ref|ZP_02848045.1|    GRLTLQVLGAVAEFERERIRERVFENMLHAATTCKWLTQSPYGYDLVDKSLVVNIVESQI
ref|NP_977168.1|      GRLTLQVLGAVAEFERERIRERVFENMYHAASKGKWLTQHPFGYRLENKELVTYENEAKI
ref|ZP_02261191.1|    GRLTLQVLGAVAEFERERIRERVFENMYHAASKGKWLTQHPFGYRLENKELVIYENEAKI
RAAC00111             GRLVAQMLSVIAEFEREMIAERVHENLLAMAQRGELATKPPFGYRLVNGRLTPDPREARW
ref|NP_981890.1|      GTAFIQLLATFAEYERSMIVQRVKAGMSKRAELGYWNGGHVLGYDVKNKELKVNKEEAEV
                      *  :  *:.**:***. * :**   .:   *  *              **  : *     *:.

ref|YP_146448.1|      VRNVYDWYLNKGLGYYAIAKKLNEEGIPSRQKKEWSIRAIKLMLTNPVYKGTLFWNRMDS
ref|ZP_02848045.1|    VKRVYDMYLNEGLCFYSIAKRLNEEGVPSRHRKEWSIRAIKLMLTNPAYKGTLVWNRKDS
ref|NP_977168.1|      VRDIFIWYTQEGHGFYAIAKKLNLLGIPSRQNKQWSIRSVKLLLLSNPVYKGTVVWNRKDR
ref|ZP_02261191.1|    VRDIFIWYTQEGHGFYAIAKKLNLLGIPSRQNKQWSIRSVKLLLLSNPVYKGTVVWNRKDR
RAAC00111             VREG  ARLLLTGASPRDVAMEFNALGVRTKTGRLWTDRTVRTLFSNPALAGVSVWNRRKT
ref|NP_981890.1|      VRKIFHLRT-EGKGYKSIALILNQQGFKTKRGRLFSIGTIKTILENPLYIGYCRWGRHKN
                      *:          . *   :*  :*    *.::   : ::   ::: :: **    *  *.*  .

ref|YP_146448.1|      SKSKRVKKDDADWVVLEDACPAIIDQATWEQVQKR--VNK-KQMAPRAQTSPHLLGGLLK
ref|ZP_02848045.1|    SKTQRKDKDEAEWVSVEECLPVIIDQPMWDKVQQR--INQPSNIAPRAKTSPHLGGMLR
ref|NP_977168.1|      SKKKEQFKKEDEWVIQENAAPAIVTDELWNEAQKR--MQT-STLAPRAQTSPHLLGGLLK
ref|ZP_02261191.1|    SKKKEQFKKEDEWVIQENAAPAIVTDELWNEAQKR--MQT-STLAPRAQTSPHLLGGLLK
RAAC00111             QGSRRTEREPTEWVCVEGAHEAILSREEFEALRGM--LERRRALSPRSQGSKRPLAGIAR
ref|NP_981890.1|      WNVERRKGKTDEYKFVKGKHEPIVSEDLWKRVQGVNYAHKKSISKNRNFNGEFVLSGILR
                      ..  .   .  ::   :     *:      :.    :        *   .    *.*:  :

ref|YP_146448.1|      CGRCGSGMSIGWSGSAKNRYR----VYRCSANKNKGTCTSKQYRADDVESWFKHGLLKIA
ref|ZP_02848045.1|    CGNCGSGMSIGFSGSPNKRYR----VYRCSANKNKGTCTSKQYRA---------------
ref|NP_977168.1|      CGKCGSGMSIGWSGSTKNRYR----VYRCSANKNKGTCTSKQYKA---------------
ref|ZP_02261191.1|    CGKCGSGMSIGWSGSTKNRYR----VYRCSANKNKGTCTSKQYKA---------------
RAAC00111             CGFCGSAMYAGWQVSKRGHERQKRPIYRCGRYVTGGGCTPNQVDASALEMLVVEELLRRV
ref|NP_981890.1|      CPSCGAGM
                      *  **:.* ref|YP_146448.1|      DSINSQMIPHLIQKAAENEESTIEQKIRTAKNRYKRKVEAYTAGLIELEDLNEEKKRMEQ
ref|ZP_02848045.1|    ------------------------------------------------------------
ref|NP_977168.1|      ------------------------------------------------------------
ref|ZP_02261191.1|    ------------------------------------------------------------
RAAC00111             RPELEPVVSAYRAHAASNELRTVQRKRRVALARLSRLAEAYASGVVSEFAFSREQVRLLR
ref|NP_981890.1|      ------------------------------------------------------------ ref|YP_146448.1|      II----------------------------------------------------------
ref|ZP_02848045.1|    ------------------------------------------------------------
ref|NP_977168.1|      ------------------------------------------------------------
ref|ZP_02261191.1|    ------------------------------------------------------------
RAAC00111             VLEACREAEAQAALSTTDGWDAWVRELCARLAGDPHLERALFLTVVREVRVFRPKRSRE
ref|NP_981890.1|      ------------------------------------------------------------ ref|YP_146448.1|      ------------
ref|ZP_02848045.1|    ------------
ref|NP_977168.1|      ------------
ref|ZP_02261191.1|    ------------
RAAC00111             VDVDLVLRLE
ref|NP_981890.1|      ------------
```

FIG. 169

```
ref|ZP_01236658.1|    ---------RAFLKWAGGKYSLVEDIKRHLPPARKLVEPFVGAGSVFLKTDYDHYLLADI
ref|ZP_01161642.1|    ---------RAFLKWAGGKYSLVEDIKRHLPPARKLVEPFVGAGSVFLKTDYDHYLLADI
ref|ZP_01221581.1|    ---------RAFLKWAGGKYSLVEEIQRHLPPARKLVEPFVGAGSVFLKTDFEQYLLADI
ref|YP_128524.1|      ---------RAFLKWAGGKYSLVEEIQRHLPPARKLVEPFVGAGSVFLKTDFEQYLLADI
ref|ZP_01898092.1|    ------MQKTRAFLKWAGGKYSLVDHLREKLPAGKRLVEPFVGAGSVFLNTDYDEYLLNDI
RAAC03161             MEVQFMTVLRSYLQWPGGKSHIVTALRAFLPPGRRLIEPFVGAGSVFLNANYPEYLLGDA
                            *::*:*.***   :*   ::   **..::*:***********::: .* * ref|ZP_01236658.1|    NPDLINLYNILKHEPERYIEDARKLFTPEYNNKEAYLKIREEFNASDDPYLRSLYFLYMN
ref|ZP_01161642.1|    NPDLINLYNILKHEPERYVEDARKLFTPEYNNKEAYLKIREEFNASDDPYLRSLYFLYMN
ref|ZP_01221581.1|    NPDLINLYNILKDDPEKYVEDVRKLFTPEFNQKEEYLKIREEFNKTQDPYVRSLYFLYMN
ref|YP_128524.1|      NPDLINLYNILKDDPEKYIEDVRKLFTPEFNQKEEYLKIREEFNKTQDPYVRSLYFLYMN
ref|ZP_01898092.1|    NPDLINMYKILQHKFLQFTADAQRFFTPEFNDKERYYKIREKFNKTSNPYQRSLMFLYMN
RAAC03161             NGDLILTHQMLQAHGEAFIEACRDLFVPENNTPDRYYELRDEFNSTADPWRKAILFVYLN
                      * ***  :::*:  . *  ::     :  :*.**  *   : * ::*::** : :*:  ::: *:*:* ref|ZP_01236658.1|    RHGFNGLCRYNKKGGFNVPFGSYKKPYFPEAEMYYFSEKAKRATFVCEGYLQTFSRARKG
ref|ZP_01161642.1|    RHGFNGLCRYNKKGGFNVPFGSYKKPYFPEAEMYYFSEKAKRATFVCEGYLQTFSRARKG
ref|ZP_01221581.1|    RHGFNGLCRYNKKGGFNVPFGSYKKPYFPEKEMYFFAEKAKRATFVCEGYQQTFSRARKG
ref|YP_128524.1|      RHGFNGLCRYNKKGGFNVPFGSYKKPYFPEKEMYFFAEKAKRATFVCEGYQQTFSRARKG
ref|ZP_01898092.1|    RHGFNGLCRYNKSGGFNVPFGSYKKPYFPLKELRFFAEKSKKATFICESYSDVYKRLGSD
RAAC03161             RHGFHGLCRYTRNGDFNVSFGYRKTVYFPEEMRYFAEKAKQATFVCADFRDLLERVEPG
                      ****:*****.:.*.***.**  *:. ***   *: :*:**:*:***:*  .: :  .*   .

ref|ZP_01236658.1|    CVVYCDPPYAPLSSTANFTSYSGNGFSLDDQATLADVAEKAAAERDIAVLISNHDTALTR
ref|ZP_01161642.1|    CVVYCDPPYAPLSSTANFTSYSGNGFSLDDQATLADVAEKAAAERDIAVLISNHDTALTR
ref|ZP_01221581.1|    CVVYCDPPYAPLSTTANFTSYAGNGFSLDDQADLADVAEKAATEREIPVLISNHDTKLTR
ref|YP_128524.1|      CVVYCDPPYAPLSSTANFTSYTGNGFSLDDQADLADVAEKAATEREIPVLISNHDTKLTR
ref|ZP_01898092.1|    DVVYCDPPYAPLSRTASFTSYSASGFSLDDQALLAKVSRETSQERNIPILISNHEDIPLTR
RAAC03161             DVVYCDPPYVPLSRTSNFTEYAPTRFSWRDHTQLAGYAQALT-ERGVTVVISNERRPAVE
                      ********.***  *:.**.*:  . **  *:: **  :.   : ** :.::****   ..

ref|ZP_01236658.1|    RLYTGADLSVVKAKRTIS-RNGSGRNKVDELLAIF---
ref|ZP_01161642.1|    RLYTGADLSVVKVKRTIS-RNGSGRNKVDELLALF---
ref|ZP_01221581.1|    RLYHGADLSVVKVRRTIS-RNGSGRNKVDELLALFKS-
ref|YP_128524.1|      RLYHGADLSVVKVRRTIS-RNGSGRNKVDELLALFKS-
ref|ZP_01898092.1|    ELYHGSTFEVVQVKRTIS-RNAGKRNKVDELLALYR--
RAAC03161             SLYRGAEIHVVEAPRNIVNRYRQATHVIEELIAVFRAL
                      ** *: : **:.  *.*   *    : ::**:*:::
```

FIG. 170

```
ref|YP_001567845.1|   ------------------------------------------------------------
RAAC03110             MTSLSQGRRAIGLRYPGHDTLECASQLQALSRAVKQAYGGEASAARMTSRDNIGEAHVTA
gb|ACA00199.1|        ------------------------------------------------------------
ref|NP_490383.1|      ------------------------------------------------------------
ref|YP_319960.1|      ------------------------------------------------------------
ref|ZP_01731959.1|    ------------------------------------------------------------ ref|YP_001567845.1|   --------------RVFVLDKNKQPLMPCHPARARELLKKGKAAVFRYHPFTIILKDR-EG
RAAC03110             ERRDEEVTLMRQNRVLVLDTHRRPLMPCHPARARQLLKAGRASVFRRYPFTIILHDR-NG
gb|ACA00199.1|        --------------RVLVLDKNRQPLMPCHPARARQLLRRGKAAVFRRFPFTIILKDR-ES
ref|NP_490383.1|      --------------KVFVIDNEKRSLNPIHPAQARQLLKRGKAAVFRRFPFTIVVKESYTD
ref|YP_319960.1|      --------------KVFVINKEKRPLNPIHPAQARQLLRSGKAAVFKRFPFTIIVKESNVN
ref|ZP_01731959.1|    --------------VFVLSKDKRPLSPCHQARARKLLKQGKAAVYRKYPFTIILKEEVNP
                                     *:*:...::.* *  *  *:**:**: *:*:*:: .****:::

ref|YP_001567845.1|   GDTQPIQVKIDPGSKITGVTLVGDFKN-GKKVIWGAEIHHRGQSIKKALDTRRGVRRSRR
RAAC03110             GDVQPMQLKLAPGSKTGVALVADFQR-GKTVVWAAEIQHRGDQIRQALLRRRMLRRSRR
gb|ACA00199.1|        GVTQPTVLKLDPGSNTTGLALVADFARRGKVLVWAAELRHRGAAIRKALADRRAIIRRFRR
ref|NP_490383.1|      ATVSPLRLKFDPGAKYTGIALVNDVNG---EVVFAAELKHRGFAIRDALTSRRQLRRSRR
ref|YP_319960.1|      TNVSPLRLKLDPGAKTTGIAIINDAND---EVVFAAELKHRGFATRDAITSRRQLRRSRR
ref|ZP_01731959.1|    NKPKPCRIKLDPGAKVTGIALIQ--GD---RVIFGAELEHRGFRIKDSLESRRQLRRGRR
                        . *  :*: **:: **::::    :::.**:.*** *:.:: ** ** **

ref|YP_001567845.1|   NRKIRYRIARFDNRKRSKGWLPPSLISRVENILTWIKRIRRFSPITGISLELVRFDTQKL
RAAC03110             YRKTRYRKPRFDNRRRLEGWLPPSLMSRVHNIETWVARLRRWAPITHLSMQLVSFDTQKL
gb|ACA00199.1|        -FKLRYRPARFNNRTRPSGWLAPSLQHRVDTTMTWVQRLMRWTPVTSLSQELVRFDTCAM
ref|NP_490383.1|      SRKTRYRQPRFFNRTRPQGWLAPSLQSRVENIKTWVNRLRKVAPITAISQELVRFDTQLI
ref|YP_319960.1|      NRKTRYRQPRFLNRTKPEGWLAPSLQSRVFNTKTWVSKLRKVAPITAISQELVKFDMQLI
ref|ZP_01731959.1|    GRKTRYRKPRFLNRTRPKGWLPPSLQSRVENINTWVNRLRKLCPVDSISVELVRFDTQQL
                        * ***   ** **  :   .***:*** ** ..  **: :: : *: ::*  **  * :

ref|YP_001567845.1|   QDPEINGIEYQRGTLYGYEIKEYLLEKWGRKCVYCGKENVPLEIEHIVPKSKGGSDRISN
RAAC03110             QYPEISGEEYQQGTLYGYEVREYLLEKWGRKCAYCGAENVPLEIDHVIPRSGGSDRVSN
gb|ACA00199.1|        QNPEISGVEYQQGTLFGYEVREYLLEKWVRKCAYCDAENVPLTIDHIHPRSKGGSNRVSN
ref|NP_490383.1|      RHPDIQGKEYQQGTLAGFETRQYFLEKWNRECAYCGIKDVPLQIEHIHPKSKGGSNSITN
ref|YP_319960.1|      RRPDIQGKEYQQGTLAGFETRQYFLEKWNRECAYCGIKDVPLQIEHIHPKSKGGSNSITN
ref|ZP_01731959.1|    ENPEISGVEYQQGTLFGYEVREYLLEKYNRTCQYCGAKEVPFEIEHIVPKSKGGSDRVSN
                      . *:*.* *:* *:*  :::*: * * **.  :::*: *:*: *:*;****: ::* ref|YP_001567845.1|   LTLACHECNQKKGNQSIEEFLTNNPERLKQIKSESKRPLKDTAALNATRWYIFNQLRGNS
RAAC03110             LVLACHRCNQAKANRPVEEFLAHDQERLHRIQAQLKLSLRDAAAMNATRWAVFRRLKDT-
gb|ACA00199.1|        LTLACFPCNQRKGNQDIKNFLKKDKSRLEKILALTKKSLADAAAVNTTRFALLEVLKST-
ref|NP_490383.1|      LTLSCEKKCNLKKGTQDIKNFLKKDKSRLEKILALTKKSLADAAAVNTTRFALLEVLKST-
ref|YP_319960.1|      LTLSCEKCNLRKGNQDIRDYLEKDKPRLEKILALTKKPLADAAAVNATRFALLYALKST-
ref|ZP_01731959.1|    LTLSCHKCNQKKGNRSVEEFLKGKPEVLKRVKANAKKPLRDAAAVNAARWAVFNRLKAS-
                      *.*:*   **  *...: :   ::*    * ::   :   .* *:**:*:  *:    * .

ref|YP_001567845.1|   LTAGKEELPIEVGTGGRTKYNRETQNYPKKUWIDAACVGESGQNVQIEPDMQVLEIKAMG
RAAC03110             ------GLPVEAGSGGRTKYNRFSQGYPKAKWIDAACVGESGQCVRLDTQMQVLTIVAKG
gb|ACA00199.1|        ------GLDVEVGTGGRTKRNRSQQQYPKEHWIDAACVGESGANVRLDPTHKPLAIQAMG
ref|NP_490383.1|      ------GLPVEIGSGGLTKFNRTQQGLNKSHWLDACCVGASTP-ILKIKGIRLLLITANG
ref|YP_319960.1|      ------GLPIETGSGGLTKFNRTQQALNKSHWLDACCVGASTP-ILKIKGIKPLLITANG
ref|ZP_01731959.1|    ------GLEVEAGSGGLTKFNRTKHELPKTHWLDAACVGKSTPSKLRMLVQKPLKIKATG
                            * :* *:  **  :    * :*:.*  *       : * *** * ref|YP_001567845.1|   HGMRRMCFVDKYGFPKKYRPKERTYMGCYKTGDIVLAVIPKGKNMGIHIGRIAIRHRPSFL
RAAC03110             HGKRQRCITDKYGFPRSHAPSSRSYMGFRTGDLVQAHVPRGKYAGTHVGRIVIRHRPSFQ
gb|ACA00199.1|        HGERQRARLNRYGFPRGYKLRARSYLGFRTGDVVFCAKPK---TEVFAGRVAIRFRPSFV
ref|NP_490383.1|      HGTRQSCRTDKYGFPIRHCSRTKFHFGFQTGDIVKAVVTKGKKIGTYIGRIATRATGSFN
ref|YP_319960.1|      HGTRQSCRTDKYGLPVRIICSRTKFHFGFQTGDIVKAVVTKGKKVGTYVGRIATRATGSFN
ref|ZP_01731959.1|    HGTRQMCRTNKYGFPTRYVPHKKDVKGFQTGDIVKAVVTKGKKTGIYVGRVAVRSTGSFN
                      ** *:  .  ::*:*:*     :   *:;****:*  . .:     .**:. *   ** ref|YP_001567845.1|   LNGVG----DVHPKYLTLLQKNDGYGY---
RAAC03110             LNGF-----NVHPKYLKVLQRGDGYGYAME
gb|ACA00199.1|        VTGAD-RKVESHPKYLSMIQKGDGYAYA--
ref|NP_490383.1|      ISTVQGLIQCISHKYCKTIHKKDGYAYAI-
ref|YP_319960.1|      ISTAKGLIQGISHKYCKTIHKKDGYAYGI
ref|ZP_01731959.1|    ISTAKGVIQGINHKYCRQIHKKDGYSYA--
                      :.           **  :::  ***.*
```

FIG. 171

```
ref|NP_852746.1|        ------------IRTLAINNEPWFIAKDVCDAIGIDNNRKALLALDEDEK GVTLSNTL
ref|YP_853610.1|        -----------FESQADIRVIVINGEPWFIASDVCRAIGIANHRDAVRKLDDDEK-GVASTDTP
emb|CAP00374.1|         --------FEQNSQIRIIMINSNPWFVAKDICDALGLSNHRDAISKLDKDEK-GVALTDTL
ref|ZP_01959153.1|      ----------NSTPIRVQVINNEPWFVAKDVCDVLGISKYRDAIARLDDDEG-CPIEVDTL
ref|YP_001038857.1|     -----------GKQVRTFIIDGEPWWVAKDVCDILELGDTHKAMERLDEDERNTIPVTDSL
RAAC03810               MQQTWAVFANGTQVRVFWVDGEPLFDAMGVCEAVGLRNVEKALRRLDDDEQ GSVILEGL
                                  :*    ::.:* : * .:*   :  :  . ..*:  **.**       :

ref|NP_852746.1|        GGKQEMNIISESGMYTLILRCRDAVKKGSVPHRFRKWVTAEVLPAIRKTGKYEAKTTVDD
ref|YP_853610.1|        GGEQESIIISESGLYTLILRCRDAVTPGTIPYRFRKWVTGEVLPQIRRTGSYIKNSLPQE
emb|CAP00374.1|         GGQQELSVINESGMYALVMRSRDAMKEGTPQHKFRKWVTSEVLPSIRKTGKYEAP-----
ref|ZP_01959153.1|      GGMQKMAAVNESGLYTLILQSR---KPEAKP--FRKWVTSEVLPSIRKKGYYG-------
ref|YP_001038857.1|     GRLQETYVVNEAGLYNLILGSR---KQEAKE--FKRWITHEVIPQIRKTGIYALEPKQL-
RAAC03810               DGREEIHVVRESGMLRLSLVGK-----DEHARALQRWATREVLPSVIRTGRYGEPDIEQE
                          : ::  : *:*: * :  :          :::* * **:*  : :.* * ref|NP_852746.1|        RTGLRNA-----------------------------
ref|YP_853610.1|        E-------------------------------
emb|CAP00374.1|         --------------------------------
ref|ZP_01959153.1|      --------------------------------
ref|YP_001038857.1|     --------------------------------
RAAC03810               QLQLQKATLLFNTLAMFRDRLFDETVQNLANAMADVLRG
```

FIG. 172

```
emb|CAP00374.1|         ----------------------FEQNSQIRIIMINSNPWFVAKDICDALGLSNHRDAISKL
ref|NP_852746.1|        ----------------------IRTLAINNEPWFIAKDVCDAIGIDNNRKALLAL
ref|ZP_01959153.1|      ----------------------NSTPIRVQVINNEPWFVAKDVCDVLGISKYRDAIARL
ref|YP_001038857.1|     ----------------------GKQVRTFIIDGEPWWVAKDVCDILELGDTHKAMERL
ref|ZP_02327844.1|      --------GKETNHMNQLQVFNFTGKDVRVVVKDGHPWWVAKDVSELLGFRMASDFTRTL
RAAC03316               MSCTTHSIGRRRSPMQQTWAVFANGTQVRVFWVDGEPLFDAMCVCEAVGLRKVEKALRRL
                                                :*       :..* : *  .:.:  :  :        * emb|CAP00374.1|         DKDEKGVALTD-TLGGQQELSVINESGMYALVMRSRDAMKEGTPQHKFRKWVTSEVLPSI
ref|NP_852746.1|        DEDEKGVTLSN-TLGGKQEMNIISESGMYTLILRCRDAVKKGSVPHRFRKWVTAEVLPAI
ref|ZP_01959153.1|      DDDEGCPIEVD-TLGGMQKMAAVNESGLYTLILQSRKPEAKP-----FRKWVTSEVLPSI
ref|YP_001038857.1|     DEDERNTIPVTDSLGRLQETYVVNEAGLYNLILGSRKQEAKE-----FKRWITHEVIPQI
ref|ZP_02327844.1|      DDDEKDTQIVR-TPGGNQEVTIINESGLYSAILKSRKPEAKQ-----FKRWVTHEVLPAI
RAAC03316               DDDEQGSVILE-GLDGREEIHVVRESGMLRLSLVGKDEHARA-----LQRWATREVLPSV
                        *.**          .  ::   : *:*:   :  :.   .      :::* * **:* :

emb|CAP00374.1|         RKTGKYEAP---------------------------------------
ref|NP_852746.1|        RKTGKYEAKTTVDDRTGLRNA---------------------------
ref|ZP_01959153.1|      RKKGYYG-----------------------------------------
ref|YP_001038857.1|     RKTGIYALE------PKQL-----------------------------
ref|ZP_02327844.1|      RKTGMYATDELLDDPELLIQAVTKL-----------------------
RAAC03316               IRTGRYGEPDIEQEQLQLQKATLLFNTLAMFRDRLEDETVQNLANAMADVLRG
                         :.* *
```

FIG. 173

```
ref|YP_148854.1|        ------------------------------DRNDVMRVVEVEPLLALYLYTPLCGTCQLARRM
ref|YP_001127043.1|     ----------------------PIERTEIQQTITEQPLMALYLYTPLCGTCQLAKRM
ref|YP_080555.1|        ----------------------------------LKRLEHETCL-LYVYTPFCGTCQLAGRM
ref|NP_693306.1|        -----------------------------------------VI--YIYTPFCGTCSVARAM
RAAC03018               MVRANVQGPRQVHTEGRRIPMFTPFPGDRPEALGTLPHEALV--FVHTPLCGTCQLARRM
ref|ZP_02170973.1       ---------------------------------KGVL--FLHTPLCGTCKMAGQF
                                                         :  :::**:****.:*  :

ref|YP_148854.1|        LTVVEQLF-PALPFYETDINYIPEQAVAWKIESVPCLLFRDGTVAGKWYAFHSVPYLYE
ref|YP_001127043.1|     LTVVEELF-PALPFYETDVNYIPEQAVVWKIESVPCLLFVDGTMVGKWYAFHSVPYLYE
ref|YP_080555.1|        LEVVDEMM-KDIPFYKNNLNYSPSFAKQQEIESVPCFILYKKGRVVKKEYAFHSVSYLYD
ref|NP_693306.1|        LENIERLHRQDI-FYEMNAAVHPEYMHDNQIESVPCLLFVENGEIVERIYTFYSTANIYD
RAAC03018               LEVVDAAHTNRLPLYDLDANLAPEAMQSWKIESVPALLYVKNGEIAHVQYRFGDVVDLAD
ref|ZP_02170973.1|      LQTAEQTP-DIPEIFSMDLNMAPHIAKDWKIESVPCLVVIDDGNVTDRMYAFKSIPDI--
                        *     :       ::. :    *       :*****.::  .* :.   * *  .  :

ref|YP_148854.1|        VIQACL--
ref|YP_001127043.1|     EIQARLER
ref|YP_080555.1|        TIKQNL--
ref|NP_693306.1|        YLIQY---
RAAC03018               AIRQFLER
ref|ZP_02170973.1|      --------
```

FIG. 174

```
ref|YP_001178926.1|     -----FPAVFEPGENGGYCVTFPDLPGCITEGETLEEALYMAKEALELHLYGLEEDNEEI
ref|YP_001211485.1|     -----FPAIFEVGEIKGYCVTFPDLPGCITEGNTLEEALQMAKEALELHLYGMEEDEDEI
ref|YP_001180877.1|     -----FPAIFEPAEKEGYVVTFPDLPGCITEGKNLEEALYMAKEALELHIFGLEEDGEEI
ref|YP_001219837.1|     -----YPALFEAYEDGGYTVSFPDLPGCITEGDSLTEALTMAKEALELFLWNMEDDNEEI
ref|YP_001211518.1|     -----YPAIFDYAED-GISVEFPDLPGCYTCGDNDEEALRMAKEALALHLYGLEEDGFPI
RAAC02718               MATRGYPAIFDPYEDGSFVVLFPDFPGCVTQGCNLDDAVAMAEEALTLQLYGIERDGEDL
                             :**:*:   *  .  * ***:*** * * .   :*: **.*** * ::.:* *   :

ref|YP_001178926.1|     PEPTPPEKLDIP--------------------
ref|YP_001211485.1|     PSPTPPERVDVPEKGF----VAIVEARMPL---
ref|YP_001180877.1|     PEPTPPEKLNV---------------------
ref|YP_001219837.1|     PEPTPPEKI-----------------------
ref|YP_001211518.1|     PEPSPASRIKVEPNQV----------------
RAAC02718               PEPSDPSHVTVPEEVQGQWFVMLIHPRPELFHP
                        *.*:  ..::
```

FIG. 175

```
ref|YP_001035109.1|    ----------------------------------------MAQLYYKYGTMNSGKTIEILKVA
ref|YP_001450442.1|    ----------------------------------------MAQLYYKYGTMNSGKTIEILKVA
ref|ZP_01818216.1|     ----------------------------------------MAQLYYRYGTMNSGKTIEILKVA
ref|ZP_01830009.1|     ----------------------------------------MAQLYYRYGTMNSGKTIEILKVA
ref|ZP_01819917.1|     ----------------------------------------MAQLYYRYGTMNSGKTIEILKVA
RAAC01115              MERLARDDGHSARRLVRARGRVTCAITRSREPERGIDVAKLYFRFGQMNASKSIQLLTVA
                                                               :*:**::* **:.*:*::*.**

ref|YP_001035109.1|    HNYEEQGKSVVIMTSAVDTRDGFGVVSSRIGMKRNAIAIEDQTDIFGYIQQLPEKPYCVL
ref|YP_001450442.1|    HNYEEQGKGVVIMTSAVDTRDGVGYVSSRIGMKRQAMAIEDDTDILGYIKNLPEKPYCIL
ref|ZP_01818216.1|     YNYEEQGKGVVIMTSALDTRDGVGYVSSRIGMKRPALAIEETTDIFGYIRDLPEKPCCVL
ref|ZP_01830009.1|     YNYEEQGKGVVIMTSALDTRDGVGYVSSRIGMKRPALAIEETTDIFGYIRDLPEKPYCVL
ref|ZP_01819917.1|     YNYEEQGKGVVIMTSALDTRDGVGYVSSRIGMKRPALAIEETTDIFGYIRGLPEKPYCVL
RAAC01115              HSYEEQGKKVALFTPAIDDRYGRGVIASRVGIAKRAVVVEEDTDLFACVR--AQMPDCVL
                       :.****** *.::*.*:* * * * ::**:*: : *:..:*: **::. :: .: * *:* ref|YP_001035109.1|    IDEAQFLKRHHVYDLARVVDELDVPVMAFGLKNDFRNELFEGSKHLLLLADKIEEIKTIC
ref|YP_001450442.1|    IDEAQFLKRHHVYDLARVVDELDVPVMAFGLKNDFRNELFEGSKHLLLLADKIEEIKTIC
ref|ZP_01818216.1|     VDEAQFLKRHHVYDLARVVDELDIPVMAFGLKNDFRNELFEGSKYLLLLADKIDEIKTIC
ref|ZP_01830009.1|     VDEAQFLKRHHVYDLARVVDELDIPVMAFGLKNDFRNELFEGSKYLLLLADKIDEIKTIC
ref|ZP_01819917.1|     VDEAQFLKRHHVYDLARVVDELDIPVMAFGLKNDFRNELFEGSKYLLLLADKIDEIKTIC
RAAC01115              VDEVQFLRAYHVRQLARVADDLDIPVIMYGLLKDYRNRLTEGSEAAILWADRIEEIKTIC
                       :.*: : :**.*::: :** :*:.***:   :* **:*:****** ref|YP_001035109.1|    QY--CSRKATMVLRTDNGKPVYDGEQIKIGGHETYISVCRKHYFNPDIK--------
ref|YP_001450442.1|    QY--CSRKATMVLRTDHGKPVYDGEQIQIGGNETYIPVCRKHYFKPDI---------
ref|ZP_01818216.1|     QY--CKKKATMVLRTQDGLPVYDGEQICIGGNETYISVCRKHYFAPEI---------
ref|ZP_01830009.1|     QY--CKKKATMVLRTQDGLPVYDGEQICIGGNETYISVCRKHYFAPEI---------
ref|ZP_01819917.1|     QY--CKKKATMVLRTQDGLPVYDGEQICIGGNETYISVCRKHYFAPEI---------
RAAC01115              AHPGCDRKATMILKVKDGRPVYECEQIEVGGNDLYKSVCRKHYFHPDVEGLMRATGP
                       :  *.:****:*:..* ***:****:**:: * .******  *::
```

FIG. 176

```
ref|NP_622644.1|       ------------------------------------------------------------
ref|YP_001664955.1|    ------------------------------------------------------------
ref|ZP_02616274.1|     ------------------------------------------------------------
ref|YP_001255422.1|    TEINCLSTRIDIUMBTULINUMASTRATCCGBABSGLYCERPHSPHRYLDIESTERPHSP
ref|YP_076287.1|       ------------------------------------------------------------
RAAC01119              ------------------------------------------------------------ ref|NP_622644.1|       ------------------------------------------------------------
ref|YP_001664955.1|    ------------------------------------------------------------
ref|ZP_02616274.1|     ------------------------------------------------------------
ref|YP_001255422.1|    HDIESTERASEFAMILYPRTEINCLSTRIDIUMBTULINUMASTRHALLSCRESIGNIFI
ref|YP_076287.1|       ------------------------------------------------------------
RAAC01119              ------------------------------------------------------------ ref|NP_622644.1|       -----------------------------TLVIAHRGDSKNVPENTIAAFKRAMELGADG
ref|YP_001664955.1|    ------------------------------LVIAHRGDSRNAPENTLASFKSALEMGADG
ref|ZP_02616274.1|     -----------------------------TKILAHRGASAYAPENTMAAFKKAIEMNADG
ref|YP_001255422.1|    CANCEE-IDENTITIESPSITIVESGAPSTKILAHRGASAYAPENTMAAFKKAIEMNADG
ref|YP_076287.1|       --------------------------------IGHRGAAGTHPENTMVSFRRAFELGVDG
RAAC01119              -------------------MIRELLMRDDTLFIAHRGASAECPENTLPAFVRAAELGADM
                                                     :.*** :    ****: :*  * *:..* ref|NP_622644.1|       IELDVQLTKDGHLVVIHDETVDRTTNGEGFVKDFTLEEIKKLDAGIKFGEKFAGERIPTL
ref|YP_001664955.1|    IELDVQLTKDGQLVVIHDERVDRTTDGIGFVKDFTLKELKRLDAGIKFDKKFAGERIPSL
ref|ZP_02616274.1|     IELDVHLSKDGYIVIIHDERVDRTTDGKGEVKDFSLYELKKLDAGSWFSDEYKDEKIPTL
ref|YP_001255422.1|    IELDVHLSKDGYIVIIHDERVDRTTDGKGEVKDFSLDELKKLDAGSWFSYEYKDEKIPTL
ref|YP_076287.1|       IEFDVHRTADGHLVVIHDPAVDRTTDGSGLVMAMTLEQTRALDAGSWKDPRFAGERVPTL
RAAC01119              IELDVRLTGDGGVVVLHDPTVDRTTNGSGLAADMRLADLRKLDAGSWFDARFRGTLIPTL
                       **:**: : ** :*::**  *****:* * .  : * ::: ****    . .: .  :*:* ref|NP_622644.1|       YEVFELIGDKDFLVNIEIKSGIVLYP-GIEEKLIKAIKEYNFEERVIISSFNHYSLRDVK
ref|YP_001664955.1|    YEVFELIGHKNFIVNIEIKSGIVLYP-GIEEKLIKAIEDYDFEDRVVISSFNHYSLRDVK
ref|ZP_02616274.1|     EELLKLIKNTELYLNIEIKAGYRVYP-NIEEKVIAMIEKYKMLDRVTISSFDHYSLVRVK
ref|YP_001255422.1|    EELLKLIKNTEIYLNIEIKAGYRLYP-NIEEKVIAMIEKYKMLDRVIISSFDHYSLVRVK
ref|YP_076287.1|       QELVRATP-PGVRLYLELKAGSVHYP-GIEQELVDLLKAEGVLDRTQVSSFDHRALVKLK
RAAC01119              DEVFATVP--HMCLNIELKTSPVAHTRQLIRRVLGAIYRHNARDRVLISSFDHAALAEVR
                        *:.        . : :*:*:.   :.  : ..::  :       :*. :***:* :*  ::

ref|NP_622644.1|       KMAPHLKIGLLYQCGLVEPWHMAIRMEAYSLHPFYFNIIPELVEGCKKNGVKLFPWTVDR
ref|YP_001664955.1|    RMAPELKIGLLYQCGLVEPWHMAIRMKAYSLHPFYFNIIPELVEGCKKNNIKLFPWTVDR
ref|ZP_02616274.1|     EINSNIKTGMLYEAALYEPWEYARSIKVEALHPNYITLTKEFIDKAYINSFEVNSYTIND
ref|YP_001255422.1|    EINSNIKTGMLYEAALYEPWEYARSIKVEALHPNYITLTKEFIDKAYINSFEVNPYTIND
ref|YP_076287.1|       EICPELPLGMLTSSNLVDPVGMAKAIGCEALHPAWPWVTPEYVEAAHAAGLKVNCWTVND
RAAC01119              RFDRDIAIGVLFTGRLLEPIQLAERLGAQSLHPDIEHLDPLFVAEAKSHHLAVYAWTAKS
                       .:  .:  *:*    * :*   *  :   ::**      :      :   .    . :  :* .

ref|NP_622644.1|       KEDMERMIKAGVDGIITDD-------------------
ref|YP_001664955.1|    KEDMEMMIKAGVDAIITDD-------------------
ref|ZP_02616274.1|     ETNMKSLIKNKVTSII----------------------
ref|YP_001255422.1|    ETNMESLIENKITSII----------------------
ref|YP_076287.1|       PLALALMQNAGVDGIMTD--------------------
RAAC01119              ELAVNRALACQVSGIILDDLRLRQIATKAVPSPTPPSA
                           :        : .*:
```

FIG. 177

```
ref|YP_001433837.1|    ---------------------VFVTTS-RGLRRDSVPMRLFEKAKRLGVWNPSDIDFSQD
ref|YP_001276310.1|    ------------------------TTS-RGLRRDTVPMRLFEKAKRLGVWNPSDIDFSQD
ref|ZP_01514627.1|     ------------------------TTS-RGLRRNSPPMRLFEKAKQFGIWNPSLLDFSRD
ref|YP_001636906.1|    ------------------------TTS-RGLNRNSPPMRLFEKAKRFGIWNPSLIDLSRD
RAAC00203              MVGVEFDVLEATPMALTEMPRVFQTTSEKRLNHSILPMRLYHKAKKLGTWDPRDIDFTKD
ref|YP_001102862.1|    -------------------------LNWDSLPLRLFGKGN-AKFWDPADIDFTRD
                                                *.  *:**  *.:     *:*  :*:::* ref|YP_001433837.1|    MRDWQTLTDDERDLVLRLTSLFQAGEEAVTLDLLPLVATIAAEGRIEEELFLTSFLWEEA
ref|YP_001276310.1|    VRDWQTLTADERDLVLRLTSLFQAGEEAVTLDLLPLVATIAAEGRIEEELFLTSFLWEEA
ref|ZP_01514627.1|     IDDWNRLSDEERDLLLRLTALFQACEEAVTLDLLPLIKAIAHDGRLEEELFLTTFLFEEA
ref|YP_001636906.1|    IRDWEQLRDEERDLLLRLTALFQAGEEAVTLDLLPLIRTIAREGRLEEELYLTTFLFEEA
RAAC00203              KEDWQGMNEAERRVILRLCSLFVAGEEAVTLDLLPLIMAVARECRLEEEMYLTTFLFEEA
ref|YP_001102862.1|    AEDWQGLTEEERRSVAMLCSQFIAGEEAVTQDLQPFMAAMAAEGRFGDEMYLTQFCFEEA
                        :          :  *   * ****  *:: ::*  :**  :*::** * :*** ref|YP_001433837.1|    KHTDFFNRFLTEVAGVTGDLSHYHTAN--YRALIHEALPAAMERLRDDPSPEAQAIASLT
ref|YP_001276310.1|    KHTDFFNRFLTEVTGVTGDLSHYHTSN--YRALIHEALPAAMGRLRDDPSPEAQAIASLT
ref|ZP_01514627.1|     KHTDFFARFISEVARVDPDLSRYHTPS--YRALIYDALPRAMQRLEHDPSPFNLAEASLT
ref|YP_001636906.1|    KHTDFFARFISEVARVDPDLSRYHTAS--YRALIYEALPAALHRLDHDPSPLNLAEASLT
RAAC00203              KHTEVFRRFLDEVAGETSDLSVFHKDH--YRKIFYEYLPQAMGRLVEDPSPEAQAEASVT
ref|YP_001102862.1|    KHTQVFRLWMDAVG-LTGDLHSHVAENPGYRAIFYEELPRSLNALHDDPSPANQVRASVT
                       ***:.*    ::  *     .      ::::  **  ::   * .****    .*:* ref|YP_001433837.1|    YNMIVEGVLAETGYHAYFTMLERRNLMPGTRKGIGLLKQDESRHIAYGVYLLSRLINAEP
ref|YP_001276310.1|    YNMIVEGVLAETGYHAYFTMLERRDLMPGTRKGIGLLKQDESRHIAYGVYLLSRLINAEP
ref|ZP_01514627.1|     YNMIVEGVLAETGYHGYFTILDTHNLMPGVREGIRLLKQDESRHIAYGIYLLSRLIAADR
ref|YP_001636906.1|    YNMIVEGVLAETGYHAYFTILDSQDIMPGTREGIRLLKQDESRHIAYCVYLLSRLIATDP
RAAC00203              YNMVVEGVLAETGYYAFYTALQKENKLPGLIQAIRLLQRDESRHIGYGTYLLSRLISENA
ref|YP_001102862.1|    YNIVVEGTLALTGYFAWQKICRSRGILPGMQEVVRRIGDDERRHMAWGTFTCRRHVAADE
                       **  :***.** ***..:        ..  :**   :  :    ** **:.:*  :     *  :   :

ref|YP_001433837.1|    RLWDVVVERMNELVVYAMGVIDDAFACYEV--------------VPFGLSHDDFMQFAMG
ref|YP_001276310.1|    RLWDVIVERMNELVVYAMGVIDDAFACYEV--------------VPFGLSHDDFMIFAMG
ref|ZP_01514627.1|     QIWDHIVERMNELVIHAIGVIDEIFTSYDT--------------MPFGLQIETFSTFALN
ref|YP_001636906.1|    QVWDHIVERMNELVLYAMGVIDEIFACYDP--------------MPFNLQIETFSTFALN
RAAC00203              HIWDVVNRRINLLLPHAIGVVQDNAELDTEEAQRLAEELGTTDVPFGLNPDEFVAYAQK
ref|YP_001102862.1|    SNWDVVQEQMQHLLPLAVTQIQWRPEDAPEE-------------TPFRLDIDELAAYASD
                         **  :  .:::  *:  *:  ::              **  *.  :    :* ref|YP_001433837.1|    QFERRLDRIERARNQTVE---------------
ref|YP_001276310.1|    QFQRRLDRIERARDQTLESI------------
ref|ZP_01514627.1|     QFQRRLNRLELACQQSLAEI------------
ref|YP_001636906.1|    QFQRRLNRLELASRQSMNEI------------
RAAC00203              QFATRLGVLQRARGKSVDEIYYYTEETVGVEQ
ref|YP_001102862.1|    RAGRRLGAISAARGVPVEQI------------
                       :   **. :. *    .:
```

FIG. 178

```
ref|ZP_02849297.1|      ------ERTLVISDIHGCYDAFNRLLERVNYEPVKDQLILLGDFVSKGPDSKLVVEQSAS
RAAC01413               MGSTPPERTIFTSDIHGHLRPFARLLERLGYRPDRDQLVLVGDYISGGPDSLGVLRLVRN
ref|NP_815033.1|        -----------ISDIHGQADLFDALLT--DYDPVEHQLVLIGDLNDRGSDSKACFLKGKE
ref|ZP_00604769.1|      -----------IGDVHGKHELFEKLIH--YYDPKIHQLVLLGDLNDRGPRTKECFLLGKQ
ref|YP_796463.1|        -----------VSDIHGEYKKFKEILK--YWDSNRQQLILLGDLCDRGLQSYECFYLAKY
ref|NP_862606.1|        -----------VSDIHGEYKKFKEILK--YWDSNRQQLILLGDLCDRGLQSYECFYLAKY
                                   :.*:**     *    ::       : . .**:*:**  . *   :   .

ref|ZP_02849297.1|      LVREHGAIAVQGKHDERFVDIVRNKTKEAREKFFRHGGRQTVYSYLKGSDMTGSEEDLLN
RAAC01413               LCSEG-AVALRGNHEEAVVNWMR--------------------RGMKPLGPVRDSLY
ref|NP_815033.1|        LVEQHGAVYLRGNHEEYFLQFLQNPEDWFAGYVRNGGKETIESLLHPGATAEYSPTEMAL
ref|ZP_00604769.1|      LVEETGAIYLRGNHEEYFLQFLQSPEDWYAPYMRNGGKETFESLIHPGASEEYSPTEISM
ref|YP_796463.1|        LCDNYGAILIKGNHEDLFLKFLNKTEDFKENYIKNGGLKTLESF---GYSENNTFKDIVL
ref|NP_862606.1|        LCDNYGAILIKGNHEDLFLKFLNKTEDFKENYIKNGGLKTLESF---GYSENNTFKDIVL
                        *   :   *: ::***::  .:.  :.                            *     . :

ref|ZP_02849297.1|      RLRETVLERYPYHADFLEQLPYYYEDKHFIYVHAGLNPKYPNWKEQPKRDFLYIKDSFHK
RAAC01413               R-----AIAADASLAAFLSTLPYAWEGERWVAVHAGIDPDKPHWRQTAKRDLLTIRERFYA
ref|NP_815033.1|        MIR-----SRYPELIDFLTKRPLYFEWQHYLFVHAGVDLTMEDWRQTAPKDFLWIREPFHQ
ref|ZP_00604769.1|      MIQ-----SRYSELIKFLVQRPLYYEWENYLFVHACVDLTKKDWRKTSLRDFIWIREPFHE
ref|YP_796463.1|        DIK----KNNDKLIEFLTYLPNFYEWNDYIFVHAGVNLKINNWKDTSIRDFMWIREDFHF
ref|NP_862606.1|        DIK----KNNDKLIEFLTYLPNFYEWNDYIFVHAGVNLKINNWKDTSIRDFMWIREDFHF
                         **     *     :* :  : :: ****::      .*::.  .:*::  *::  *:

ref|ZP_02849297.1|      SDTVVNKVVVFGHTKTVDLH---GRADVWYGKGKIGIDGGCASGLQLNALEIIGEEVRSF
RAAC01413               RPHRVGKLVVFGHTPCVVLH---GTHDVWYGSDKVGIDGGARHGGQVNALVDAGGALTST
ref|NP_815033.1|        GKNNTGKTIVFGHTITPMLHGDMQTTDLWQSDGKIGIDGGAIFGGSVHGVI---------
ref|ZP_00604769.1|      GKNNTGKTIVFGHTITPMLHGDMQTTDLWIQDHKIGMDGGAVFGGSLHGVV---------
ref|YP_796463.1|        TPNRLNKTIVFGHTETKILN-KNNKYDIWIHDNKIGIDGGAVYGGYLYGVI---------
ref|NP_862606.1|        TPNRLNKTIVFGHTETKILN-KNNKYDIWIHDNKIGIDGGAVYGGYLYGVI---------
                          .* :***** *:       *:* . *:*:***. *   :  .:

ref|ZP_02849297.1|      SVP-
RAAC01413               AEPV
ref|NP_815033.1|        ----
ref|ZP_00604769.1|      ----
ref|YP_796463.1|        ----
ref|NP_862606.1|        ----
```

FIG. 179

```
ref|YP_145897.2|        ------------------------------------------------------------
sp|P42816|KPRS_BACCL    ------------------------------------------------------------
ref|YP_001124176.1|     ------------------------------------------------------------
ref|NP_387932.1|        SISFALLSTERICINHIBITINANDACTIVATINPDBDKUACHAINACRYSTALSTRUCT
RAAC01435               ------------------------------------------------------------
ref|YP_359065.1|        ------------------------------------------------------------ ref|YP_145897.2|        ------------------------------------------------------------
sp|P42816|KPRS_BACCL    ------------------------------------------------------------
ref|YP_001124176.1|     ------------------------------------------------------------
ref|NP_387932.1|        URESFBACILLUSSUBTILISPHSPHRIBSYLPYRPHSPHATESYNTHETASEMLECULA
RAAC01435               ------------------------------------------------------------
ref|YP_359065.1|        ------------------------------------------------------------ ref|YP_145897.2|        ------------------------------------------------------------
sp|P42816|KPRS_BACCL    ------------------------------------------------------------
ref|YP_001124176.1|     ------------------------------------------------------------
ref|NP_387932.1|        RBASISFALLSTERICINHIBITINANDACTIVATINPDBDKUBCHAINBCRYSTALSTR
RAAC01435               ------------------------------------------------------------
ref|YP_359065.1|        ------------------------------------------------------------ ref|YP_145897.2|        ------------------------------------------------------------
sp|P42816|KPRS_BACCL    ------------------------------------------------------------
ref|YP_001124176.1|     ------------------------------------------------------------
ref|NP_387932.1|        UCTURESFBACILLUSSUBTILISPHSPHRIBSYLPYRPHSPHATESYNTHETASEMLEC
RAAC01435               ------------------------------------------------------------
ref|YP_359065.1|        ------------------------------------------------------------ ref|YP_145897.2|        ------------------------------------------------------------
sp|P42816|KPRS_BACCL    ------------------------------------------------------------
ref|YP_001124176.1|     ------------------------------------------------------------
ref|NP_387932.1|        ULARBASISFALLSTERICINHIBITINANDACTIVATINPDBIBSACHAINAPHSPHRI
RAAC01435               ------------------------------------------------------------
ref|YP_359065.1|        ------------------------------------------------------------ ref|YP_145897.2|        ------------------------------------------------------------
sp|P42816|KPRS_BACCL    ------------------------------------------------------------
ref|YP_001124176.1|     ------------------------------------------------------------
ref|NP_387932.1|        BSYLDIPHSPHATESYNTHETASEINCMPLEXWITHCADMIUMINSPDBIBSBCHAINBP
RAAC01435               ------------------------------------------------------------
ref|YP_359065.1|        ------------------------------------------------------------ ref|YP_145897.2|        ------------------------------------------------------------
sp|P42816|KPRS_BACCL    ------------------------------------------------------------
ref|YP_001124176.1|     ------------------------------------------------------------
ref|NP_387932.1|        HSPHRIBSYLDIPHSPHATESYNTHETASEINCMPLEXWITHCADMIUMINSEMBCAAUN
RAAC01435               ------------------------------------------------------------
ref|YP_359065.1|        ------------------------------------------------------------ ref|YP_145897.2|        ------------------------------------------------------------
sp|P42816|KPRS_BACCL    ------------------------------------------------------------
ref|YP_001124176.1|     ------------------------------------------------------------
ref|NP_387932.1|        NAMEDPRTEINPRDUCTBACILLUSSUBTILISDBBAAPHSPHRIBSYLPYRPHSPHATE
RAAC01435               ------------------------------------------------------------
ref|YP_359065.1|        ------------------------------------------------------------
``` continued →

FIG. 179 continued

```
ref|YP_145897.2|        ------------------------------------------------------------
sp|P42816|KPRS_BACCL    ------------------------------------------------------------
ref|YP_001124176.1|     ------------------------------------------------------------
ref|NP_387932.1|        SYNTHETASEBACILLUSSUBTILISEMBCABPHSPHRIBSYLPYRPHSPHATESYNTHE
RAAC01435               ------------------------------------------------------------
ref|YP_359065.1|        ------------------------------------------------------------ ref|YP_145897.2|        ------------------------------------------------------------
sp|P42816|KPRS_BACCL    ------------------------------------------------------------
ref|YP_001124176.1|     ------------------------------------------------------------
ref|NP_387932.1|        TASEBACILLUSSUBTILISSUBSPSUBTILISSTRSCRESIGNIFICANCEE-IDENTI
RAAC01435               ------------------------------------------------------------
ref|YP_359065.1|        ------------------------------------------------------------ ref|YP_145897.2|        ------------------LKLFALNSNMKLAKEIAEVMGIELGKCSVSRFSDGEIQINI
sp|P42816|KPRS_BACCL    ------------------LKLFALNSNMKLAKEIAEVMGIELGKCSVSRFSDGEIQINI
ref|YP_001124176.1|     ------------------LKLFALNSNMKLAKQIAETMGIELGKCSVSRFSDGEIQINI
ref|NP_387932.1|        TIESPSITIVESGAPSDKNLKIFSLNSNPELAKEIADIVGVQLGKCSVTRFSDGEVQINI
RAAC01435               -------------MAIDADLKLVTGNANPALAQEIADYIGVPLADCQVGRFSDGEVRIRL
ref|YP_359065.1|        ----------------DLKIFSGNANPDLAREIASFLGVEVGDARVSRFSDGEIQVKI
                                          **:.: *:*  **::**. :*:  :... * ****** :::.:

ref|YP_145897.2|        EESIRGDDVFVIQSTSVPVNEHLMELLIMIDALKRASARTINIVMPYYGYARQDRKARSR
sp|P42816|KPRS_BACCL    EESIRGDDVFVIQSTSVPVNEHLMELLIMIDALKRASARTINIVMPYYGYARQDRKARSR
ref|YP_001124176.1|     EESIRGDDVFVIQSTSVPVNEHLMELLIMIDALKRASARTINIVMPYYGYARQDRKARSR
ref|NP_387932.1|        EESIRGCDCYIIQSTSDPVNEHIMELLIMVDALKRASAKTINIVIPYYGYARQDRKARSR
RAAC01435               GESVRGANVFIIQPTSQPVNEHLMELLILMDAVKRASARTINVVIPYYGYARQDRKARAR
ref|YP_359065.1|        NESVRGADVFIIQPTCTPVNENLMELLILIDAIRRASARRITAVLPYFGYARQDRKTRAR
                         : : ::**.*. **::***:*::****: *, *::******:*:* ref|YP_145897.2|        EPITAKLVANLLETAGASRVITLDLHAPQIQGFFDIPIDHLMGVPILADYFKSKQLEDIV
sp|P42816|KPRS_BACCL    NPITAKLVANLLETAGASRVITLDLHAPQIQGFFDIPIDHLMGVPILADYFKSKQLEDIV
ref|YP_001124176.1|     EPITAKLVANLLETAGASRVITLDLHAPQIQGFFDIPIDHLMGVPILADYFKSKQLDDVV
ref|NP_387932.1|        EPITAKLFANLLETAGATRVIALDLHAPQIQGFFDIPIDHLMGVPILGEYFEGKNLEDIV
RAAC01435               DPITAKLVANLLQTAGASRVISMDLHAGQIQGFFDIPVDHLIGMPILADYFLDKQIENPV
ref|YP_359065.1|        DPITAKLVSNLITVSGARRVIAMDLHAGQIQGFFDIPVDHLVGVPILAKYFNEKGLENKV
                         :****.:: ..: *::** ****:*:*:*..  * ::: * ref|YP_145897.2|        VVSPDHGGVTRARKLADRLKAPIAIIDKRRPKPNVAEVMNIVGQVAGKTAILIDDIIDTA
sp|P42816|KPRS_BACCL    VVSPDHGGVTRARKLADRLKAPIAIIDKRRPKPNVAEVMNIVGQVAGKTAILIDDIIDTA
ref|YP_001124176.1|     IVSPDHGGVTRARKLADRLKAPIAIIDKRRPRPNVAEVMNIVGQVKGKTAILIDDIIDTA
ref|NP_387932.1|        IVSPDHGGVTRARKLADRLKAPIAIIDKRRPRPNVAEVMNIVGNIEGKTAILIDDIIDTA
RAAC01435               VVSPDMGGVTRARAFAERLGAPLAIIDKRRPDANVAQVMNIIGDIEGKTAILIDDMIDTA
ref|YP_359065.1|        VVSPDLGGVTRARDLAERIGAPIAIIDKRRPEPNVAEIMNIIGEIEGKTVIMDDIIDTA
                        ;**** ******* ;*;*; **;********* .*..;;***;*;; ***.*;***;****

ref|YP_145897.2|        GTITLAANALAENGAKEVYACCTHPVLSGPAIERIQNSRIKELVVTNSIALPEEKKIDKI
sp|P42816|KPRS_BACCL    GTITLAANALAESGAKEVYACCTHPVLSGPAIERIQSSKIKELVVTNSIALPEEKKIDKI
ref|YP_001124176.1|     GTITLGANALVENGAKEVYACCTHPVLSGPAIERIQNSKIKELVVTNSIALPEEKKIDKI
ref|NP_387932.1|        GTITLAANALVENGAKEVYACCTHPVLSGPAVERINNSTIKELVVTNSIKLPEEKKIERF
RAAC01435               GTITAGAAELLKRGARGVYACCIHPVLSGQGVERLQNSAIEEVVVTNTIALPEHKRIDKI
ref|YP_359065.1|        GTITQGAQALMERGAKEVYVCCTHPILSGPAVDRLANAPIKEVVVTNTIPLPPEKKLPKI
                        ****  .*   *  :  **; **.** **;*** .;;; .: *;*;****;* ** .*::  ::

ref|YP_145897.2|        VELSVAPLIAEAISRVYEMKSVSVLFD
sp|P42816|KPRS_BACCL    VKLSVRPLIAEAITRVYEMKSVSVLFD
ref|YP_001124176.1|     VELSVAPLIAEAITRVYEMQSVSVLFD
ref|NP_387932.1|        KQLSVGPLLAEAIIRVHEQQSVSYLF-
RAAC01435               KVLSVAELIAEAIIRVHTQRSVSQLFD
ref|YP_359065.1|        KVLSVAPLMGEAIRRIHEDLSVSELF-
                        ***  *:.*** *:;    *** **
```

FIG. 180

```
ref|ZP_02170919.1|    MNKTELINAVAESADLSKKDATSAVDAVFEVITDSLKKGDKVQLIGFGNFEVRERAARKG
ref|ZP_01862118.1|    MNKTELINAVAEAAELSKKDATKAVDAVFESIQDALANGDKVQLIGFGNFEVRERAARKG
ref|NP_692713.1|      MNKTDLVNAVAEKSELSKKDATKAVDAVFESVMDSLKNGEKVQLIGFGNFEVRERSARKG
ref|YP_535778.1|      -NKAALIERVAEKTGLTKKDATVAVDAVFETIQDALVDGEKVQLIGFGNFEVRERAARKG
ref|YP_359077.1|      MNKAELVSVIAEKAEMTKKDAEKALNAVLAAIEEALKKGEKVQLVGFGTFEVRERAARKG
RAAC01442             MNKMELINRVAEKTNLKKKDAESAVNAVFEIIEEALANGEKVQIIGFGTFETRSRAARSG
                       **  *:. : : :.**  *::**:   : ::* .*:*::*.**.*.*:**.* ref|ZP_02170919.1|    RNPQTGEEIEIPASNVPAFKPGKALKDAVK
ref|ZP_01862118.1|    RNPQTGEEIEISASKVPAFKPGKALKDAVK
ref|NP_692713.1|      RNPQTGEEIEIPASKVPAFKPGKALKD---
ref|YP_535778.1|      RNPQTGEEIEIPASKVPAFKPGKSLKDAVK
ref|YP_359077.1|      RNPQTGQEIEIPASKVPVFKPGKLLKE---
RAAC01442             RNPQTGEVIEIPASTVPAFKPGNKLKEVTR
                      ******: ***.**.**.****: **:
```

FIG. 181

```
ref|ZP_02583512.1|    -----------IPEEVVEQIRTSSDIVEVIGEYVQLRKQGRNYFGLCPFHGENSPSFSVS
ref|NP_834002.1|      -----------IPEEVVEQIRTSSDIVEVIGEYVQLRKQGRNYFGLCPFHGENSPSFSVS
ref|ZP_00238564.1|    SITIVESGAPSIPEEVVEQIRTSSDIVEVIGEYVQLRKQGRNYFGLCPFHGENSPSFSVS
ref|ZP_02604064.1|    -----------IPEEVVEQIRTSSDIVEVIGEYVQLRKQGRNYFGLCPFHGENSPSFSVS
ref|NP_846740.1|      -----------IPEEVVEQIRTSSDIVEVIGEYVQLRKQGRNYFGLCPFHGENSPSFSVS
RAAC00895             --------MMNVPETFIDTLRQKVDIVEVISEYVPLRKSGRSYVGLCPFHNERTPSFSVS
                              :**  .::  :*  .  ****.* *..*.******.*:****** ref|ZP_02583512.1|    SDKQIFHCFGCGEGGNVFSFLMKMEGLAFTEAVQKLGERNGIAVAEYTSGQGQQEDISDD
ref|NP_834002.1|      SDKQIFHCFGCGEGGNVFSFLMKMEGLAFTEAVQKLGERNGIAVAEYTSGQGQQEDISDD
ref|ZP_00238564.1|    SDKQIFHCFGCGEGGNVFSFLMKMEGLAFTEAVQKLGERNGIAVAEYTSGQGQQEDISDD
ref|ZP_02604064.1|    SDKQIFHCFGCGEGGNVFSFLMKMEGLAFTEAVQKLGERNGIAVAEYTSGQGQQEDISDD
ref|NP_846740.1|      SDKQIFHCFGCGEGGNVFSFLMKMEGLAFTEAVQKLGERNGIAVAEYTSGQGQQEDISDD
RAAC00895             PERQVYHCFGCGAGGTVFRFLMDIEGISFAETVTLLAERCGIPLPDSLHAPAPR---SPR
                       ::*::**** . *.:**::*.*:*  *. .::.:      . .:  * ref|ZP_02583512.1|    TVIMQQAHELLKKYYHHLLVNTEEGNEALSYLLNRGITKEMIEKFEIGYASPAWDAATKI
ref|NP_834002.1|      TVIMQQAHELLKKYYHHLLVNTEEGNEALSYLLNRGITKEMIEKFEIGYASPAWDAATKI
ref|ZP_00238564.1|    TVIMQQAHELLKKYYIHHLLVNTEEGNEALSYLLKRGITKEMIEKFEIGYASPAWDAATKI
ref|ZP_02604064.1|    TVIMQQAHELLKKYYHHLLVNTEEGNEALSYLLKRGITKEMIEKFEIGYASPAWDAATKI
ref|NP_846740.1|      TVIMQQAHELLKKYYHHLLVNTEEGNEALSYLLKRGITKEMIEKFEIGYASPAWDAATKI
RAAC00895             LERYRQAHDLAAKAFNHILMNTDAGVQALHYLLSRGISRTTMATFQLGYAPPSGRAMMSF
                       :***:*  *  ::*:*:**: *  :** ***.***::   : .*::***.*:  *   .:

ref|ZP_02583512.1|    LQKRGLSLSSMEQAGLLIRSEKDGSHYDRFRGRVMFPIYTLQGKVIAFSGRALGDDT-PK
ref|NP_834002.1|      LQKRGLSLSTMEQAGLLIRSEKDGSHYDRFRGRVMFPIYTLQGKVIAFSGRALGDDT-PK
ref|ZP_00238564.1|    LQKRGLSLSSMEQAGLLIRSEKDGSHYDRFRGRVMFPIYTLQGKVIAFSGRALGDDT-PK
ref|ZP_02604064.1|    LQKRGLSLSSMEQAGLLIRSEKDGSHYDRFRGRVMFPIYTLQGKVIAFSGRALGDDT-PK
ref|NP_846740.1|      LQKRGLSLSSMEQAGLLIRSEKDGSHYDRFRGRVMFPIYTLQGKVIAFSGRALGDDT-PK
RAAC00895             LQQKGFSAEELIACGLAVDLG--GELVDRFRGRVIIPIADRRGQVVAFGARALDDDAKPK
                      **:*:*:   .  :  .**   :   *.  ********::**  :*:*:** .***.**:  **

ref|ZP_02583512.1|    YLNSPETPIFHKSKLLYNFHQARPFIRKRGQVVLFEGYADVLAAVKSGVEEAVATMGTAL
ref|NP_834002.1|      YLNSPETPIFHKSKLLYNFHQARPFIRKRGQVVLFEGYADVLAAVKSGVEEAVATMGTAL
ref|ZP_00238564.1|    YLNSPETPIFHKSKLLYNFHQARPFIRKRGQVVLFEGYADVLAAVKSGVEEAVATMGTAL
ref|ZP_02604064.1|    YLNSPETPIFHKSKLLYNFHQARPFIRKRGQVVLFEGYADVLAAVKSGVEEAVATMGTAL
ref|NP_846740.1|      YLNSPETPIFHKSKLLYNFHQARPFIRKRGQVVLFEGYADVLAAVKSGVEEAVATMGTAL
RAAC00895             YLNSPEYELFHKGRMLFNVHRARKAIRRERRALLLEGYMDVLAVAQAGIECAVATLGTSL
                      ****  :*.::*:*.*: .:. .:.:*.** ::*:*  **.:* ref|ZP_02583512.1|    TEEQAKLLRRNVETVVLCYDGDKAGREATMKAGQLLLKVGCQVKVTSLPDKLDPDEYVQQ
ref|NP_834002.1|      TEEQAKLLRRNVETVVLCYDGDKAGREATMKAGQLLLKVGCQVKVTSLPDKLDPDEYVQQ
ref|ZP_00238564.1|    TEEQAKLLRRNVETVVLCYDGDKAGREATMKAGQLLLQVGCQVKVTSLPDKLDPDEYVQQ
ref|ZP_02604064.1|    TEEQAKLLRRNVETVVLCYDGDKAGREATMKAGQLLLQVGCQVKVTSLPNKLDPDEYVQQ
ref|NP_846740.1|      TEEQAKLLRRNVETVVLCYDGDKAGREATMKAGQLLLQVGCQVKVTSLPDKLDPDEYVQQ
RAAC00895             TEEQAQLLKADCDKVVIAYDGDEAGRKATVRAIEVLEQAGVTPVVLRLPDGMDPDEYIRA
                      *****::**:  : ..**:.****:***:**:** ::* .*  * .**: :*****::

ref|ZP_02583512.1|    YGTTAFEN-LVKSSVSFVGFKINYLRLGKNLQDESGKEEYVKSVLKELSLLQDAMQAESY
ref|NP_834002.1|      YGTTAFEN-LVKSSVSFVGFKINYLRLGKNLQDESGKEEYVKSVLKELSLLQDAMQAESY
ref|ZP_00238564.1|    YGTTAFEN-LVKSSISFVGFKINYLRLGKNLQDESGKEEYVKSVLKELSLLQDAMQAESY
ref|ZP_02604064.1|    YGTTAFEN-LVKSSISFVGFKINYLRLGKNLQDESGKEEYVKSVLKELSLLQDAMQAESY
ref|NP_846740.1|      YGTTAFEN-LVKSSISFVGFKINYLRLGKNLQDESGKEEYVKSVLKELSLLQDAMQAESY
RAAC00895             HGARAFERMLSESTWTAVQFLIEDMRARAEWVSPAGRTEFLRQVLRLLAERASPVEQEYQ
                      :*: ***. * :*:  * * *: *  :*     . .:*: *:::.**. *:   ..:: * ref|ZP_02583512.1|    LKSLSQEFSYSMETLLNQLHQYRKEQKVQQKQIKQVAKPSQVVQTKPKLTGFERAEREII
ref|NP_834002.1|      LKSLSQEFSYSMETLLNQLHQYRKEQKVQQKQIKQVAKPSQVVQTKPKLTGFERAEREII
ref|ZP_00238564.1|    LKSLSQEFSYSMETLLNQLHQYRKEQKVQQKQVKQVSKPSQIVQTKPKLTGFERAEREII
ref|ZP_02604064.1|    LKSLSQEFSYSMETLLNQLHQYRKEQKVQQKQVKQVSKPSQIVQTKPKLTGFERAEREII
ref|NP_846740.1|      LKSLSQEFSYSMETLLNQLHQYRKEQKVQQKQVKQVSKPSQIVQTKPKLTGFERAEREII
RAAC00895             LRNLSQEFNLSVETLKEEMRGFAKPLRRRSPPREEVTP---WVNSPRAAKGKDQVSLRIL
                      *:.*****. *.***  ::: :  *  :  .  ::*:       *::     .*  ::...*:
``` continued →

FIG. 181 continued

```
ref|ZP_02583512.1|    YHMLQSAEVAVR-MESHIEDFHTEEHKGILYELYAYYEKGNEPSVGTFLSWLSDEKLKNI
ref|NP_834002.1|      YHMLQSAEVAVR-MESHIEDFHTEEHKGILYELYAYYEKGNEPSVGTFLSWLSDEKLKNI
ref|ZP_00238564.1|    YHMLQSPEVAVR-MESHIEDFHTEEHKGILYELYAYYEKGNEPSVGTFLSWLSDEKLKNI
ref|ZP_02604064.1|    YHMLQSPEVAVR-MESHIEDFHTEEHKGILYELYAYYEKGNEPSVGTFLSWLSDEKLKNI
ref|NP_846740.1|      YHMLQSPEVAVR-MESHIEDFHTEEHKGILYELYAYYEKGNEPSVGTFLSWLSDEKLKNI
RAAC00895             QAALFSQEAAEYLMEKGVTELAHPLHTALLSHVYSWRLEQPGQPPSAFIDRLEDEELVRL
                       *  *  *.*    **. :  ::      *..:*  .:*::  :     . .:*:. *.**:*  .:

ref|ZP_02583512.1|    ITDISTDEF--INPEYTEEVLQGHLETLRRHQEKLEKMEIIFKVKQMEKTDPVEAAKYYV
ref|NP_834002.1|      ITDISTDEF--INPEYTEEVLQGHLETLRRHQEKLEKMEIIFKVKQMEKTDPVEAAKYYV
ref|ZP_00238564.1|    ITDISTDEF--INPEYTEEVLQGHLETLRRHQEKLEKMEIIFKIKQMEKTDPVEAAKYYV
ref|ZP_02604064.1|    ITDISTDEF--INPEYTEEVLQGHLETLRRHQEKLEKMEIIFKIKQMEKTDPVEAAKYYV
ref|NP_846740.1|      ITDISTDEF--INPEYTEEVLQSHLETLRRHQEKLEKMEIIFKIKQMEKTDPVEAAKYYV
RAAC00895             ASSLLFDEPPEITVELVEDYLR-ALELFRLEQELKEKVRAWNEAEAAGDQEKSREIKLQV
                      :.:    **    *. * .*: *:  ** :* .  :.   : :   . :  .  *  * ref|ZP_02583512.1|    AYLQNQKA-----------
ref|NP_834002.1|      AYLQNQKA-----------
ref|ZP_00238564.1|    AYLQNQKA-----------
ref|ZP_02604064.1|    AYLQNQKA-----------
ref|NP_846740.1|      AYLQNQKA-----------
RAAC00895             EWIQSQMATMKQPRALHAE
                      ::*.* *
```

FIG. 182

```
ref|YP_001180871.1|    ----MNLFRFRLKELREEKNISRSDLAEILGVSTQTIANYENGHREPNFDTLLKIADYFG
ref|YP_001114120.1|    ---VMSTIGERLRQLRKEKNTNREDVANLLGVTVRSVTNYESGQRNLDPDQLIALADYYD
ref|YP_001662345.1|    --EKLNPFSQRLRQLREEKGLLQKDVAKILGITPSAYGYYEQGKREPSMEVLKKLSDFFN
ref|YP_001210714.1|    ------IFAKRLSFLITKNKLSKQAVANAINVSRPAVSQFANGENLPSVEKLIALADFFD
RAAC03475              MEEVMTLFSQRLTELLDRTGTTRRSFAQALGVSERMVQYYITGKKDPTVETLIALADFFD
ref|ZP_02442523.1|     ------IFQKRLKELRNAKGTSQ_AIAAALGITDRGYRKYEAGDSEPTLSVIIALADYFD
                             :  **   *    .   :   . * :.::       :  *.   . :  ::*::.

ref|YP_001180871.1|    VTVDYLIGRSE-----
ref|YP_001114120.1|    VSMDYLTGRSDNPK--
ref|YP_001662345.1|    VSIDYLLGRTD-----
ref|YP_001210714.1|    VSLDYLVGRSDDPRR-
RAAC03475              VSLDYLVGRSENPERK
ref|ZP_02442523.1|     VSLDYLCGRSDDPAR-
                       *::***  **::
```

FIG. 183

```
ref|YP_001114120.1    --GERLRQLRKEKNINREDVANLLGVTVRSVTNYESGQRNLDPDQLIALADYYDVSMDYL
RAAC03560             MNGERLRALRKSLGLKRDEVAQAIGVTPRIITDYETETKRPTLDTAVKLADFFNVSLDYL
ref|YP_001662345.1|   ---QRLRQLREEKGLLQKDVAKILGITPSAYGYYEQGKREPSMEVLKKLSDFFNVSIDYL
ref|NP_242309.1|      ---ERLRYLRKKHGLTMKELGKKINVAESTISGYENGNRKPDMDTLVKMAEYFNSSTDYL
ref|YP_146346.1|      --GDRLRKLRQEKKLTQEELGKKINVTKVSISGYENGNRTPDTETLQKLADFFNVTTDYL
ref|YP_146347.1|      ----RLKMLRLQKKLTHQDMADFLGITRQGYSKYENGQSQPDIDTINKLAEFFNVTTDYL
                          :   .  :  .:: .. :.::                 :    :::::: : * ref|YP_001114120.1    TGRSDNPKPPQTTTIDDE---
RAAC03560             VGRTDDPTPPKRSSPSNEPGS
ref|YP_001662345.1|   LGRTDIRSP------------
ref|NP_242309.1|      LGRTEEP-APYQKQPPEKQ--
ref|YP_146346.1|      LGRTDHPNPPDQDDIPEE---
ref|YP_146347.1|      LGRTDDPTPPEQDDIPEE---
                      **::    .
```

TYPE II RESTRICTION-MODIFICATION SYSTEM METHYLATION SUBUNIT OF *ALICYCLOBACILLUS ACIDOCALDARIUS*

CROSS-REFERENCE TO RELATED APPLICATION

This application is a divisional of U.S. patent application Ser. No. 12/800,045, filed May 5, 2010, pending, the disclosure of which is hereby incorporated herein by this reference in its entirety.

GOVERNMENT RIGHTS

This invention was made with government support under Contract No. DE-AC07-99ID13727 and Contract No. DE-AC07-05ID14517 awarded by the United States Department of Energy. The government has certain rights in the invention.

STATEMENT ACCORDING TO 37 C.F.R. §1.821(c) or (e)-SEQUENCE LISTING SUBMITTED AS A TXT FILES

Pursuant to 37 C.F.R. §1.821(c) or (e), a file containing a TXT version of the Sequence Listing has been submitted concomitant with this application, the contents of which are hereby incorporated by reference. A Request to Transfer CRF is also submitted concomitant.

TECHNICAL FIELD

The present invention relates generally to biotechnology. More specifically, embodiments of the present invention relate to isolated and/or purified polypeptides and nucleic acid sequences encoding polypeptides from *Alicyclobacillus acidocaldarius* and methods for their use.

BACKGROUND

Thermophilic and/or acidophilic bacteria have great potential for production of useful chemicals in industrial processes. However, most systems for promoting genetic recombination for the purposes of introducing nucleic acids of interest are not well suited for such thermophilic and/or acidophilic bacteria.

BRIEF SUMMARY OF THE INVENTION

Embodiments of the invention relate to purified and/or isolated nucleotide sequences of the genome of *Alicyclobacillus acidocaldarius*, or a homologue or fragment thereof. In one embodiment of the invention, the nucleotide sequence is selected from at least one of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, and 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283 or a homologue or fragment thereof. In another embodiment of the invention, the homologue is selected from the group consisting of a nucleotide sequence having at least 80% sequence identity to at least one of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283.

Embodiments of the invention may further relate to an isolated and/or purified nucleic acid sequence comprising a nucleic acid sequence encoding a polypeptide selected from the group consisting of a polypeptide having at least 90% sequence identity to at least one of SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282.

Embodiments of the invention also relate to isolated and/or purified polypeptides coded for by a nucleotide sequence comprising a nucleotide sequence of the genome of *Alicyclobacillus acidocaldarius*, or a homologue or fragment thereof. In one embodiment, the nucleotide sequence comprises a nucleotide sequence selected from the group consisting of a nucleotide sequence having at least 80% sequence identity to at least one of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283.

In another embodiment of the invention, the nucleotide sequence comprises a nucleotide sequence selected from at least one of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, and 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283 or a homologue or fragment thereof. In still another embodiment, the polypeptide comprises an amino acid sequence of SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282. In yet another embodiment, the polypeptide comprises an amino acid sequence selected from the group consisting of a polypeptide having at least 90% sequence identity to at least one of SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282.

In embodiments of the invention, the polypeptides may be acidophilic and/or thermophilic. In further embodiments, the polypeptides may be glycosylated, pegylated, and/or otherwise post-translationally modified.

Embodiments of methods include methods of altering genetic recombination inside or outside of a cell, the methods comprising providing a recombinant, purified, and/or isolated nucleotide sequence comprising a nucleotide sequence selected from the group consisting of a nucleotide sequence having at least 90% sequence identity to at least one of the sequences of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283 and/or a recombinant, purified, and/or isolated polypeptide selected from the group consisting of a polypeptide having at least 90% sequence identity to at least one of the sequences of SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282 to a nucleotide sequence with which recombination is desired.

Further embodiments of methods include placing a cell producing or encoding a recombinant, purified, and/or isolated nucleotide sequence comprising a nucleotide sequence selected from the group consisting of a nucleotide sequences having at least 90% sequence identity to at least one of the sequences of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283 and/or a recombinant, purified, and/or isolated polypeptide selected from the group consisting of a polypeptide having at least 90% sequence identity to at least one of the sequences of SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282 in a environment comprising temperatures at or above about 25, 30, 35, 40, 45, 50, 55, 60, 65, 70, 75, 80, 85, 90, and/or 95 degrees Celsius and/or a pH at, below, and/or above 8, 7, 6, 5, 4, 3, 2, 1, and/or 0.

These and other aspects of the invention will become apparent to the skilled artisan in view of the teachings contained herein.

BRIEF DESCRIPTION OF THE SEVERAL VIEWS OF THE DRAWINGS

FIG. 1 depicts a sequence alignment between SEQ ID NO: 1 (RAAC03697) and ref|ZP_01916690.1|, ref|YP_308280.1|, ref|XP_001525241.1|, gb|AAY21825.1|, and ref|XP_001743680.1| (SEQ ID Nos: 3-7 respectively). Amino acids conserved among all sequences are indicated by a "*" and generally conserved amino acids are indicated by a ":".

FIG. 2 depicts a sequence alignment between SEQ ID NO: 18 (RAAC02297) and ref|ZP_01171092.1|, ref|YP_429214.1|, gb|EAZ41188.1|, gb|AAR38445.1|, and ref|ZP_01774730.1| (SEQ ID Nos: 20-24 respectively). Amino acids conserved among all sequences are indicated by a "*" and generally conserved amino acids are indicated by a ":".

FIG. 3 depicts a sequence alignment between SEQ ID NO: 35 (RAAC02298) and ref|ZP_01575699.1|, ref|ZP_01171091.1|, ref|ZP_02598168.1|, ref|ZP_01900573.1|, and ref|ZP_01301851.1| (SEQ ID Nos: 37-41 respectively). Amino acids conserved among all sequences are indicated by a "*" and generally conserved amino acids are indicated by a ":".

FIG. 4 depicts a sequence alignment between SEQ ID NO: 52 (RAAC02299) and ref|ZP_01171090.1|, ref|ZP_02598167.1|, ref|ZP_01575700.1|, ref|ZP_02849387.1|, and ref|NP_627754.1| (SEQ ID Nos: 54-58 respectively). Amino acids conserved among all sequences are indicated by a "*" and generally conserved amino acids are indicated by a ":".

FIG. 5 depicts a sequence alignment between SEQ ID NO: 69 (RAAC02300) and ref|ZP_02598166.1|, ref|ZP_01171089.1|, ref|ZP_02849386.1|, ref|YP_159112.1|, and ref|ZP_02007550.1 (SEQ ID Nos: 71-75 respectively). Amino acids conserved among all sequences are indicated by a "*" and generally conserved amino acids are indicated by a ":".

FIG. 6 depicts a sequence alignment between SEQ ID NO: 86 (RAAC02301) and ref|ZP_02756760.1|, ref|ZP_01171088.1|, emb|CAE47790.1|, emb|CAE47778.1|, and ref|NP_967133.1| (SEQ ID Nos: 88-92 respectively). Amino acids conserved among all sequences are indicated by a "*" and generally conserved amino acids are indicated by a ":".

FIG. 7 depicts a sequence alignment between SEQ ID NO: 103 (RAAC02302) and ref|ZP_01171087.1|, ref|YP_061819.1|, emb|CAJ49597.1|, ref|YP_158155.1|, and ref|NP_779769.1| (SEQ ID Nos: 105-109 respectively). Amino acids conserved among all sequences are indicated by a "*" and generally conserved amino acids are indicated by a ":".

FIG. 8 depicts a sequence alignment between SEQ ID NO: 120 (RAAC02303) and ref|YP_001371728.1|, ref|YP_001235767.1|, ref|YP_674884.1|, ref|NP_046584.1|, and ref|ZP_00630666.1| (SEQ ID Nos: 122-126 respectively). Amino acids conserved among all sequences are indicated by a "*" and generally conserved amino acids are indicated by a ":".

FIG. 9 depicts a sequence alignment between SEQ ID NO: 137 (RAAC02304) and ref|YP_793245.1|, ref|YP_386759.1|, ref|YP_868126.1|, ref|NP_253469.1|, and ref|ZP_01591801.1| (SEQ ID Nos: 139-143 respectively). Amino acids conserved among all sequences are indicated by a "*" and generally conserved amino acids are indicated by a ":".

FIG. 10 depicts a sequence alignment between SEQ ID NO: 154 (RAAC02305) and ref|YP_645800.1|, ref|ZP_01697403.1|, ref|NP_111721.1|, dbj|BAB60367.1|, and ref|YP_950098.1| (SEQ ID Nos: 156-160 respectively). Amino acids conserved among all sequences are indicated by a "*" and generally conserved amino acids are indicated by a ":".

FIG. 11 depicts a sequence alignment between SEQ ID NO: 171 (RAAC02306) and gb|EAU91762.1|, ref|ZP_01035289.1|, ref|ZP_01076306.1|, ref|YP_173223.1|, and ref|ZP_01500882.1| (SEQ ID Nos: 173-177 respectively). Amino acids conserved among all sequences are indicated by a "*" and generally conserved amino acids are indicated by a ":".

FIG. 12 depicts a sequence alignment between SEQ ID NO: 188 (RAAC02289) and ref|YP_517477.1|, ref|YP_001568284.1|, ref|YP_503850.1|, ref|NP_783815.1|, and ref|YP_149134.1| (SEQ ID Nos: 190-194 respectively). Amino acids conserved among all sequences are indicated by a "*" and generally conserved amino acids are indicated by a ":".

FIG. 13 depicts a sequence alignment between SEQ ID NO: 205 (RAAC02307) and ref|XP_001317319.1|, ref|YP_303751.1|, ref|ZP_01222568.1|, ref|XP_001191064.1|, and ref|ZP_01697132.1| (SEQ ID Nos: 207-211 respectively). Amino acids conserved among all sequences are indicated by a "*" and generally conserved amino acids are indicated by a ":".

FIG. 14 depicts a sequence alignment between SEQ ID NO: 222 (RAAC02309) and ref|NP_623664.1|, ref|ZP_02755290.1|, ref|YP_001662357.1|, ref|YP_001666189.1|, and ref|YP_001181426.1| (SEQ ID Nos: 224-228 respectively). Amino acids conserved among all sequences are indicated by a "*" and generally conserved amino acids are indicated by a ":".

FIG. 15 depicts a sequence alignment between SEQ ID NO: 239 (RAAC02310) and ref|NP_735797.1|, ref|XP_001247966.1|, gb|AAG38042.1|AF295925_7, ref|ZP_00874806.1|, and gb|ABV55445.1| (SEQ ID Nos: 241-245 respectively). Amino acids conserved among all sequences are indicated by a "*" and generally conserved amino acids are indicated by a ":".

FIG. 16 depicts a sequence alignment between SEQ ID NO: 256 (RAAC02311) and ref|YP_001205829.1|, ref|YP_001240062.1|, ref|YP_359336.1|, ref|YP_001451893.1|, and ref|YP_466026.1| (SEQ ID Nos: 258-262 respectively). Amino acids conserved among all sequences are indicated by a "*" and generally conserved amino acids are indicated by a ":".

FIG. 17 depicts a sequence alignment between SEQ ID NO: 273 (RAAC02312) and ref|YP_001506532.1|, ref|NP_279998.1|, ref|ZP_02850831.1|, ref|ZP_02248080.1|, and ref|XP_001637270.1| (SEQ ID Nos: 275-279 respectively). Amino acids conserved among all sequences are indicated by a "*" and generally conserved amino acids are indicated by a ":".

FIG. 18 depicts a sequence alignment between SEQ ID NO: 290 (RAAC02313) and ref|YP_245669.1|, ref|ZP_02369868.1|, ref|YP_438666.1|, ref|NP_695275.1|, and emb|CAB06069.2| (SEQ ID Nos: 292-296 respectively). Amino acids conserved among all sequences are indicated by a "*" and generally conserved amino acids are indicated by a ":".

FIG. 19 depicts a sequence alignment between SEQ ID NO: 307 (RAAC02314) and ref|XP_503244.1|, ref|NP_218466.1|, ref|ZP_01058859.1|, ref|NP_126488.1|, and ref|YP_754274.1| (SEQ ID Nos: 309-313 respectively). Amino acids conserved among all sequences are indicated by a "*" and generally conserved amino acids are indicated by a ":".

FIG. 20 depicts a sequence alignment between SEQ ID NO: 324 (RAAC02315) and ref|ZP_02854145.1|, ref|YP_145847.1|, ref|YP_536482.1|, ref|YP_799230.1|, and ref|NP_714527.1| (SEQ ID Nos: 326-330 respectively). Amino acids conserved among all sequences are indicated by a "*" and generally conserved amino acids are indicated by a ":".

FIG. 21 depicts a sequence alignment between SEQ ID NO: 341 (RAAC02316) and ref|ZP_02180762.1|, ref|ZP_02077766.1|, ref|ZP_01893908.1|, ref|XP_001444409.1|, and ref|XP_624126.2| (SEQ ID Nos: 343-347 respectively). Amino acids conserved among all sequences are indicated by a "*" and generally conserved amino acids are indicated by a ":".

FIG. 22 depicts a sequence alignment between SEQ ID NO: 358 (RAAC02290) and emb|CAJ50746.1|, gb|AAM28266.1|, ref|XP_816394.1|, ref|XP_001585185.1|, and gb|EAU92316.1| (SEQ ID Nos: 360-364 respectively). Amino acids conserved among all sequences are indicated by a "*" and generally conserved amino acids are indicated by a ":".

FIG. 23 depicts a sequence alignment between SEQ ID NO: 375 (RAAC02317) and ref|YP_001210712.1|, ref|ZP_02727046.1|, ref|ZP_02758954.1|, ref|ZP_01593342.1|, and ref|ZP_00235902.1| (SEQ ID Nos: 377-381 respectively). Amino acids conserved among all sequences are indicated by a "*" and generally conserved amino acids are indicated by a ":".

FIG. 24 depicts a sequence alignment between SEQ ID NO: 409 (RAAC02319) and ref|YP_431168.1|, ref|YP_001212944.1|, ref|YP_754944.1|, ref|YP_754864.1|, and ref|ZP_02171383.1| (SEQ ID Nos: 411-415 respectively). Amino acids conserved among all sequences are indicated by a "*" and generally conserved amino acids are indicated by a ":".

FIG. 25 depicts a sequence alignment between SEQ ID NO: 426 (RAAC02320) and ref|YP_431169.1|, ref|YP_754945.1|, ref|YP_754863.1|, ref|ZP_01287154.1|, and ref|ZP_01287577.1| (SEQ ID Nos: 428-432 respectively). Amino acids conserved among all sequences are indicated by a "*" and generally conserved amino acids are indicated by a ":".

FIG. 26 depicts a sequence alignment between SEQ ID NO: 443 (RAAC02321) and ref|NP_982177.1|, ref|ZP_02595431.1|, ref|NP_927486.1|, ref|YP_001108426.1|, and emb|CAN89659.1| (SEQ ID Nos: 445-449 respectively). Amino acids conserved among all sequences are indicated by a "*" and generally conserved amino acids are indicated by a ":".

FIG. 27 depicts a sequence alignment between SEQ ID NO: 460 (RAAC02322) and ref|YP_504284.1|, ref|YP_001046337.1|, ref|ZP_02131576.1|, ref|ZP_01288161.1|, and ref|ZP_02132246.1| (SEQ ID Nos: 462-466 respectively). Amino acids conserved among all sequences are indicated by a "*" and generally conserved amino acids are indicated by a ":".

FIG. 28 depicts a sequence alignment between SEQ ID NO: 477 (RAAC02323) and ref|ZP_01287831.1|, ref|YP_076198.1|, ref|YP_446560.1|, ref|NP_634267.1|, and ref|ZP_01106621.1| (SEQ ID Nos: 479-483 respectively). Amino acids conserved among all sequences are indicated by a "*" and generally conserved amino acids are indicated by a ":".

FIG. 29 depicts a sequence alignment between SEQ ID NO: 494 (RAAC02324) and ref|ZP_02595423.1|, ref|NP_982173.1|, ref|ZP_02367476.1|, ref|YP_001616264.1|, and ref|YP_827637.1| (SEQ ID Nos: 496-500 respectively). Amino acids conserved among all sequences are indicated by a "*" and generally conserved amino acids are indicated by a ":".

FIG. 30 depicts a sequence alignment between SEQ ID NO: 511 (RAAC02326) and ref|NP_982172.1|, ref|ZP_01872101.1|, ref|NP_922949.1|, emb|CAO48005.1|, and sp|P08995|NO26_SOYBN (SEQ ID Nos: 513-517 respectively). Amino acids conserved among all sequences are indicated by a "*" and generally conserved amino acids are indicated by a ":".

FIG. 31 depicts a sequence alignment between SEQ ID NO: 528 (RAAC02327) and ref|NP_982171.1|, ref|ZP_01090358.1|, ref|ZP_01856486.1|, ref|ZP_02736297.1|, and ref|ZP_01311632.1| (SEQ ID Nos: 530-534 respectively). Amino acids conserved among all sequences are indicated by a "*" and generally conserved amino acids are indicated by a ":".

FIG. 32 depicts a sequence alignment between SEQ ID NO: 545 (RAAC02328) and ref|NP_982170.1|, ref|XP_955124.1|, ref|XP_763458.1|, ref|XP_845342.1|, and ref|XP_666904.1| (SEQ ID Nos: 547-551 respectively). Amino acids conserved among all sequences are indicated by a "*" and generally conserved amino acids are indicated by a ":".

FIG. 33 depicts a sequence alignment between SEQ ID NO: 562 (RAAC02332) and ref|YP_079109.1|, ref|ZP_01858609.1|, gb|AAV70501.1|, ref|YP_001319533.1|, and ref|ZP_00539168.1| (SEQ ID Nos: 564-568 respectively). Amino acids conserved among all sequences are indicated by a "*" and generally conserved amino acids are indicated by a ":".

FIG. 34 depicts a sequence alignment between SEQ ID NO: 596 (RAAC02334) and ref|YP_001485227.1|, ref|YP_001358015.1|, ref|ZP_02013298.1|, ref|ZP_02178354.1|, and ref|YP_001356736.1| (SEQ ID Nos: 598-602 respectively). Amino acids conserved among all sequences are indicated by a "*" and generally conserved amino acids are indicated by a ":".

FIG. 35 depicts a sequence alignment between SEQ ID NO: 613 (RAAC02335) and dbj|BAF91394.1|, gb|AAL17690.1|, dbj|BAF91409.1|, ref|NP_001058416.1|, and dbj|BAD45624.1| (SEQ ID Nos: 615-619 respectively). Amino acids conserved among all sequences are indicated by a "*" and generally conserved amino acids are indicated by a ":".

FIG. 36 depicts a sequence alignment between SEQ ID NO: 630 (RAAC02336) and ref|YP_517477.1|, ref|YP_517489.1|, ref|ZP_01370335.1|, gb|ACA46983.1|, and ref|NP_001568284.1| (SEQ ID Nos: 632-636 respectively). Amino acids conserved among all sequences are indicated by a "*" and generally conserved amino acids are indicated by a ":".

FIG. 37 depicts a sequence alignment between SEQ ID NO: 647 (RAAC02292) and gb|AAB91591.1|, ref|YP_001422657.1|, ref|NP_391247.1|, ref|YP_093160.1|, and ref|NP_391246.1| (SEQ ID Nos: 649-653 respectively). Amino acids conserved among all sequences are indicated by a "*" and generally conserved amino acids are indicated by a ":".

FIG. 38 depicts a sequence alignment between SEQ ID NO: 664 (RAAC02337) and gb|ACA41259.1|, ref|ZP_02626811.1|, ref|NP_664934.1|, ref|YP_195796.1|, and ref|NP_817052.1| (SEQ ID Nos: 666-670 respectively). Amino acids conserved among all sequences are indicated by a "*" and generally conserved amino acids are indicated by a ":".

FIG. 39 depicts a sequence alignment between SEQ ID NO: 681 (RAAC02338) and gb|ACA41261.1|, ref|ZP_02626812.1|, ref|NP_664935.1|, ref|XP_001701427.1|, and sp|Q2M3V2|ANR43_HUMAN (SEQ ID Nos: 683-687 respectively). Amino acids conserved among all sequences are indicated by a "*" and generally conserved amino acids are indicated by a FIG. 40 depicts a sequence alignment between SEQ ID NO: 698 (RAAC02339) and gb|AAU83457.1|, emb|CAJ70907.1|, ref|ZP_00514953.1|, ref|YP_322920.1|, and ref|YP_183482.1| (SEQ ID Nos: 700-704 respectively). Amino acids conserved among all sequences are indicated by a "*" and generally conserved amino acids are indicated by a ":".

FIG. 41 depicts a sequence alignment between SEQ ID NO: 715 (RAAC02340) and ref|ZP_01731985.1|, ref|ZP_02429891.1|, ref|ZP_02432977.1|, ref|ZP_02085861.1|, and ref|ZP_02207628.1| (SEQ ID Nos: 717-721 respectively). Amino acids conserved among all sequences are indicated by a "*" and generally conserved amino acids are indicated by a ":".

FIG. 42 depicts a sequence alignment between SEQ ID NO: 732 (RAAC02341) and ref|ZP_02596024.1|, ref|NP_150014.1|, ref|ZP_00231288.1|, ref|YP_001213007.1|, and ref|YP_001113884.1| (SEQ ID Nos: 734-738 respectively). Amino acids conserved among all sequences are indicated by a "*" and generally conserved amino acids are indicated by a ":".

FIG. 43 depicts a sequence alignment between SEQ ID NO: 749 (RAAC02342) and ref|NP_783868.1|, ref|YP_805310.1|, ref|ZP_01273840.1|, ref|YP_803555.1|, and ref|YP_001270615.1| (SEQ ID Nos: 751-755 respectively). Amino acids conserved among all sequences are indicated by a "*" and generally conserved amino acids are indicated by a ":".

FIG. 44 depicts a sequence alignment between SEQ ID NO: 766 (RAAC02293) and ref|ZP_01171099.1|, ref|ZP_02598174.1|, ref|YP_429218.1|, ref|YP_001112194.1|, and ref|YP_001112320.1| (SEQ ID Nos: 768-772 respectively). Amino acids conserved among all sequences are indicated by a "*" and generally conserved amino acids are indicated by a ":".

FIG. 45 depicts a sequence alignment between SEQ ID NO: 783 (RAAC02346) and ref|NP_623604.1|, ref|ZP_00235040.1|, ref|ZP_02327783.1|, ref|ZP_02082031.1|, and ref|ZP_02846176.1| (SEQ ID Nos: 785-789 respectively). Amino acids conserved among all sequences are indicated by a "*" and generally conserved amino acids are indicated by a ":".

FIG. 46 depicts a sequence alignment between SEQ ID NO: 800 (RAAC02347) and ref|XP_001383704.2|, ref|XP_001664270.1|, ref|YP_113896.1|, ref|XP_761114.1|, and ref|XP_001015776.2| (SEQ ID Nos: 802-806 respectively). Amino acids conserved among all sequences are indicated by a "*" and generally conserved amino acids are indicated by a ":".

FIG. 47 depicts a sequence alignment between SEQ ID NO: 817 (RAAC03510) and gb|ACA42330.1|, ref|ZP_02605128.1|, ref|ZP_02586769.1|, ref|YP_001049647.1|, and ref|YP_913053.1| (SEQ ID Nos: 819-823 respectively). Amino acids conserved among all sequences are indicated by a "*" and generally conserved amino acids are indicated by a ":".

FIG. 48 depicts a sequence alignment between SEQ ID NO: 834 (RAAC02348) and ref|XP_414088.2|, ref|ZP_01171110.1|, gb|AAF98351.1|, ref|NP_607899.1|, and ref|NP_269831.1| (SEQ ID Nos: 836-840 respectively). Amino acids conserved among all sequences are indicated by a "*" and generally conserved amino acids are indicated by a ":".

FIG. 49 depicts a sequence alignment between SEQ ID NO: 851 (RAAC02349) and ref|YP_001038860.1|, ref|YP_754926.1|, ref|YP_001396671.1|, ref|YP_001254879.1|, and ref|YP_001396310.1| (SEQ ID Nos: 853-857 respectively). Amino acids conserved among all sequences are indicated by a "*" and generally conserved amino acids are indicated by a ":".

FIG. 50 depicts a sequence alignment between SEQ ID NO: 868 (RAAC03270) and ref|YP_001655174.1|, emb|CAJ73677.1|, emb|CAJ73386.1|, emb|CAJ74660.1|, and ref|ZP_00516046.1| (SEQ ID Nos: 870-874 respectively). Amino acids conserved among all sequences are indicated by a "*" and generally conserved amino acids are indicated by a ":".

FIG. 51 depicts a sequence alignment between SEQ ID NO: 885 (RAAC03271) and sp|P26545|VE2_HPV5B, ref|XP_001371550.1|, sp|P36786|VE2_HPV19, ref|NP_041368.1|, and ref|XP_001131003.1| (SEQ ID Nos: 887-891 respectively). Amino acids conserved among all sequences are indicated by a "*" and generally conserved amino acids are indicated by a ":".

FIG. 52 depicts a sequence alignment between SEQ ID NO: 902 (RAAC02294) and ref|YP_941474.2|, gb|AAZ42391.1|, ref|ZP_01171098.1|, prf||2123261AD, and ref|NP_498368.2| (SEQ ID Nos: 904-908 respectively). Amino acids conserved among all sequences are indicated by a "*" and generally conserved amino acids are indicated by a ":".

FIG. 53 depicts a sequence alignment between SEQ ID NO: 919 (RAAC02353) and ref|YP_430185.1|, ret|YP_001233893.1|, emb|CAO81523.1|, ref|YP_001603689.1|, and ref|YP_719187.1| (SEQ ID Nos: 921-925 respectively). Amino acids conserved among all sequences are indicated by a "*" and generally conserved amino acids are indicated by a ":".

FIG. 54 depicts a sequence alignment between SEQ ID NO: 936 (RAAC02354) and ref|YP_001438903.1|, ref|YP_001251565.1|, ref|YP_126374.1|, ref|YP_123382.1|, and ref|NP_001251158.1| (SEQ ID Nos: 938-942 respectively). Amino acids conserved among all sequences are indicated by a "*" and generally conserved amino acids are indicated by a ":".

FIG. 55 depicts a sequence alignment between SEQ ID NO: 953 (RAAC02355) and ref|ZP_02758276.1|, gb|ACA42232.1|, ref|ZP_02602342.1|, ref|ZP_02597242.1|, and ref|ZP_02524501.1| (SEQ ID Nos: 955-959 respectively). Amino acids conserved among all sequences are indicated by a "*" and generally conserved amino acids are indicated by a ":".

FIG. 56 depicts a sequence alignment between SEQ ID NO: 970 (RAAC02356) and ref|NP_347717.1|, ref|YP_

423535.1|, ref|ZP_01860459.1|, ref|YP_429187.1|, and ref|YP_645289.1| (SEQ ID Nos: 972-976 respectively). Amino acids conserved among all sequences are indicated by a "*" and generally conserved amino acids are indicated by a ":".

FIG. 57 depicts a sequence alignment between SEQ ID NO: 987 (RAAC02357) and gb|EAY58379.1|, ref|ZP_01505670.1|, ref|NP_856790.1|, ref|NP_217638.1|, and ref|ZP_00876805.1| (SEQ ID Nos: 989-993 respectively). Amino acids conserved among all sequences are indicated by a "*" and generally conserved amino acids are indicated by a ":".

FIG. 58 depicts a sequence alignment between SEQ ID NO: 1004 (RAAC02358) and ref|YP_024839.1|, ref|YP_001456771.1|, ret|YP_655149.1|, ref|XP_748956.1|, and ref|NP_943831.1| (SEQ ID Nos: 1006-1010 respectively). Amino acids conserved among all sequences are indicated by a "*" and generally conserved amino acids are indicated by a ":".

FIG. 59 depicts a sequence alignment between SEQ ID NO: 1038 (RAAC02361) and ref|ZP_01966753.1|, ref|YP_001086797.1|, ref|ZP_01805266.1|, ref|YP_001681547.1|, and ref|ZP_01188985.1| (SEQ ID Nos: 1040-1044 respectively). Amino acids conserved among all sequences are indicated by a "*" and generally conserved amino acids are indicated by a ":".

FIG. 60 depicts a sequence alignment between SEQ ID NO: 1055 (RAAC02362) and ref|YP_157691.1|, ref|ZP_02509777.1|, ref|ZP_02485527.1|, ref|ZP_02406784.1|, and ref|YP_335221.1) (SEQ ID Nos: 1057-1061 respectively). Amino acids conserved among all sequences are indicated by a "*" and generally conserved amino acids are indicated by a FIG. 61 depicts a sequence alignment between SEQ ID NO: 1072 (RAAC02363) and ref|YP_001681084.1|, ref|YP_177318.1|, ref|ZP_02329650.1|, ref|NP_243607.1|, and ref|YP_001421775.1| (SEQ ID Nos: 1074-1078 respectively). Amino acids conserved among all sequences are indicated by a "*" and generally conserved amino acids are indicated by a ":".

FIG. 62 depicts a sequence alignment between SEQ ID NO: 1089 (RAAC02364) and ref|YP_079689.1|, ref|ZP_02329649.1|, ref|ZP_01860132.1|, ref|ZP_01171904.1|, and ref|YP_001487332.1| (SEQ ID Nos: 1091-1095 respectively). Amino acids conserved among all sequences are indicated by a "*" and generally conserved amino acids are indicated by a ":".

FIG. 63 depicts a sequence alignment between SEQ ID NO: 1106 (RAAC02366) and ref|ZP_01614696.1|, gb|ABH06559.1|, gb|AAB95339.1|, ref|YP_161675.1|, and ref|YP_001202661.1| (SEQ ID Nos: 1108-1112 respectively). Amino acids conserved among all sequences are indicated by a "*" and generally conserved amino acids are indicated by a ":".

FIG. 64 depicts a sequence alignment between SEQ ID NO: 1123 (RAAC02367) and ref|ZP_02093159.1|, ref|ZP_02026447.1|, ref|YP_001127515.1|, ref|ZP_02091713.1|, and ref|ZP_02423704.1| (SEQ ID Nos: 1125-1129 respectively). Amino acids conserved among all sequences are indicated by a "*" and generally conserved amino acids are indicated by a ":".

FIG. 65 depicts a sequence alignment between SEQ ID NO: 1140 (RAAC02370) and ref|ZP_00960984.1|, ref|ZP_01035782.1|, ref|ZP_01903846.1|, ref|ZP_01880414.1|, and ref|ZP_01742943.1| (SEQ ID Nos: 1142-1146 respectively). Amino acids conserved among all sequences are indicated by a "*" and gene conserved amino acids are indicated by a ":".

FIG. 66 depicts a sequence alignment between SEQ ID NO: 1157 (RAAC02371) and ref|ZP_02756730.1|, ref|ZP_02833143.1|, ret|YP_521772.1|, ref|ZP_01551668.1|, and ref|YP_887014.1| (SEQ ID Nos: 1159-1163 respectively). Amino acids conserved among all sequences are indicated by a "*" and generally conserved amino acids are indicated by a ":".

FIG. 67 depicts a sequence alignment between SEQ ID NO: 1174 (RAAC02372) and sp|Q7ZXB1|MCM7B_XENLA, ref|YP_324842.1|, ref|NP_486002.1|, ref|XP_660834.1|, and ref|ZP_01733540.1| (SEQ ID Nos: 1176-1180 respectively). Amino acids conserved among all sequences are indicated by a "*" and generally conserved amino acids are indicated by a ":".

FIG. 68 depicts a sequence alignment between SEQ ID NO: 1191 (RAAC02296) and ref|XP_001563017.1|, ref|XP_001615133.1|, ref|YP_001236354.1|, ref|ZP_01776409.1|, and ref|ZP_01565636.1| (SEQ ID Nos: 1193-1197 respectively). Amino acids conserved among all sequences are indicated by a "*" and generally conserved amino acids are indicated by a ":".

FIG. 69 depicts a sequence alignment between SEQ ID NO: 1208 (RAAC02373) and ref|YP_001376930.1|, gb|AAW81277.1|, ref|ZP_02852259.1|, ref|YP_001642790.1|, and ref|YP_001312077.1| (SEQ ID Nos: 1210-1214 respectively). Amino acids conserved among all sequences are indicated by a "*" and generally conserved amino acids are indicated by a ":".

FIG. 70 depicts a sequence alignment between SEQ ID NO: 1225 (RAAC02374) and ref|XP_001467069.1|, ref|YP_001376929.1|, ref|YP_001208199.1|, gb|EAU86007.1|, and ref|YP_946581.1| (SEQ ID Nos: 1227-1231 respectively). Amino acids conserved among all sequences are indicated by a "*" and generally conserved amino acids are indicated by a ":".

FIG. 71 depicts a sequence alignment between SEQ ID NO: 1242 (RAAC02375) and ref|XP_975359.1|, ref|XP_001315633.1|, ref|ZP_02840410.1|, ref|ZP_01467536.1|, and ref|YP_001016790.1| (SEQ ID Nos: 1244-1248 respectively). Amino acids conserved among all sequences are indicated by a "*" and generally conserved amino acids are indicated by a ":".

FIG. 72 depicts a sequence alignment between SEQ ID NO: 1259 (RAAC03273) and ref|YP_502758.1|, gb|EAU81483.1|, ref|ZP_01091610.1|, ref|YP_944003.1|, and ref|YP_462360.1| (SEQ ID Nos: 1261-1265 respectively). Amino acids conserved among all sequences are indicated by a "*" and generally conserved amino acids are indicated by a ":".

FIG. 73 depicts a sequence alignment between SEQ ID NO: 1276 (RAAC02967) and ref|YP_074959.1|, ref|YP_594046.1|, ref|ZP_01846154.1|, sp|Q45618|TRA6_BACST, and ref|YP_828009.1| (SEQ ID Nos: 1278-1282 respectively). Amino acids conserved among all sequences are indicated by a "*" and generally conserved amino acids are indicated by a ":".

FIG. 74 depicts a sequence alignment between SEQ ID NO: 1293 (RAAC03589) and ref|YP_146741.1|, ref|YP_148969.1|, ref|YP_001126171.1|, ref|ZP_02130848.1|, and ref|YP_146154.1| (SEQ ID Nos: 1295-1299 respectively). Amino acids conserved among all sequences are indicated by a "*" and generally conserved amino acids are indicated by a ":".

FIG. 75 depicts a sequence alignment between SEQ ID NO: 1310 (RAAC03695) and ref|ZP_01665148.1|, ref|YP_001111903.1|, ref|YP_752864.1|, ref|YP_753434.1|, and ref|YP_753226.1| (SEQ ID Nos: 1312-1316 respectively).

Amino acids conserved among all sequences are indicated by a "*" and generally conserved amino acids are indicated by a ":".

FIG. 76 depicts a sequence alignment between SEQ ID NO: 1327 (RAAC02318) and reflYP_754943.1l, reflYP_754865.1l, reflYP_431166.1l, reflZP_02171171.1l, and reflYP_519650.1l (SEQ ID Nos: 1329-1333 respectively). Amino acids conserved among all sequences are indicated by a "*" and generally conserved amino acids are indicated by a ":".

FIG. 77 depicts a sequence alignment between SEQ ID NO: 1344 (RAAC02319) and reflYP_431168.1l, reflYP_001212944.1l, reflYP_754944.1l, reflYP_754864.1l, and reflZP_02171383.1l (SEQ ID Nos: 1346-1350 respectively). Amino acids conserved among all sequences are indicated by a "*" and generally conserved amino acids are indicated by a ":".

FIG. 78 depicts a sequence alignment between SEQ ID NO: 1361 (RAAC02333) and retlZP_02734990.1l, reflZP_01265219.1l, reflYP_266430.1l, reflYP_008142.1l, and reflYP_713924.1l (SEQ ID Nos: 1363-1367 respectively). Amino acids conserved among all sequences are indicated by a "*" and generally conserved amino acids are indicated by a ":".

FIG. 79 depicts a sequence alignment between SEQ ID NO: 1378 (RAAC03703) and reflYP_001036724.1l, reflYP_001039064.1l, reflNP_001039349.1l, reflYP_076118.1l, and reflYP_074958.1lX (SEQ ID Nos: 1380-1384 respectively). Amino acids conserved among all sequences are indicated by a "*" and generally conserved amino acids are indicated by a ":".

FIG. 80 depicts a sequence alignment between SEQ ID NO: 1395 (RAAC03568) and reflYP_001039349.1l, reflYP_001036724.1l, reflYP_001039064.1l, reflYP_076118.1l, and reflNP_074958.1lX (SEQ ID Nos: 1397-1401 respectively). Amino acids conserved among all sequences are indicated by a "*" and generally conserved amino acids are indicated by a ":".

FIG. 81 depicts a sequence alignment between SEQ ID NO: 1412 (RAAC03707) and reflYP_519534.1l, reflZP_01370818.1l, reflZP_01372264.1l, reflYP_516922.1l, and reflYP_519084.1lX (SEQ ID Nos: 1414-1418 respectively). Amino acids conserved among all sequences are indicated by a "*" and generally conserved amino acids are indicated by a ":".

FIG. 82 depicts a sequence alignment between SEQ ID NO: 1429 (RAAC03173) and reflYP_431168.1l, reflYP_001212944.1l, reflYP_754944.1l, reflYP_754864.1l, and reflZP_02171383.1lX (SEQ ID Nos: 1431-1435 respectively). Amino acids conserved among all sequences are indicated by a "*" and generally conserved amino acids are indicated by a ":".

FIG. 83 depicts a sequence alignment between SEQ ID NO: 1446 (RAAC02966) and reflYP_074959.1l, reflNP_634718.1l, reflNP_616807.1l, gblAAR99616.1l, and splQ45618lTRA6_BACSTX (SEQ ID Nos: 1448-1452 respectively). Amino acids conserved among all sequences are indicated by a "*" and generally conserved amino acids are indicated by a ":".

FIG. 84 depicts a sequence alignment between SEQ ID NO: 1463 (RAAC00757) and reflYP_430545.1l, reflYP_148444.1l, reflNP_980798.1l, reflYP_001211577.1l, and splQ9KDI8lRUVB_BACHDX (SEQ ID Nos: 1465-1469 respectively). Amino acids conserved among all sequences are indicated by a "*" and generally conserved amino acids are indicated by a FIG. 85 depicts a sequence alignment between SEQ ID NO: 1480 (RAAC00756) and reflYP_234498.1l, reflNP_793742.1l, reflNP_275913.1l, reflZP_00991066.1l, and reflYP_001186768.1lX (SEQ ID Nos: 1482-1486 respectively). Amino acids conserved among all sequences are indicated by a "*" and generally conserved amino acids are indicated by a ":".

FIG. 86 depicts a sequence alignment between SEQ ID NO: 1497 (RAAC00755) and reflYP_644098.1l, reflZP_02848139.1l, reflYP_518701.1l, reflYP_074988.1l, and reflYP_001180347.1lX (SEQ ID Nos: 1499-1503 respectively). Amino acids conserved among all sequences are indicated by a "*" and generally conserved amino acids are indicated by a ":".

FIG. 87 depicts a sequence alignment between SEQ ID NO: 1514 (RAAC01468) and reflYP_146341.1l, reflYP_001513188.1l, reflZP_02261478.1l, reflYP_001373830.1l, and reflZP_02257063.1lX (SEQ ID Nos: 1516-1520 respectively). Amino acids conserved among all sequences are indicated by a "*" and generally conserved amino acids are indicated by a ":".

FIG. 88 depicts a sequence alignment between SEQ ID NO: 1531 (RAAC03178) and reflZP_01665148.1l, reflYP_752864.1l, reflNP_001111903.1l, reflYP_753434.1l, and reflYP_753226.1lX (SEQ ID Nos: 1533-1537 respectively). Amino acids conserved among all sequences are indicated by a "*" and generally conserved amino acids are indicated by a ":".

FIG. 89 depicts a sequence alignment between SEQ ID NO: 1548 (RAAC01937) and dbjlBAF33373.1l, reflYP_001126744.1l, gblAAB52611.1l, gblABM97416.1l, and splP52026lDPO1_BACSTX (SEQ ID Nos: 1550-1554 respectively). Amino acids conserved among all sequences are indicated by a "*" and generally conserved amino acids are indicated by a ":".

FIG. 90 depicts a sequence alignment between SEQ ID NO: 1565 (RAAC01372) and reflYP_001681573.1l, reflZP_00651175.1l, reflYP_473713.1l, gblACA11657.1l, and reflYP_475384.1lX (SEQ ID Nos: 1567-1571 respectively). Amino acids conserved among all sequences are indicated by a "*" and generally conserved amino acids are indicated by a ":".

FIG. 91 depicts a sequence alignment between SEQ ID NO: 1582 (RAAC00062) and reflZP_01695687.1l, reflZP_01695971.1l, reflZP_01695982.1l, reflZP_01695655.1l, and reflYP_430569.1lX (SEQ ID Nos: 1584-1588 respectively). Amino acids conserved among all sequences are indicated by a "*" and generally conserved amino acids are indicated by a ":".

FIG. 92 depicts a sequence alignment between SEQ ID NO: 1599 (RAAC02377) and reflYP_752864.1l, reflZP_01665148.1l, reflYP_001111903.1l, reflYP_754667.1l, and reflYP_753226.1lX (SEQ ID Nos: 1601-1605 respectively). Amino acids conserved among all sequences are indicated by a "*" and generally conserved amino acids are indicated by a ":".

FIG. 93 depicts a sequence alignment between SEQ ID NO: 1633 (RAAC03117) and reflYP_754865.1l, reflYP_754943.1l, reflYP_431166.1l, reflZP_02171171.1l, and reflYP_001318017.1lX (SEQ ID Nos: 1635-1639 respectively). Amino acids conserved among all sequences are indicated by a "*" and generally conserved amino acids are indicated by a ":".

FIG. 94 depicts a sequence alignment between SEQ ID NO: 1650 (RAAC00037) and reflYP_001514390.1l, reflNP_780819.1l, reflYP_001663996.1l, reflYP_699899.1l, and reflYP_077153.1lX (SEQ ID Nos: 1652-1656 respectively). Amino acids conserved among all sequences are indicated by a "*" and generally conserved amino acids are indicated by a ":".

FIG. 95 depicts a sequence alignment between SEQ ID NO: 1667 (RAAC00054) and ref|NP_387885.1|, ref|YP_803557.1|, ref|YP_077286.1|, ref|ZP_02326643.1|, and ref|YP_001419683.1|X (SEQ ID Nos: 1669-1673 respectively). Amino acids conserved among all sequences are indicated by a "*" and generally conserved amino acids are indicated by a ":".

FIG. 96 depicts a sequence alignment between SEQ ID NO: 1684 (RAAC03102) and ref|YP_074959.1|, gb|AAR99616.1|, sp|Q45618|TRA6_BACST, ref|YP_075129.1|, and ref|YP_359963.1|X (SEQ ID Nos: 1686-1690 respectively). Amino acids conserved among all sequences are indicated by a "*" and generally conserved amino acids are indicated by a ":".

FIG. 97 depicts a sequence alignment between SEQ ID NO: 1701 (RAAC03103) and ref|YP_074959.1|, ref|YP_594046.1|, ref|ZP_02563000.1|, ref|ZP_02516401.1|, and ref|ZP_02335796.1|X (SEQ ID Nos: 1703-1707 respectively). Amino acids conserved among all sequences are indicated by a "*" and generally conserved amino acids are indicated by a ":".

FIG. 98 depicts a sequence alignment between SEQ ID NO: 1718 (RAAC03341) and ref|YP_076075.1|, ref|NP_074958.1|, ref|YP_076118.1|, ref|YP_001039349.1|, and ref|YP_001036724.1|X (SEQ ID Nos: 1720-1724 respectively). Amino acids conserved among all sequences are indicated by a "*" and generally conserved amino acids are indicated by a ":".

FIG. 99 depicts a sequence alignment between SEQ ID NO: 1786 (RAAC02852) and ref|YP_001125185.1|, ref|YP_147064.1|, ref|YP_001486753.1|, ref|NP_389494.1|, and ref|YP_091420.1|X (SEQ ID Nos: 1788-1792 respectively). Amino acids conserved among all sequences are indicated by a "*" and generally conserved amino acids are indicated by a ":".

FIG. 100 depicts a sequence alignment between SEQ ID NO: 1803 (RAAC02854) and ref|YP_001125186.1|, ref|ZP_01775043.1|, ref|YP_175772.1|, ref|NP_243331.1|, and ref|YP_740910.1|X (SEQ ID Nos: 1805-1809 respectively). Amino acids conserved among all sequences are indicated by a "*" and generally conserved amino acids are indicated by a ":".

FIG. 101 depicts a sequence alignment between SEQ ID NO: 1820 (RAAC03166) and ref|YP_001211938.1|, dbj|BAD22831.1|, ref|ZP_01666445.1|, ref|ZP_01665334.1|, and gb|EAY56013.1|X (SEQ ID Nos: 1822-1826 respectively). Amino acids conserved among all sequences are indicated by a "*" and generally conserved amino acids are indicated by a ":".

FIG. 102 depicts a sequence alignment between SEQ ID NO: 1854 (RAAC02961) and ref|ZP_02330756.1|, ref|ZP_02327778.1|, ref|ZP_02330395.1|, ref|ZP_02327484.1|, and ref|ZP_02326400.1|X (SEQ ID Nos: 1856-1860 respectively). Amino acids conserved among all sequences are indicated by a "*" and generally conserved amino acids are indicated by a ":".

FIG. 103 depicts a sequence alignment between SEQ ID NO: 1871 (RAAC02202) and ref|YP_146129.1|, sp|O87703|DNLJ_BACST, gb|ABN05294.1|, ref|YP_001124385.1|, and ref|ZP_01169975.1|X (SEQ ID Nos: 1873-1877 respectively). Amino acids conserved among all sequences are indicated by a "*" and generally conserved amino acids are indicated by a ":".

FIG. 104 depicts a sequence alignment between SEQ ID NO: 1888 (RAAC03682) and ref|ZP_01695687.1|, ref|ZP_01695971.1|, ref|ZP_01695982.1|, ref|ZP_01695655.1|, and ref|YP_430569.1|X (SEQ ID Nos: 1890-1894 respectively). Amino acids conserved among all sequences are indicated by a "*" and generally conserved amino acids are indicated by a ":".

FIG. 105 depicts a sequence alignment between SEQ ID NO: 1922 (RAAC03770) and ref|ZP_01695687.1|, ref|ZP_01695971.1|, ref|ZP_01695982.1|, ref|ZP_01695655.1|, and ref|YP_430569.1|X (SEQ ID Nos: 1924-1928 respectively). Amino acids conserved among all sequences are indicated by a "*" and generally conserved amino acids are indicated by a ":".

FIG. 106 depicts a sequence alignment between SEQ ID NO: 1939 (RAAC02738) and ref|NP_842969.1|, ref|YP_430640.1|, ref|ZP_02596019.1|, ref|YP_001666203.1|, and ref|YP_001512589.1|X (SEQ ID Nos: 1941-1945 respectively). Amino acids conserved among all sequences are indicated by a "*" and generally conserved amino acids are indicated by a ":".

FIG. 107 depicts a sequence alignment between SEQ ID NO: 1956 (RAAC02514) and ref|YP_001114460.1|, ref|YP_001111555.1|, ref|YP_001112147.1|, ref|YP_001111684.1|, and ref|YP_001113963.1|X (SEQ ID Nos: 1958-1962 respectively). Amino acids conserved among all sequences are indicated by a "*" and generally conserved amino acids are indicated by a ":".

FIG. 108 depicts a sequence alignment between SEQ ID NO: 1973 (RAAC02515) and ref|YP_001111555.1|, ref|YP_001111684.1|, ref|YP_001114460.1|, ref|YP_001113963.1|, and dbj|BAD18231.1|X (SEQ ID Nos: 1975-1979 respectively). Amino acids conserved among all sequences are indicated by a "*" and generally conserved amino acids are indicated by a ":".

FIG. 109 depicts a sequence alignment between SEQ ID NO: 1990 (RAAC02530) and ref|YP_001212947.1|, ref|YP_431166.1|, ref|YP_754943.1|, ref|YP_754865.1|, and ret|YP_001318017.1|X (SEQ ID Nos: 1992-1996 respectively). Amino acids conserved among all sequences are indicated by a "*" and generally conserved amino acids are indicated by a ":".

FIG. 110 depicts a sequence alignment between SEQ ID NO: 2007 (RAAC02533) and ref|YP_001039349.1|, ref|YP_001036724.1|, ref|YP_001039064.1|, ref|YP_076118.1|, and ref|YP_076073.1|X (SEQ ID Nos: 2009-2013 respectively). Amino acids conserved among all sequences are indicated by a "*" and generally conserved amino acids are indicated by a ":".

FIG. 111 depicts a sequence alignment between SEQ ID NO: 2024 (RAAC02534) and ref|YP_076118.1|, ref|YP_074958.1|, ref|YP_001039349.1|, ref|YP_001036724.1|, and ref|YP_001039064.1|X (SEQ ID Nos: 2026-2030 respectively). Amino acids conserved among all sequences are indicated by a "*" and generally conserved amino acids are indicated by a ":".

FIG. 112 depicts a sequence alignment between SEQ ID NO: 2041 (RAAC02562) and ref|YP_148733.1|, ref|YP_146224.1|, ref|ZP_02619781.1|, ref|ZP_02171259.1|, and ref|NP_977687.1|X (SEQ ID Nos: 2043-2047 respectively). Amino acids conserved among all sequences are indicated by a "*" and generally conserved amino acids are indicated by a ":".

FIG. 113 depicts a sequence alignment between SEQ ID NO: 2058 (RAAC03229) and ref|YP_519534.1|, ref|ZP_01370818.1|, ref|ZP_01372264.1|, ref|YP_516922.1|, and ref|YP_520815.1|X (SEQ ID Nos: 2060-2064 respectively).

Amino acids conserved among all sequences are indicated by a "*" and generally conserved amino acids are indicated by a ":".

FIG. 114 depicts a sequence alignment between SEQ ID NO: 2092 (RAAC00160) and ref|YP_001125159.1|, ref|ZP_02849289.1|, ref|ZP_02329219.1|, ref|YP_147039.1|, and ref|NP_816723.1|X (SEQ ID Nos: 2094-2098 respectively). Amino acids conserved among all sequences are indicated by a "*" and generally conserved amino acids are indicated by a ":".

FIG. 115 depicts a sequence alignment between SEQ ID NO: 2109 (RAAC03182) and ref|YP_146741.1|, ref|NP_148969.1|, ref|YP_001126171.1|, ret|ZP_02130848.1|, and ref|YP_146154.1|X (SEQ ID Nos: 2111-2115 respectively). Amino acids conserved among all sequences are indicated by a "*" and generally conserved amino acids are indicated by a ":".

FIG. 116 depicts a sequence alignment between SEQ ID NO: 2126 (RAAC03163) and ref|YP_148733.1|, ref|YP_146224.1|, ref|ZP_02171259.1|, ref|ZP_02619781.1|, and ref|NP_977687.1|X (SEQ ID Nos: 2128-2132 respectively). Amino acids conserved among all sequences are indicated by a "*" and generally conserved amino acids are indicated by a ":".

FIG. 117 depicts a sequence alignment between SEQ ID NO: 2143 (RAAC01387) and ref|YP_148733.1|, ref|YP_146224.1|, ref|ZP_02171259.1|, ref|ZP_02619781.1|, and ref|YP_001396471.1|X (SEQ ID Nos: 2145-2149 respectively). Amino acids conserved among all sequences are indicated by a "*" and generally conserved amino acids are indicated by a ":".

FIG. 118 depicts a sequence alignment between SEQ ID NO: 2160 (RAAC03385) and gb|AAL87775.1|AF403183_1286, ref|YP_517288.1|, ref|YP_517659.1|, ref|ZP_01368657.1|, and ref|YP_001212990.1|X (SEQ ID Nos: 2162-2166 respectively). Amino acids conserved among all sequences are indicated by a "*" and generally conserved amino acids are indicated by a ":".

FIG. 119 depicts a sequence alignment between SEQ ID NO: 2177 (RAAC03398) and ref|YP_001126171.1|, ref|YP_148969.1|, ref|YP_146154.1|, ref|YP_146741.1|, and ref|ZP_02172080.1|X (SEQ ID Nos: 2179-2183 respectively). Amino acids conserved among all sequences are indicated by a "*" and generally conserved amino acids are indicated by a ":".

FIG. 120 depicts a sequence alignment between SEQ ID NO: 2194 (RAAC03177) and ref|YP_148969.1|, ref|YP_146154.1|, ref|YP_001126171.1|, ref|YP_146741.1|, and ref|ZP_02172080.1|X (SEQ ID Nos: 2196-2200 respectively). Amino acids conserved among all sequences are indicated by a "*" and generally conserved amino acids are indicated by a ":".

FIG. 121 depicts a sequence alignment between SEQ ID NO: 2211 (RAAC03588) and ref|YP_001036724.1|, ref|YP_001039064.1|, ref|YP_001039349.1|, ref|YP_074105.1|, and ref|YP_076073.1|X (SEQ ID Nos: 2213-2217 respectively). Amino acids conserved among all sequences are indicated by a "*" and generally conserved amino acids are indicated by a ":".

FIG. 122 depicts a sequence alignment between SEQ ID NO: 2228 (RAAC03818) and ref|YP_074959.1|, ref|NP_634718.1|, gb|AAR99616.1|, sp|Q45618|TRA6_BACST, and ref|NP_616807.1|X (SEQ ID Nos: 2230-2234 respectively). Amino acids conserved among all sequences are indicated by a "*" and generally conserved amino acids are indicated by a ":".

FIG. 123 depicts a sequence alignment between SEQ ID NO: 2245 (RAAC03819) and ref|NP_594046.1|, ref|YP_074959.1|, ref|YP_359963.1|, ref|YP_361300.1|, and ref|NP_622784.1|X (SEQ ID Nos: 2247-2251 respectively). Amino acids conserved among all sequences are indicated by a "*" and generally conserved amino acids are indicated by a ":".

FIG. 124 depicts a sequence alignment between SEQ ID NO: 2262 (RAAC03823) and ref|ZP_01695687.1|, ref|ZP_01695971.1|, ref|ZP_01695982.1|, ref|ZP_01695655.1|, and ref|YP_430569.1|X (SEQ ID Nos: 2264-2268 respectively). Amino acids conserved among all sequences are indicated by a "*" and generally conserved amino acids are indicated by a ":".

FIG. 125 depicts a sequence alignment between SEQ ID NO: 2279 (RAAC01171) and ref|ZP_02330348.1|, ref|ZP_02328298.1|, ref|ZP_02326599.1|, ref|YP_001664428.1|, and ref|YP_001664274.1| (SEQ ID Nos: 2281-2285 respectively). Amino acids conserved among all sequences are indicated by a "*" and generally conserved amino acids are indicated by a ":".

FIG. 126 depicts a sequence alignment between SEQ ID NO: 2296 (RAAC03825) and ref|YP_519534.1|, ref|ZP_01370818.1|, ref|ZP_01372264.1|, ref|YP_516922.1|, and ref|YP_520815.1| (SEQ ID Nos: 2298-2302 respectively). Amino acids conserved among all sequences are indicated by a "*" and generally conserved amino acids are indicated by a ":".

FIG. 127 depicts a sequence alignment between SEQ ID NO: 2313 (RAAC03826) and ref|ZP_02851608.1|, ref|ZP_02326599.1|, ref|YP_001307815.1|, ref|YP_001212943.1|, and ref|YP_001113174.1| (SEQ ID Nos: 2315-2319 respectively). Amino acids conserved among all sequences are indicated by a "*" and generally conserved amino acids are indicated by a ":".

FIG. 128 depicts a sequence alignment between SEQ ID NO: 2330 (RAAC02717) and ref|ZP_01002160.1|, ref|ZP_01592598.1|, ref|YP_001229345.1|, ref|YP_771767.1|, and ref|YP_245447.1| (SEQ ID Nos: 2332-2336 respectively). Amino acids conserved among all sequences are indicated by a "*" and generally conserved amino acids are indicated by a ":".

FIG. 129 depicts a sequence alignment between SEQ ID NO: 2347 (RAAC01155) and ref|YP_145872.1|, ref|YP_001124150.1|, ref|ZP_02850412.1|, ref|NP_240902.1|, and ref|NP_466224.1| (SEQ ID Nos: 2349-2353 respectively). Amino acids conserved among all sequences are indicated by a "*" and generally conserved amino acids are indicated by a ":".

FIG. 130 depicts a sequence alignment between SEQ ID NO: 2364 (RAAC03145) and dbj|BAA94830.1|, ref|ZP_01666433.1|, ref|YP_001213263.1|, ref|YP_387030.1|, and ref|YP_387237.1| (SEQ ID Nos: 2366-2370 respectively). Amino acids conserved among all sequences are indicated by a "*" and generally conserved amino acids are indicated by a ":".

FIG. 131 depicts a sequence alignment between SEQ ID NO: 2381 (RAAC03325) and ref|YP_146741.1|, ref|YP_148969.1|, ref|YP_001126171.1|, ref|ZP_02130848.1|, and ref|YP_146154.1| (SEQ ID Nos: 2383-2387 respectively). Amino acids conserved among all sequences are indicated by a "*" and generally conserved amino acids are indicated by a ":".

FIG. 132 depicts a sequence alignment between SEQ ID NO: 2398 (RAAC03376) and ref|ZP_02851608.1|, ref|ZP_02326599.1|, ref|YP_001664274.1|, ref|YP_001307815.1|, and ref|YP_001319448.1| (SEQ ID Nos:

2400-2404 respectively). Amino acids conserved among all sequences are indicated by a "*" and generally conserved amino acids are indicated by a ":".

FIG. 133 depicts a sequence alignment between SEQ ID NO: 2415 (RAAC02657) and ref|YP_076090.1|, ref|NP_001516732.1|, ref|YP_001185431.1|, ref|YP_318565.1|, and ref|ZP_01061333.1| (SEQ ID Nos: 2417-2421 respectively). Amino acids conserved among all sequences are indicated by a "*" and generally conserved amino acids are indicated by a ":".

FIG. 134 depicts a sequence alignment between SEQ ID NO: 2432 (RAAC01373) and ref|YP_001680037.1|, ref|YP_001505049.1|, ref|YP_482514.1|, ref|YP_481774.1|, and ref|NP_215436.1| (SEQ ID Nos: 2434-2438 respectively). Amino acids conserved among all sequences are indicated by a "*" and generally conserved amino acids are indicated by a ":".

FIG. 135 depicts a sequence alignment between SEQ ID NO: 2449 (RAAC00337) and ref|YP_001680296.1|, ref|YP_342400.1|, ref|NP_756021.1|, ref|YP_405147.1|, and ref|NP_709160.1| (SEQ ID Nos: 2451-2455 respectively). Amino acids conserved among all sequences are indicated by a "*" and generally conserved amino acids are indicated by a ":".

FIG. 136 depicts a sequence alignment between SEQ ID NO: 2466 (RAAC00506) and emb|CAD18993.1|, ref|ZP_00995572.1|, ref|YP_805441.1|, ref|YP_001115956.1|, and ref|ZP_02134324.1| (SEQ ID Nos: 2468-2472 respectively). Amino acids conserved among all sequences are indicated by a "*" and generally conserved amino acids are indicated by a ":".

FIG. 137 depicts a sequence alignment between SEQ ID NO: 2483 (RAAC00022) and ref|ZP_01695451.1|, ref|NP_391924.1|, ref|YP_001488901.1|, ref|NP_244897.1|, and ref|YP_001423303.1| (SEQ ID Nos: 2485-2489 respectively). Amino acids conserved among all sequences are indicated by a "*" and generally conserved amino acids are indicated by a ":".

FIG. 138 depicts a sequence alignment between SEQ ID NO: 2500 (RAAC00027) and ref|YP_001213441.1|, ref|NP_244917.1|, ref|YP_001377189.1|, ref|YP_149334.1|, and ref|YP_077145.1| (SEQ ID Nos: 2502-2506 respectively). Amino acids conserved among all sequences are indicated by a "*" and generally conserved amino acids are indicated by a ":".

FIG. 139 depicts a sequence alignment between SEQ ID NO: 2517 (RAAC01051) and ref|YP_074151.1|, ref|YP_001255315.1|, ref|YP_001392092.1|, gb|ACA43749.1|, and ref|ZP_02619122.1|X (SEQ ID Nos: 2519-2523 respectively). Amino acids conserved among all sequences are indicated by a "*" and generally conserved amino acids are indicated by a ":".

FIG. 140 depicts a sequence alignment between SEQ ID NO: 2534 (RAAC01050) and ref|YP_878438.1|, ref|ZP_02621211.1|, ref|YP_001560315.1|, ref|YP_001392091.1|, and ref|YP_001255314.1|X (SEQ ID Nos: 2536-2540 respectively). Amino acids conserved among all sequences are indicated by a "*" and generally conserved amino acids are indicated by a ":".

FIG. 141 depicts a sequence alignment between SEQ ID NO: 2551 (RAAC01009) and ref|NP_148023.1|, ref|YP_001126202.1|, ref|YP_001421643.1|, ref|ZP_01697284.1|, and gb|ABN10253.1|X (SEQ ID Nos: 2553-2557 respectively). Amino acids conserved among all sequences are indicated by a "*" and generally conserved amino acids are indicated by a ":".

FIG. 142 depicts a sequence alignment between SEQ ID NO: 2568 (RAAC00998) and ref|ZP_02175216.1|, ref|YP_464174.1|, ref|YP_753805.1|, ref|ZP_02321813.1|, and ref|ZP_01575281.1|X (SEQ ID Nos: 2570-2574 respectively). Amino acids conserved among all sequences are indicated by a "*" and generally conserved amino acids are indicated by a ":".

FIG. 143 depicts a sequence alignment between SEQ ID NO: 2585 (RAAC02359) and ref|NP_832076.1|, ref|YP_001645033.1|, ref|NP_844759.1|, ref|YP_001375058.1|, and ref|YP_535778.1|X (SEQ ID Nos: 2587 FIG. 153-2591 respectively). Amino acids conserved among all sequences are indicated by a "*" and generally conserved amino acids are indicated by a ":".

FIG. 144 depicts a sequence alignment between SEQ ID NO: 2602 (RAAC00997) and ref|ZP_02854041.1|, ref|YP_075626.1|, ref|YP_753804.1|, ref|ZP_01667008.1|, and ref|YP_946103.1|X (SEQ ID Nos: 2604-2608 respectively). Amino acids conserved among all sequences are indicated by a "*" and generally conserved amino acids are indicated by a ":".

FIG. 145 depicts a sequence alignment between SEQ ID NO: 2619 (RAAC02419) and ref|ZP_02330146.1|, ref|YP_001210709.1|, ref|ZP_02184702.1|, gb|AAD26564.1|AF124258_1, and ref|ZP_01828805.1|X (SEQ ID Nos: 2621-2625 respectively). Amino acids conserved among all sequences are indicated by a "*" and generally conserved amino acids are indicated by a ":".

FIG. 146 depicts a sequence alignment between SEQ ID NO: 2636 (RAAC02417) and ref|NP_469419.1|, ref|ZP_02309926.1|, ref|ZP_01926077.1|, ref|ZP_01941236.1|, and ref|YP_001111866.1|X (SEQ ID Nos: 2638-2642 respectively). Amino acids conserved among all sequences are indicated by a "*" and generally conserved amino acids are indicated by a ":".

FIG. 147 depicts a sequence alignment between SEQ ID NO: 2653 (RAAC03180) and ref|ZP_02442523.1|, ref|YP_001664041.1|, ref|YP_001210714.1|, ref|ZP_02589119.1|, and ref|NP_242309.1|X (SEQ ID Nos: 2655-2659 respectively). Amino acids conserved among all sequences are indicated by a "*" and generally conserved amino acids are indicated by a ":".

FIG. 148 depicts a sequence alignment between SEQ ID NO: 2670 (RAAC03525) and ref|ZP_02442523.1|, ref|NP_001210714.1|, ref|YP_001180871.1|, ref|YP_001662345.1|, and ref|ZP_02543721.1|X (SEQ ID Nos: 2672-2676 respectively). Amino acids conserved among all sequences are indicated by a "*" and generally conserved amino acids are indicated by a ":".

FIG. 149 depicts a sequence alignment between SEQ ID NO: 2687 (RAAC03224) and ref|YP_006607.1|, ref|YP_001038857.1|, ret|YP_146372.1|, ref|YP_001662865.1|, and ref|ZP_02781438.1|X (SEQ ID Nos: 2689-2693 respectively). Amino acids conserved among all sequences are indicated by a "*" and generally conserved amino acids are indicated by a ":".

FIG. 150 depicts a sequence alignment between SEQ ID NO: 2704 (RAAC02915) and ref|YP_001211829.1|, ref|ZP_02091210.1|, ref|YP_518738.1|, ref|ZP_02378091.1|, and ref|ZP_02454559.1|X (SEQ ID Nos: 2706-2710 respectively). Amino acids conserved among all sequences are indicated by a "*" and generally conserved amino acids are indicated by a ":".

FIG. 151 depicts a sequence alignment between SEQ ID NO: 2721 (RAAC02943) and ref|ZP_02850845.1|, ref|NP_243249.1|, emb|CAD56684.1|, ref|YP_079090.1|, and ref|YP_001421272.1|X (SEQ ID Nos: 2723-2727 respectively). Amino acids conserved among all sequences are indicated by a "*" and generally conserved amino acids are indicated by a ":".

FIG. 152 depicts a sequence alignment between SEQ ID NO: 2738 (RAAC02234) and ref|NP_242725.1|, ref|YP_175539.1|, ref|ZP_02170975.1|, ref|ZP_01696769.1|, and emb|CAJ73252.1|X (SEQ ID Nos: 2740-2744 respectively). Amino acids conserved among all sequences are indicated by a "*" and generally conserved amino acids are indicated by a ":".

FIG. 153 depicts a sequence alignment between SEQ ID NO: 2755 (RAAC01662) and emb|CAK51299.1|, ref|YP_832554.1|, emb|CAI78402.1|, ref|YP_001362100.1|, and ref|YP_712120.1|X (SEQ ID Nos: 2757-2761 respectively). Amino acids conserved among all sequences are indicated by a "*" and generally conserved amino acids are indicated by a ":".

FIG. 154 depicts a sequence alignment between SEQ ID NO: 2772 (RAAC02171) and ref|ZP_01188667.1|, ref|ZP_02620185.1|, ret|YP_001512273.1|, ref|YP_877450.1|, and ref|YP_001275096.1|X (SEQ ID Nos: 2774-2778 respectively). Amino acids conserved among all sequences are indicated by a "*" and generally conserved amino acids are indicated by a ":".

FIG. 155 depicts a sequence alignment between SEQ ID NO: 2789 (RAAC01696) and sp|P80579|THIO_ALIAC, pdb|1NW2|A, pdb|1NSW|A, pdb|1RQM|A, and ref|YP_703612.1|X (SEQ ID Nos: 2791-2795 respectively). Amino acids conserved among all sequences are indicated by a "*" and generally conserved amino acids are indicated by a ":".

FIG. 156 depicts a sequence alignment between SEQ ID NO: 2806 (RAAC01724) and ref|NP_244119.1|, ret|ZP_02850022.1|, ref|YP_815236.1|, ref|NP_965472.1|, and ref|YP_001422284.1|X (SEQ ID Nos: 2808-2812 respectively). Amino acids conserved among all sequences are indicated by a "*" and generally conserved amino acids are indicated by a ":".

FIG. 157 depicts a sequence alignment between SEQ ID NO: 2823 (RAAC01817) and ref|ZP_02326197.1|, ref|YP_001212789.1|, ref|ZP_01666637.1|, ref|YP_001211675.1|, and ref|ZP_01126596.1|X (SEQ ID Nos: 2825-2829 respectively). Amino acids conserved among all sequences are indicated by a "*" and generally conserved amino acids are indicated by a ":".

FIG. 158 depicts a sequence alignment between SEQ ID NO: 2840 (RAAC01840) and ref|YP_001514193.1|, ref|YP_517020.1|, ref|YP_001317996.1|, ref|NP_001090064.1|, and ref|ZP_01995293.1|X (SEQ ID Nos: 2842-2846 respectively). Amino acids conserved among all sequences are indicated by a "*" and generally conserved amino acids are indicated by a ":".

FIG. 159 depicts a sequence alignment between SEQ ID NO: 2857 (RAAC01875) and ref|YP_644758.1|, ref|YP_604970.1|, ref|YP_076566.1|, ref|NP_295807.1|, and ref|YP_357266.1|X (SEQ ID Nos: 2859-2863 respectively). Amino acids conserved among all sequences are indicated by a "*" and generally conserved amino acids are indicated by a ":".

FIG. 160 depicts a sequence alignment between SEQ ID NO: 2874 (RAAC02539) and ref|ZP_01034116.1|, gb|ABY83631.1|, ref|ZP_02297879.1|, ref|YP_208280.1|, and ref|YP_001516905.1|X (SEQ ID Nos: 2876-2880 respectively). Amino acids conserved among all sequences are indicated by a "*" and generally conserved amino acids are indicated by a ":".

FIG. 161 depicts a sequence alignment between SEQ ID NO: 2891 (RAAC02543) and ret|ZP_01042597.1|, gb|ABO14793.1|, ret|YP_001443312.1|, ref|ZP_01815366.1|, and ref|YP_205672.1|X (SEQ ID Nos: 2893-2897 respectively). Amino acids conserved among all sequences are indicated by a "*" and generally conserved amino acids are indicated by a ":".

FIG. 162 depicts a sequence alignment between SEQ ID NO: 2908 (RAAC02564) and ref|ZP_01631840.1|, gb|AAZ73681.1|, ref|YP_001633718.1|, ref|YP_001275109.1|, and ref|ZP_01514022.1|X (SEQ ID Nos: 2910-2914 respectively). Amino acids conserved among all sequences are indicated by a "*" and generally conserved amino acids are indicated by a ":".

FIG. 163 depicts a sequence alignment between SEQ ID NO: 2925 (RAAC02566) and ref|YP_853610.1|, ref|YP_512277.1|, ref|NP_001038857.1|, ref|ZP_01959153.1|, and ref|YP_001662865.1|X (SEQ ID Nos: 2927-2931 respectively). Amino acids conserved among all sequences are indicated by a "*" and generally conserved amino acids are indicated by a ":".

FIG. 164 depicts a sequence alignment between SEQ ID NO: 2942 (RAAC02589) and ref|ZP_00591928.1|, ret|YP_001003150.1|, ref|NP_046614.1|, ref|YP_375842.1|, and ref|YP_001131112.1|X (SEQ ID Nos: 2944-2948 respectively). Amino acids conserved among all sequences are indicated by a "*" and generally conserved amino acids are indicated by a ":".

FIG. 165 depicts a sequence alignment between SEQ ID NO: 2959 (RAAC02045) and ref|ZP_02848186.1|, ref|YP_080797.1|, ref|YP_001127101.1|, ref|YP_148915.1|, and ref|YP_001488316.1|X (SEQ ID Nos: 2961-2965 respectively). Amino acids conserved among all sequences are indicated by a "*" and generally conserved amino acids are indicated by a ":".

FIG. 166 depicts a sequence alignment between SEQ ID NO: 2976 (RAAC02635) and ref|YP_866618.1|, ref|YP_342704.1|, ref|NP_384606.1|, ref|YP_115396.1|, and ref|YP_911114.1|X (SEQ ID Nos: 2978-2982 respectively). Amino acids conserved among all sequences are indicated by a "*" and generally conserved amino acids are indicated by a ":".

FIG. 167 depicts a sequence alignment between SEQ ID NO: 2993 (RAAC00088) and ref|NP_244431.1|, ref|ZP_02848186.1|, ref|ZP_02171648.1|, ref|ZP_02210735.1|, and ref|YP_176521.1|X (SEQ ID Nos: 2995-2999 respectively). Amino acids conserved among all sequences are indicated by a "*" and generally conserved amino acids are indicated by a ":".

FIG. 168 depicts a sequence alignment between SEQ ID NO: 3010 (RAAC00111) and ref|YP_146448.1|, ref|NP_977168.1|, ref|ZP_02261191.1|, ref|ZP_02848045.1|, and ref|NP_981890.1|X (SEQ ID Nos: 3012-3016 respectively). Amino acids conserved among all sequences are indicated by a "*" and generally conserved amino acids are indicated by a ":".

FIG. 169 depicts a sequence alignment between SEQ ID NO: 3027 (RAAC03161) and ref|ZP_01898092.1|, ref|ZP_01221581.1|, ref|YP_128524.1|, ref|ZP_01236658.1|, and ref|ZP_01161642.1|X (SEQ ID Nos: 3029-3033 respectively). Amino acids conserved among all sequences are indicated by a "*" and generally conserved amino acids are indicated by a ":".

FIG. 170 depicts a sequence alignment between SEQ ID NO: 3044 (RAAC03110) and ref|YP_001567845.1|, gb|ACA00199.1|, ref|ZP_01731959.1|, ref|NP_490383.1|, and ref|YP_319960.1|X (SEQ ID Nos: 3046-3050 respectively). Amino acids conserved among all sequences are indicated by a "*" and generally conserved amino acids are indicated by a ":".

FIG. 171 depicts a sequence alignment between SEQ ID NO: 3061 (RAAC03810) and emb|CAP00374.1|, ref|YP_001038857.1|, ref|NP_852746.1|, ref|ZP_01959153.1|, and ref|YP_853610.1|X (SEQ ID Nos: 3063-3067 respectively). Amino acids conserved among all sequences are indicated by a "*" and generally conserved amino acids are indicated by a ":".

FIG. 172 depicts a sequence alignment between SEQ ID NO: 3078 (RAAC03316) and emb|CAP00374.1|, ref|YP_001038857.1|, ref|ZP_02327844.1|, ref|NP_852746.1|, and ref|ZP_01959153.1|X (SEQ ID Nos: 3080-3084 respectively). Amino acids conserved among all sequences are indicated by a "*" and generally conserved amino acids are indicated by a ":".

FIG. 173 depicts a sequence alignment between SEQ ID NO: 3095 (RAAC03018) and ref|YP_148854.1|, ref|YP_001127043.1|, ref|YP_080555.1|, ref|NP_693306.1|, and ref|ZP_02170973.1|X (SEQ ID Nos: 3097-3101 respectively). Amino acids conserved among all sequences are indicated by a "*" and generally conserved amino acids are indicated by a ":".

FIG. 174 depicts a sequence alignment between SEQ ID NO: 3112 (RAAC02718) and ref|YP_001178926.1|, ref|YP_001180877.1|, ret|YP_001219837.1|, ref|YP_001211485.1|, and ret|YP_001211518.1|X (SEQ ID Nos: 3114-3118 respectively). Amino acids conserved among all sequences are indicated by a "*" and generally conserved amino acids are indicated by a ":".

FIG. 175 depicts a sequence alignment between SEQ ID NO: 3129 (RAAC01115) and ref|YP_001035109.1|, ref|ZP_01819917.1|, ref|YP_001450442.1|, ref|ZP_01818216.1|, and ref|ZP_01830009.1|X (SEQ ID Nos: 3131-3135 respectively). Amino acids conserved among all sequences are indicated by a "*" and generally conserved amino acids are indicated by a ":".

FIG. 176 depicts a sequence alignment between SEQ ID NO: 3146 (RAAC01119) and ref|NP_622644.1|, ref|YP_001664955.1|, ret|YP_076287.1|, ref|ZP_02616274.1|, and ref|YP_001255422.1|X (SEQ ID Nos: 3148-3152 respectively). Amino acids conserved among all sequences are indicated by a "*" and generally conserved amino acids are indicated by a ":".

FIG. 177 depicts a sequence alignment between SEQ ID NO: 3163 (RAAC00203) and ref|YP_001433837.1|, ref|YP_001276310.1|, ref|ZP_01514627.1|, ref|YP_001636906.1|, and ref|YP_001102862.1|X (SEQ ID Nos: 3165-3169 respectively). Amino acids conserved among all sequences are indicated by a "*" and generally conserved amino acids are indicated by a ":".

FIG. 178 depicts a sequence alignment between SEQ ID NO: 3180 (RAAC01413) and ref|ZP_02849297.1|, ref|NP_815033.1|, ref|YP_796463.1|, ref|NP_862606.1|, and ref|ZP_00604769.1|X (SEQ ID Nos: 3182-3186 respectively). Amino acids conserved among all sequences are indicated by a "*" and generally conserved amino acids are indicated by a ":".

FIG. 179 depicts a sequence alignment between SEQ ID NO: 3197 (RAAC01435) and ref|YP_359065.1|, ref|YP_145897.21, ref|NP_387932.1|, ref|YP_001124176.1|, and sp|P42816|KPRS_BACCLX (SEQ ID Nos: 3199-3203 respectively). Amino acids conserved among all sequences are indicated by a "*" and generally conserved amino acids are indicated by a ":".

FIG. 180 depicts a sequence alignment between SEQ ID NO: 3214 (RAAC01442) and ref|ZP_02170919.1|, ref|YP_535778.1|, ref|ZP_01862118.1|, ref|NP_692713.1|, and ref|YP_359077.1|X (SEQ ID Nos: 3216-3220 respectively). Amino acids conserved among all sequences are indicated by a "*" and generally conserved amino acids are indicated by a ":".

FIG. 181 depicts a sequence alignment between SEQ ID NO: 3231 (RAAC00895) and ref|NP_846740.1|, ref|ZP_00238564.1|, ref|ZP_02583512.1|, ref|NP_834002.1|, and ref|ZP_02604064.1|X (SEQ ID Nos: 3233-3237 respectively). Amino acids conserved among all sequences are indicated by a "*" and generally conserved amino acids are indicated by a ":".

FIG. 182 depicts a sequence alignment between SEQ ID NO: 3248 (RAAC03475) and ref|ZP_02442523.1|, ref|YP_001210714.1|, ref|NP_001180871.1|, ref|YP_001662345.1|, and ref|YP_001114120.1|X (SEQ ID Nos: 3250-3254 respectively). Amino acids conserved among all sequences are indicated by a "*" and generally conserved amino acids are indicated by a ":".

FIG. 183 depicts a sequence alignment between SEQ ID NO: 3265 (RAAC03560) and ref|YP_001114120.1|, ref|NP_242309.1|, ref|YP_146346.1|, ref|YP_146347.1|, and ref|YP_001662345.1|X (SEQ ID Nos: 3267-3271 respectively). Amino acids conserved among all sequences are indicated by a "*" and generally conserved amino acids are indicated by a ":".

DETAILED DESCRIPTION OF THE INVENTION

Embodiments of the invention include genes and associated proteins related to genetic recombination from the thermoacidophile *Alicyclobacillus acidocaldarius*. Coding sequences for genes related to recombination were determined from sequence information generated from sequencing the genome of *Alicyclobacillus acidocaldarius*. These genes and proteins may represent targets and/or elements of transformation systems or vectors for genetic engineering for introducing nucleotide sequences of interest into *Alicyclobacillus acidocaldarius*, Gram positive thermophiles, or other organisms. Non-limiting examples of nucleotide sequences found within the genome of *Alicyclobacillus acidocaldarius*, and amino acids coded thereby, associated with recombination are listed in the sequence listing. Examples of these nucleotide sequences and the proteins they encode can be found in Table 1. Proteins related to recombination may be, without limitation, one of any of the following: ATP-dependent DNA helicase recG, ATP-dependent DNA ligase, ATP-dependent endopeptidase clp proteolytic subunit, Chromosome partitioning protein, Crossover junction endodeoxyribonuclease ruvC, Deoxyuridine 5'-triphosphate nucleotidohydrolase, DNA adenine methylase, DNA helicase, DNA integration/recombination/inversion, DNA polymerase I, DNA polymerase III beta chain, DNA polymerase IV, DNA primase, DNA repair protein radC, DNA replication and repair protein recF, DNA replication protein dnaD, DNA topoisomerase I, DNA/RNA helicase (DEAD/DEAH box family), DNA-binding protein HU, Fe—S oxidoreductase, Glycerophosphoryl diester phosphodiesterase, HNH endonuclease family protein, Holliday junction DNA helicase ruvB, Integrase/recombinase (XerC/CodV family), Ligase/carboxyalse family protein, LtrC-like protein, Macrolide-efflux protein, NAD-dependent DNA ligase, Nicotinate phosphoribosyltransferase, nodulin-26, Phage antirepressor protein, Phage protein, Phosphinothricin N-acetyltransferase, Phosphohydrolase, RecA protein, Recombination protein recR, Replicative DNA helicase, Ribonucleoside-diphosphate reductase alpha chain, Ribonucleoside-diphosphate reductase beta chain, Ribose-phosphate pyrophosphokinase, Serine/threonine protein phosphatase, Single-strand DNA binding protein, Single-stranded DNA-binding protein, Site-specific recombinase, Site-specific resolvase/integrase, Thioredoxin, Thymidine kinase, Transcriptional regulator/Lex A repressor, Transcriptional regulator, Cro/CI family, Transposase, TRSE protein, Two-component response regulator, Type II restriction-modification system methylation subunit, and others.

Embodiments of the invention relate in part to the gene sequences and/or protein sequences comprising genes and/or proteins of *Alicyclobacillus acidocaldarius*. Genes and proteins included are those which play a role in genetic manipulation. Intracellular enzyme activities may be thermophilic and/or acidophilic in nature and general examples of similar genes are described in the literature. Classes of genes, sequences, enzymes and factors include, but are not limited to, those listed in Table 1. FIGS. 1-183 provide sequence alignments between polypeptide sequences of the present invention and closely related proteins. Areas of high homology between the polypeptide sequences of the present invention and closely related proteins are indicative of functionality for polypeptide sequences of the present invention for the same purposes as the sequences to which they are aligned.

TABLE 1

*Alicyclobacillus acidocaldarius* coding sequences related to recombination

| Reference | Protein Sequence | Coding Sequence | Function |
|---|---|---|---|
| RAAC02304 | SEQ ID NO: 137 | SEQ ID NO: 138 | Two-component response regulator |
| RAAC02309 | SEQ ID NO: 222 | SEQ ID NO: 223 | TRSE PROTEIN |
| RAAC02315 | SEQ ID NO: 324 | SEQ ID NO: 325 | Chromosome partitioning protein parA |
| RAAC02319 | SEQ ID NO: 409 | SEQ ID NO: 410 | Transposase |
| RAAC02321 | SEQ ID NO: 443 | SEQ ID NO: 444 | Ligase/carboxyalse family protein |
| RAAC02324 | SEQ ID NO: 494 | SEQ ID NO: 495 | Fe—S OXIDOREDUCTASE |
| RAAC02326 | SEQ ID NO: 511 | SEQ ID NO: 512 | nodulin-26 |
| RAAC02332 | SEQ ID NO: 562 | SEQ ID NO: 563 | Phosphinothricin N-acetyltransferase |
| RAAC02292 | SEQ ID NO: 647 | SEQ ID NO: 648 | Transcriptional regulator/Lex A repressor |
| RAAC02340 | SEQ ID NO: 715 | SEQ ID NO: 716 | LtrC-like protein |
| RAAC02341 | SEQ ID NO: 732 | SEQ ID NO: 733 | DNA repair protein radC |
| RAAC02342 | SEQ ID NO: 749 | SEQ ID NO: 750 | DNA polymerase III, beta chain |
| RAAC02348 | SEQ ID NO: 834 | SEQ ID NO: 835 | Single-stranded DNA-binding protein |
| RAAC02358 | SEQ ID NO: 1004 | SEQ ID NO: 1005 | DNA/RNA helicase (DEAD/DEAH box family) |
| RAAC02361 | SEQ ID NO: 1038 | SEQ ID NO: 1039 | DNA helicase II |
| RAAC02363 | SEQ ID NO: 1072 | SEQ ID NO: 1073 | DNA polymerase IV |
| RAAC02318 | SEQ ID NO: 1327 | SEQ ID NO: 1328 | Transposase |
| RAAC02319 | SEQ ID NO: 1344 | SEQ ID NO: 1345 | Transposase |
| RAAC02333 | SEQ ID NO: 1361 | SEQ ID NO: 1362 | DNA integration/recombination/inversion protein |
| RAAC03173 | SEQ ID NO: 1429 | SEQ ID NO: 1430 | Transposase |
| RAAC00757 | SEQ ID NO: 1463 | SEQ ID NO: 1464 | Holliday junction DNA helicase ruvB |
| RAAC00756 | SEQ ID NO: 1480 | SEQ ID NO: 1481 | Holliday junction DNA helicase ruvB |
| RAAC00755 | SEQ ID NO: 1497 | SEQ ID NO: 1498 | Crossover junction endodeoxyribonuclease ruvC |
| RAAC01468 | SEQ ID NO: 1514 | SEQ ID NO: 1515 | Site-specific recombinase |
| RAAC03178 | SEQ ID NO: 1531 | SEQ ID NO: 1532 | Transposase |
| RAAC01937 | SEQ ID NO: 1548 | SEQ ID NO: 1549 | DNA polymerase I |
| RAAC01372 | SEQ ID NO: 1565 | SEQ ID NO: 1566 | Transposase |
| RAAC02377 | SEQ ID NO: 1599 | SEQ ID NO: 1600 | Transposase |
| RAAC00037 | SEQ ID NO: 1650 | SEQ ID NO: 1651 | ATP-dependent DNA helicase recG |
| RAAC00054 | SEQ ID NO: 1667 | SEQ ID NO: 1668 | DNA replication and repair protein recF |
| RAAC03102 | SEQ ID NO: 1684 | SEQ ID NO: 1685 | Transposase |
| RAAC03103 | SEQ ID NO: 1701 | SEQ ID NO: 1702 | Transposase |
| RAAC03341 | SEQ ID NO: 1718 | SEQ ID NO: 1719 | Transposase |
| RAAC02852 | SEQ ID NO: 1786 | SEQ ID NO: 1787 | DNA topoisomerase I (EC 1280.1374.1276.1277) |
| RAAC02854 | SEQ ID NO: 1803 | SEQ ID NO: 1804 | Integrase/recombinase (XerC/CodV family) |
| RAAC03166 | SEQ ID NO: 1820 | SEQ ID NO: 1821 | Transposase |
| RAAC02961 | SEQ ID NO: 1854 | SEQ ID NO: 1855 | DNA integration/recombination/inversion protein |
| RAAC02202 | SEQ ID NO: 1871 | SEQ ID NO: 1872 | NAD-dependent DNA ligase |
| RAAC03682 | SEQ ID NO: 1888 | SEQ ID NO: 1889 | Transposase |
| RAAC02738 | SEQ ID NO: 1939 | SEQ ID NO: 1940 | DNA integration/recombination/inversion protein |
| RAAC02514 | SEQ ID NO: 1956 | SEQ ID NO: 1957 | Transposase |
| RAAC02515 | SEQ ID NO: 1973 | SEQ ID NO: 1974 | Transposase |
| RAAC02530 | SEQ ID NO: 1990 | SEQ ID NO: 1991 | Transposase |
| RAAC02533 | SEQ ID NO: 2007 | SEQ ID NO: 2008 | Transposase |
| RAAC02534 | SEQ ID NO: 2024 | SEQ ID NO: 2025 | Transposase |
| RAAC02562 | SEQ ID NO: 2041 | SEQ ID NO: 2042 | Transposase |
| RAAC03229 | SEQ ID NO: 2058 | SEQ ID NO: 2059 | Transposase |
| RAAC00160 | SEQ ID NO: 2092 | SEQ ID NO: 2093 | ATP-dependent DNA helicase recG |
| RAAC03182 | SEQ ID NO: 2109 | SEQ ID NO: 2110 | Transposase |
| RAAC03163 | SEQ ID NO: 2126 | SEQ ID NO: 2127 | Transposase |
| RAAC01387 | SEQ ID NO: 2143 | SEQ ID NO: 2144 | Transposase |
| RAAC01171 | SEQ ID NO: 2279 | SEQ ID NO: 2280 | Transposase |
| RAAC03825 | SEQ ID NO: 2296 | SEQ ID NO: 2297 | Transposase |
| RAAC03826 | SEQ ID NO: 2313 | SEQ ID NO: 2314 | Transposase |
| RAAC02717 | SEQ ID NO: 2330 | SEQ ID NO: 2331 | Transposase |
| RAAC01155 | SEQ ID NO: 2347 | SEQ ID NO: 2348 | Recombination protein recR |
| RAAC03145 | SEQ ID NO: 2364 | SEQ ID NO: 2365 | Transposase |
| RAAC03325 | SEQ ID NO: 2381 | SEQ ID NO: 2382 | Transposase |
| RAAC03376 | SEQ ID NO: 2398 | SEQ ID NO: 2399 | Transposase |

TABLE 1-continued

Alicyclobacillus acidocaldarius coding sequences related to recombination

| Reference | Protein Sequence | Coding Sequence | Function |
|---|---|---|---|
| RAAC02657 | SEQ ID NO: 2415 | SEQ ID NO: 2416 | Type II restriction-modification system methylation subunit |
| RAAC01373 | SEQ ID NO: 2432 | SEQ ID NO: 2433 | Site-specific resolvase/integrase |
| RAAC00337 | SEQ ID NO: 2449 | SEQ ID NO: 2450 | DNA adenine methylase |
| RAAC00506 | SEQ ID NO: 2466 | SEQ ID NO: 2467 | Serine/threonine protein phosphatase |
| RAAC00022 | SEQ ID NO: 2483 | SEQ ID NO: 2484 | Replicative DNA helicase |
| RAAC00027 | SEQ ID NO: 2500 | SEQ ID NO: 2501 | Single-strand DNA binding protein |
| RAAC01051 | SEQ ID NO: 2517 | SEQ ID NO: 2518 | Ribonucleoside-diphosphate reductase alpha chain |
| RAAC01050 | SEQ ID NO: 2534 | SEQ ID NO: 2535 | Ribonucleoside-diphosphate reductase beta chain |
| RAAC01009 | SEQ ID NO: 2551 | SEQ ID NO: 2552 | DNA replication protein dnaD |
| RAAC00998 | SEQ ID NO: 2568 | SEQ ID NO: 2569 | ATP-dependent DNA ligase |
| RAAC02359 | SEQ ID NO: 2585 | SEQ ID NO: 2586 | DNA-binding protein HU |
| RAAC00997 | SEQ ID NO: 2602 | SEQ ID NO: 2603 | ATP-dependent DNA ligase |
| RAAC02419 | SEQ ID NO: 2619 | SEQ ID NO: 2620 | Site-specific recombinase |
| RAAC02417 | SEQ ID NO: 2636 | SEQ ID NO: 2637 | Transcriptional regulator, Cro/CI family |
| RAAC03180 | SEQ ID NO: 2653 | SEQ ID NO: 2654 | Transcriptional regulator, Cro/CI family |
| RAAC03224 | SEQ ID NO: 2687 | SEQ ID NO: 2688 | Phage antirepressor protein |
| RAAC02915 | SEQ ID NO: 2704 | SEQ ID NO: 2705 | Deoxyuridine 5'-triphosphate nucleotidohydrolase |
| RAAC02943 | SEQ ID NO: 2721 | SEQ ID NO: 2722 | RecA protein |
| RAAC02234 | SEQ ID NO: 2738 | SEQ ID NO: 2739 | Serine/threonine protein phosphatase |
| RAAC01662 | SEQ ID NO: 2755 | SEQ ID NO: 2756 | Macrolide-efflux protein |
| RAAC02171 | SEQ ID NO: 2772 | SEQ ID NO: 2773 | Phosphohydrolase |
| RAAC01696 | SEQ ID NO: 2789 | SEQ ID NO: 2790 | Thioredoxin |
| RAAC01724 | SEQ ID NO: 2806 | SEQ ID NO: 2807 | Thioredoxin |
| RAAC01817 | SEQ ID NO: 2823 | SEQ ID NO: 2824 | Site-specific recombinase |
| RAAC01840 | SEQ ID NO: 2840 | SEQ ID NO: 2841 | Nicotinate phosphoribosyltransferase |
| RAAC01875 | SEQ ID NO: 2857 | SEQ ID NO: 2858 | Glycerophosphoryl diester phosphodiesterase |
| RAAC02539 | SEQ ID NO: 2874 | SEQ ID NO: 2875 | Type II restriction-modification system methylation subunit |
| RAAC02543 | SEQ ID NO: 2891 | SEQ ID NO: 2892 | DNA adenine methylase |
| RAAC02564 | SEQ ID NO: 2908 | SEQ ID NO: 2909 | DNA adenine methylase |
| RAAC02566 | SEQ ID NO: 2925 | SEQ ID NO: 2926 | Phage antirepressor protein |
| RAAC02589 | SEQ ID NO: 2942 | SEQ ID NO: 2943 | DNA-binding protein HU |
| RAAC02045 | SEQ ID NO: 2959 | SEQ ID NO: 2960 | ATP-dependent endopeptidase clp proteolytic subunit clpP |
| RAAC02635 | SEQ ID NO: 2976 | SEQ ID NO: 2977 | Type II restriction-modification system methylation subunit |
| RAAC00088 | SEQ ID NO: 2993 | SEQ ID NO: 2994 | ATP-dependent endopeptidase clp proteolytic subunit clpP |
| RAAC00111 | SEQ ID NO: 3010 | SEQ ID NO: 3011 | Site-specific recombinase |
| RAAC03161 | SEQ ID NO: 3027 | SEQ ID NO: 3028 | DNA adenine methylase |
| RAAC03110 | SEQ ID NO: 3044 | SEQ ID NO: 3045 | HNH endonuclease family protein |
| RAAC03316 | SEQ ID NO: 3078 | SEQ ID NO: 3079 | Phage antirepressor protein |
| RAAC03018 | SEQ ID NO: 3095 | SEQ ID NO: 3096 | Thioredoxin |
| RAAC02718 | SEQ ID NO: 3112 | SEQ ID NO: 3113 | Phage protein |
| RAAC01115 | SEQ ID NO: 3129 | SEQ ID NO: 3130 | Thymidine kinase |
| RAAC01119 | SEQ ID NO: 3146 | SEQ ID NO: 3147 | Glycerophosphoryl diester phosphodiesterase |
| RAAC00203 | SEQ ID NO: 3163 | SEQ ID NO: 3164 | Ribonucleoside-diphosphate reductase beta chain |
| RAAC01413 | SEQ ID NO: 3180 | SEQ ID NO: 3181 | Serine/threonine protein phosphatase |
| RAAC01435 | SEQ ID NO: 3197 | SEQ ID NO: 3198 | Ribose-phosphate pyrophosphokinase |
| RAAC01442 | SEQ ID NO: 3214 | SEQ ID NO: 3215 | DNA-binding protein HU |
| RAAC00895 | SEQ ID NO: 3231 | SEQ ID NO: 3232 | DNA primase |
| RAAC03475 | SEQ ID NO: 3248 | SEQ ID NO: 3249 | Transcriptional regulator, Cro/CI family |

The present invention relates to nucleotides sequences comprising isolated and/or purified nucleotide sequences of the genome of *Alicyclobacillus acidocaldarius* selected from the sequences of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283 or one of their fragments.

The present invention likewise relates to isolated and/or purified nucleotide sequences, characterized in that they comprise at least one of a) a nucleotide sequence of at least one of the sequences of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283 or one of their fragments; b) a nucleotide sequence homologous to a nucleotide sequence such as defined in a); c) a nucleotide sequence complementary to a nucleotide sequence such as defined in a) or b), and a nucleotide sequence of their corresponding RNA; d) a nucleotide sequence capable of hybridizing under stringent conditions with a sequence such as defined in a), b) or c); e) a nucleotide sequence comprising a sequence such as defined in a), b), c) or d); and f) a nucleotide sequence modified by a nucleotide sequence such as defined in a), b), c), d) or e).

Nucleotide, polynucleotide, or nucleic acid sequence will be understood according to the present invention as meaning both a double-stranded or single-stranded DNA in the monomeric and dimeric (so-called in tandem) forms and the transcription products of said DNAs.

Aspects of the invention relate to nucleotide sequences which it has been possible to isolate, purify or partially purify, starting from separation methods such as, for example, ion-exchange chromatography, by exclusion based on molecular size, or by affinity, or alternatively fractionation techniques based on solubility in different solvents, or starting from methods of genetic engineering such as amplification, cloning, and subcloning, it being possible for the sequences of the invention to be carried by vectors.

Isolated and/or purified nucleotide sequence fragment according to the invention will be understood as designating any nucleotide fragment of the genome of *Alicyclobacillus acidocaldarius*, and may include, by way of non-limiting examples, length of at least 8, 12, 20 25, 50, 75, 100, 200, 300, 400, 500, 1000, or more, consecutive nucleotides of the sequence from which it originates.

Specific fragment of an isolated and/or purified nucleotide sequence according to the invention will be understood as designating any nucleotide fragment of the genome of *Alicyclobacillus acidocaldarius*, having, after alignment and comparison with the corresponding fragments of genomic sequences of *Alicyclobacillus acidocaldarius*, at least one nucleotide or base of different nature.

Homologous isolated and/or purified nucleotide sequence in the sense of the present invention is understood as meaning isolated and/or purified a nucleotide sequence having at least a percentage identity with the bases of a nucleotide sequence according to the invention of at least about 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7%, this percentage being purely statistical and it being possible to distribute the differences between the two nucleotide sequences at random and over the whole of their length.

Specific homologous nucleotide sequence in the sense of the present invention is understood as meaning a homologous nucleotide sequence having at least one nucleotide sequence of a specific fragment, such as defined above. Said "specific" homologous sequences can comprise, for example, the sequences corresponding to the genomic sequence or to the sequences of its fragments representative of variants of the genome of *Alicyclobacillus acidocaldarius*. These specific homologous sequences can thus correspond to variations linked to mutations within strains of *Alicyclobacillus acidocaldarius*, and especially correspond to truncations, substitutions, deletions and/or additions of at least one nucleotide. Said homologous sequences can likewise correspond to variations linked to the degeneracy of the genetic code.

The term "degree or percentage of sequence homology" refers to "degree or percentage of sequence identity between two sequences after optimal alignment" as defined in the present application.

Two amino-acids or nucleotide sequences are said to be "identical" if the sequence of amino-acids or nucleotide residues, in the two sequences is the same when aligned for maximum correspondence as described below. Sequence comparisons between two (or more) peptides or polynucleotides are typically performed by comparing sequences of two optimally aligned sequences over a segment or "comparison window" to identify and compare local regions of sequence similarity. Optimal alignment of sequences for comparison may be conducted by the local homology algorithm of Smith and Waterman, *J Mol Biol,* 147, 195-197, by the homology alignment algorithm of Needleman and Wunsch, *J. Mol. Biol.* 48: 443 (1970), by the search for similarity method of Pearson and Lipman, *Proc. Natl. Acad. Sci.* (U.S.A.) 85: 2444 (1988), by computerized implementation of these algorithms (GAP, BESTFIT, FASTA, and TFASTA in the Wisconsin Genetics Software Package, Genetics Computer Group (GCG), 575 Science Dr., Madison, Wis.), or by visual inspection.

"Percentage of sequence identity" (or degree of identity) is determined by comparing two optimally aligned sequences over a comparison window, where the portion of the peptide or polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical amino-acid residue or nucleic acid base occurs in both sequences to yield the number of matched positions, dividing the number of matched positions by the total number of positions in the window of comparison and multiplying the result by 100 to yield the percentage of sequence identity.

The definition of sequence identity given above is the definition that would be used by one of skill in the art. The definition by itself does not need the help of any algorithm, said algorithms being helpful only to achieve the optimal alignments of sequences, rather than the calculation of sequence identity.

From the definition given above, it follows that there is a well defined and only one value for the sequence identity between two compared sequences which value corresponds to the value obtained for the best or optimal alignment.

In the BLAST N or BLAST P "BLAST 2 sequence," software that is available in the web site worldwideweb.blast.ncbi.nlm.nih.gov/Blast.cgi?PAGE_TYPE=BlastSearch&PROG_DEF=blastn&BLAST_PROG_DEF=megaBlast&SHOW_DEFAULTS=on&BLAST_SPEC=blast2seq&LINK_LOC=align2seq, and habitually used by the inventors and in general by the skilled person for comparing and determining the identity between two sequences, gap cost that depends on the sequence length to be compared is directly selected by the software (i.e., 11.2 for substitution matrix BLOSUM-62 for length>85).

Complementary nucleotide sequence of a sequence of the invention is understood as meaning any DNA whose nucleotides are complementary to those of the sequence of the invention, and whose orientation is reversed (antisense sequence).

Hybridization under conditions of stringency with a nucleotide sequence according to the invention is understood as meaning hybridization under conditions of temperature and ionic strength chosen in such a way that they allow the maintenance of the hybridization between two fragments of complementary DNA.

By way of illustration, conditions of great stringency of the hybridization step with the aim of defining the nucleotide fragments described above are advantageously the following.

The hybridization is carried out at a preferential temperature of 65° C. in the presence of SSC buffer, 1×SSC corresponding to 0.15 M NaCl and 0.05 M Na citrate. The washing steps, for example, can be the following: 2×SSC, at ambient temperature followed by two washes with 2×SSC, 0.5% SDS at 65° C.; 2×0.5×SSC, 0.5% SDS; at 65° C. for 10 minutes each.

The conditions of intermediate stringency, using, for example, a temperature of 42° C. in the presence of a 2×SSC buffer, or of less stringency, for example a temperature of 37° C. in the presence of a 2×SSC buffer, respectively require a globally less significant complementarity for the hybridization between the two sequences.

The stringent hybridization conditions described above for a polynucleotide with a size of approximately 350 bases will be adapted by the person skilled in the art for oligonucleotides of greater or smaller size, according to the teaching of Sambrook et al., 1989.

Among the isolated and/or purified nucleotide sequences according to the invention, are those that can be used as a primer or probe in methods allowing the homologous sequences according to the invention to be obtained, these methods, such as the polymerase chain reaction (PCR), nucleic acid cloning, and sequencing, being well known to the person skilled in the art.

The terms "recombination," "genetic recombination," and "genetic engineering" are used interchangeable herein and refer to the process by which a first stretch of one or more nucleic acids are removed from or added to a second stretch of nucleic acids. Such addition or removal may occur in vivo or ex vivo. The terms also refer to the introduction of coding sequences or genes into cells or organisms for the purposes of expression or regulation of other nucleotide sequences or polypeptides. The terms further refer to the alteration of nucleic acid structure or topology. By way of non-limiting example, altering the "twist," supercoiling, helicity, separation and/or annealing of a nucleotide sequence.

Among the isolated and/or purified nucleotide sequences according to the invention, those are again preferred that can be used as a primer or probe in methods allowing the presence of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283, and one of their fragments, or one of their variants such as defined below to be diagnosed.

The nucleotide sequence fragments according to the invention can be obtained, for example, by specific amplification, such as PCR, or after digestion with appropriate restriction enzymes of nucleotide sequences according to the invention, these methods in particular being described in the work of Sambrook et al., 1989. Such representative fragments can likewise be obtained by chemical synthesis according to methods well known to persons of ordinary skill in the art.

Modified nucleotide sequence will be understood as meaning any nucleotide sequence obtained by mutagenesis according to techniques well known to the person skilled in the art, and containing modifications with respect to the normal sequences according to the invention, for example mutations in the regulatory and/or promoter sequences of polypeptide expression, especially leading to a modification of the rate of expression of said polypeptide or to a modulation of the replicative cycle.

Modified nucleotide sequence will likewise be understood as meaning any nucleotide sequence coding for a modified polypeptide such as defined below.

The present invention relates to nucleotide sequence comprising isolated and/or purified nucleotide sequences of *Alicyclobacillus acidocaldarius*, characterized in that they are selected from the sequences SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283 or one of their fragments.

Embodiments of the invention likewise relate to isolated and/or purified nucleotide sequences characterized in that they comprise a nucleotide sequence selected from: a) at least one of a nucleotide sequence of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283 or one of their fragments or one of their fragments; b) a nucleotide sequence of a specific fragment of a sequence such as defined in a); c) a homologous nucleotide sequence having at least 80% identity with a sequence such as defined in a) or b); d) a complementary nucleotide sequence or sequence of RNA corresponding to a sequence such as defined in a), b) or c); and e) a nucleotide sequence modified by a sequence such as defined in a), b), c) or d).

Among the isolated and/or purified nucleotide sequences according to the invention are the nucleotide sequences of SEQ ID NOS:13-17, 30-34, 47-51, 64-68, 81-85, 98-102, 115-119, 132-136, 149-153, 166-170, 183-187, 200-204, 217-221, 234-238, 251-255, 268-272, 285-289, 302-306, 319-323, 336-340, 353-357, 370-374, 387-391, 404-408, 421-425, 438-442, 455-459, 472-476, 489-493, 506-510, 523-527, 540-544, 557-561, 574-578, 591-595, 608-612, 625-629, 642-646, 659-663, 676-680, 693-697, 710-714, 727-731, 744-748, 761-765, 778-782, 795-799, 812-816, 829-833, 846-850, 863-867, 880-884, 897-901, 914-918, 931-935, 948-952, 965-969, 982-986, 999-1003, 1016-1020, 1033-1037, 1050-1054, 1067-1071, 1084-1088, 1101-1105, 1118-1122, 1135-1139, 1152-1156, 1169-1173, 1186-1190, 1203-1207, 1220-1224, 1237-1241, 1254-1258, 1271-1275, 1288-1292, 1305-1309, 1322-1326, 1339-1343, 1356-1360, 1373-1377, 1390-1394, 1407-1411, 1424-1428, 1441-1445, 1458-1462, 1475-1479, 1492-1496, 1509-1513, 1526-1530, 1543-1547, 1560-1564, 1577-1581, 1594-1598, 1611-1615, 1628-1632, 1645-1649, 1662-1666, 1679-1683, 1696-1700, 1713-1717, 1730-1734, 1747-1751, 1764-1768, 1781-1785, 1798-1802, 1815-1819, 1832-1836, 1849-1853, 1866-1870, 1883-1887, 1900-1904, 1917-1921, 1934-1938, 1951-1955, 1968-1972, 1985-1989, 2002-2006, 2019-2023, 2036-2040, 2053-2057, 2070-2074, 2087-2091, 2104-2108, 2121-2125, 2138-2142, 2155-2159, 2172-2176, 2189-2193, 2206-2210, 2223-2227, 2240-2244, 2257-2261, 2274-2278, 2291-2295, 2308-2312, 2325-2329, 2342-2346, 2359-2363, 2376-2380, 2393-2397, 2410-2414, 2427-2431, 2444-2448, 2461-2465, 2478-2482, 2495-2499, 2512-2516, 2529-2533, 2546-2550, 2563-2567, 2580-2584, 2597-2601, 2614-2618, 2631-2635, 2648-2652, 2665-2669, 2682-2686, 2699-2703, 2716-2720, 2733-2737, 2750-2754, 2767-2771, 2784-2788, 2801-2805, 2818-2822, 2835-2839, 2852-2856, 2869-2873, 2886-2890, 2903-2907, 2920-2924, 2937-2941, 2954-2958, 2971-2975, 2988-2992, 3005-3009, 3022-3026, 3039-3043, 3056-3060, 3073-3077, 3090-3094, 3107-3111, 3124-3128, 3141-3145, 3158-3162, 3175-3179, 3192-3196, 3209-3213, 3226-3230, 3243-3247, 3260-3264, 3277-3281, and 3294-3298; or fragments thereof and any isolated and/or purified nucleotide sequences that have a homology of at least 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7% identity with the at least one of the sequences of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283; or fragments thereof. Such homologous sequences can comprise, for example, the sequences corresponding to the genomic sequences *Alicyclobacillus acidocaldarius*. In the same manner, these specific homologous sequences can correspond to variations linked to mutations within strains of *Alicyclobacillus acidocaldarius* and especially correspond to truncations, substitutions, deletions and/or additions of at least one nucleotide. As will be apparent to one of ordinary skill in the art, such homologues are easily created and identified using conventional techniques and publicly available computer programs such as BLAST. Accordingly, each homologue referenced above should be considered as set forth herein and fully described.

Embodiments of the invention comprise the isolated and/or purified polypeptides coded for by a nucleotide sequence according to the invention, or fragments thereof, whose sequence is represented by a fragment. Amino acid sequences corresponding to the isolated and/or purified polypeptides that can be coded for according to one of the three possible reading frames of at least one of the sequences SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283.

Embodiments of the invention likewise relate to the isolated and/or purified polypeptides, characterized in that they comprise a polypeptide selected from at least one of the amino acid sequences of SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, and 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282; or one of their fragments.

Among the isolated and/or purified polypeptides, according to embodiments of the invention, are the isolated and/or purified polypeptides of amino acid sequence SEQ ID NOS: 8-12, 25-29, 42-46, 59-63, 76-80, 93-97, 110-114, 127-131, 144-148, 161-165, 178-182, 195-199, 212-216, 229-233, 246-250, 263-267, 280-284, 297-301, 314-318, 331-335, 348-352, 365-369, 382-386, 399-403, 416-420, 433-437, 450-454, 467-471, 484-488, 501-505, 518-522, 535-539, 552-556, 569-573, 586-590, 603-607, 620-624, 637-641, 654-658, 671-675, 688-692, 705-709, 722-726, 739-743, 756-760, 773-777, 790-794, 807-811, 824-828, 841-845, 858-862, 875-879, 892-896, 909-913, 926-930, 943-947, 960-964, 977-981, 994-998, 1011-1015, 1028-1032, 1045-1049, 1062-1066, 1079-1083, 1096-1100, 1113-1117, 1130-1134, 1147-1151, 1164-1168, 1181-1185, 1198-1202, 1215-1219, 1232-1236, 1249-1253, 1266-1270, 1283-1287, 1300-1304, 1317-1321, 1334-1338, 1351-1355, 1368-1372, 1385-1389, 1402-1406, 1419-1423, 1436-1440, 1453-1457, 1470-1474, 1487-1491, 1504-1508, 1521-1525, 1538-1542, 1555-1559, 1572-1576, 1589-1593, 1606-1610, 1623-1627, 1640-1644, 1657-1661, 1674-1678, 1691-1695, 1708-1712, 1725-1729, 1742-1746, 1759-1763, 1776-1780, 1793-1797, 1810-

1814, 1827-1831, 1844-1848, 1861-1865, 1878-1882, 1895-1899, 1912-1916, 1929-1933, 1946-1950, 1963-1967, 1980-1984, 1997-2001, 2014-2018, 2031-2035, 2048-2052, 2065-2069, 2082-2086, 2099-2103, 2116-2120, 2133-2137, 2150-2154, 2167-2171, 2184-2188, 2201-2205, 2218-2222, 2235-2239, 2252-2256, 2269-2273, 2286-2290, 2303-2307, 2320-2324, 2337-2341, 2354-2358, 2371-2375, 2388-2392, 2405-2409, 2422-2426, 2439-2443, 2456-2460, 2473-2477, 2490-2494, 2507-2511, 2524-2528, 2541-2545, 2558-2562, 2575-2579, 2592-2596, 2609-2613, 2626-2630, 2643-2647, 2660-2664, 2677-2681, 2694-2698, 2711-2715, 2728-2732, 2745-2749, 2762-2766, 2779-2783, 2796-2800, 2813-2817, 2830-2834, 2847-2851, 2864-2868, 2881-2885, 2898-2902, 2915-2919, 2932-2936, 2949-2953, 2966-2970, 2983-2987, 3000-3004, 3017-3021, 3034-3038, 3051-3055, 3068-3072, 3085-3089, 3102-3106, 3119-3123, 3136-3140, 3153-3157, 3170-3174, 3187-3191, 3204-3208, 3221-3225, 3238-3242, 3255-3259, 3272-3276, and 3289-3293; or fragments thereof or any other isolated and/or purified polypeptides that have a homology of at least 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, or 99.7% identity with at least one of the sequences of SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282; or fragments thereof. As will be apparent to one of ordinary skill in the art, such homologues are easily created and identified using conventional techniques and publicly available computer programs such as BLAST. Accordingly, each homologue referenced above should be considered as set forth herein and fully described.

Embodiments of the invention also relate to the polypeptides, characterized in that they comprise a polypeptide selected from: a) a specific fragment of at least 5 amino acids of a polypeptide of an amino acid sequence according to the invention; b) a polypeptide homologous to a polypeptide such as defined in a); c) a specific biologically active fragment of a polypeptide such as defined in a) or b); and d) a polypeptide modified by a polypeptide such as defined in a), b) or c).

In the present description, the terms polypeptide, peptide and protein are interchangeable.

In embodiments of the invention, the isolated and/or purified polypeptides according to the invention may be glycosylated, pegylated, and/or otherwise post-translationally modified. In further embodiments, glycosylation, pegylation, and/or other post-translational modifications may occur in vivo or in vitro and/or may be performed using chemical techniques. In additional embodiments, any glycosylation, pegylation and/or other post-translational modifications may be N-linked or O-linked.

In embodiments of the invention any one of the isolated and/or purified polypeptides according to the invention may be enzymatically or functionally active at temperatures at or above about 25, 30, 35, 40, 45, 50, 55, 60, 65, 70, 75, 80, 85, 90, and/or 95 degrees Celsius and/or may be enzymatically or functionally active at a pH at, below, and/or above 8, 7, 6, 5, 4, 3, 2, 1, and/or 0. In further embodiments of the invention, glycosylation, pegylation, and/or other posttranslational modification may be required for the isolated and/or purified polypeptides according to the invention to be enzymatically or functionally active at pH at or below 8, 7, 6, 5, 4, 3, 2, 1, and/or 0 or at a temperatures at or above about 25, 30, 35, 40, 45, 50, 55, 60, 65, 70, 75, 80, 85, 90, and/or 95 degrees Celsius.

Aspects of the invention relate to polypeptides that are isolated or obtained by purification from natural sources, or else obtained by genetic recombination, or alternatively by chemical synthesis and that they may thus contain unnatural amino acids, as will be described below.

A "polypeptide fragment" according to the embodiments of the invention is understood as designating a polypeptide containing at least 5 consecutive amino acids, preferably 10 consecutive amino acids or 15 consecutive amino acids.

In the present invention, a specific polypeptide fragment is understood as designating the consecutive polypeptide fragment coded for by a specific fragment nucleotide sequence according to the invention.

"Homologous polypeptide" will be understood as designating the polypeptides having, with respect to the natural polypeptide, certain modifications such as, in particular, a deletion, addition, or substitution of at least one amino acid, a truncation, a prolongation, a chimeric fusion, and/or a mutation. Among the homologous polypeptides, those are preferred whose amino acid sequence has at least 80% or 90%, homology with the sequences of amino acids of polypeptides according to the invention.

"Specific homologous polypeptide" will be understood as designating the homologous polypeptides such as defined above and having a specific fragment of polypeptide according to the invention. In the case of a substitution, one or more consecutive or nonconsecutive amino acids are replaced by "equivalent" amino acids. The expression "equivalent" amino acid is directed here at designating any amino acid capable of being substituted by one of the amino acids of the base structure without, however, essentially modifying the biological activities of the corresponding peptides and such that they will be defined by the following. As will be apparent to one of ordinary skill in the art, such substitutions are easily created and identified using standard molecular biology techniques and publicly available computer programs such as BLAST. Accordingly, each substitution referenced above should be considered as set forth herein and fully described. Examples of such substitutions in the amino acid sequences SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282 may include those isolated and/or purified polypeptides of amino acid sequence SEQ ID NOS:8-12, 25-29, 42-46, 59-63, 76-80, 93-97, 110-

114, 127-131, 144-148, 161-165, 178-182, 195-199, 212-216, 229-233, 246-250, 263-267, 280-284, 297-301, 314-318, 331-335, 348-352, 365-369, 382-386, 399-403, 416-420, 433-437, 450-454, 467-471, 484-488, 501-505, 518-522, 535-539, 552-556, 569-573, 586-590, 603-607, 620-624, 637-641, 654-658, 671-675, 688-692, 705-709, 722-726, 739-743, 756-760, 773-777, 790-794, 807-811, 824-828, 841-845, 858-862, 875-879, 892-896, 909-913, 926-930, 943-947, 960-964, 977-981, 994-998, 1011-1015, 1028-1032, 1045-1049, 1062-1066, 1079-1083, 1096-1100, 1113-1117, 1130-1134, 1147-1151, 1164-1168, 1181-1185, 1198-1202, 1215-1219, 1232-1236, 1249-1253, 1266-1270, 1283-1287, 1300-1304, 1317-1321, 1334-1338, 1351-1355, 1368-1372, 1385-1389, 1402-1406, 1419-1423, 1436-1440, 1453-1457, 1470-1474, 1487-1491, 1504-1508, 1521-1525, 1538-1542, 1555-1559, 1572-1576, 1589-1593, 1606-1610, 1623-1627, 1640-1644, 1657-1661, 1674-1678, 1691-1695, 1708-1712, 1725-1729, 1742-1746, 1759-1763, 1776-1780, 1793-1797, 1810-1814, 1827-1831, 1844-1848, 1861-1865, 1878-1882, 1895-1899, 1912-1916, 1929-1933, 1946-1950, 1963-1967, 1980-1984, 1997-2001, 2014-2018, 2031-2035, 2048-2052, 2065-2069, 2082-2086, 2099-2103, 2116-2120, 2133-2137, 2150-2154, 2167-2171, 2184-2188, 2201-2205, 2218-2222, 2235-2239, 2252-2256, 2269-2273, 2286-2290, 2303-2307, 2320-2324, 2337-2341, 2354-2358, 2371-2375, 2388-2392, 2405-2409, 2422-2426, 2439-2443, 2456-2460, 2473-2477, 2490-2494, 2507-2511, 2524-2528, 2541-2545, 2558-2562, 2575-2579, 2592-2596, 2609-2613, 2626-2630, 2643-2647, 2660-2664, 2677-2681, 2694-2698, 2711-2715, 2728-2732, 2745-2749, 2762-2766, 2779-2783, 2796-2800, 2813-2817, 2830-2834, 2847-2851, 2864-2868, 2881-2885, 2898-2902, 2915-2919, 2932-2936, 2949-2953, 2966-2970, 2983-2987, 3000-3004, 3017-3021, 3034-3038, 3051-3055, 3068-3072, 3085-3089, 3102-3106, 3119-3123, 3136-3140, 3153-3157, 3170-3174, 3187-3191, 3204-3208, 3221-3225, 3238-3242, 3255-3259, 3272-3276, and 3289-3293. These equivalent amino acids may be determined either by depending on their structural homology with the amino acids that they substitute, or on results of comparative tests of biological activity between the different polypeptides, which are capable of being carried out.

By way of nonlimiting example, the possibilities of substitutions capable of being carried out without resulting in an extensive modification of the biological activity of the corresponding modified polypeptides will be mentioned, the replacement, for example, of leucine by valine or isoleucine, of aspartic acid by glutamic acid, of glutamine by asparagine, of arginine by lysine etc., the reverse substitutions naturally being envisageable under the same conditions.

In a further embodiment, substitutions are limited to substitutions in amino acids not conserved among other proteins that have similar identified enzymatic activity. For example, one of ordinary skill in the art may align proteins of the same function in similar organisms and determine which amino acids are generally conserved among proteins of that function. One example of a program that may be used to generate such alignments is worldwideweb.charite.de/bioinf/strap/ in conjunction with the databases provided by the NCBI. Examples of such polypeptides may include, but are not limited to, those found in amino acid sequence SEQ ID NOS:8-12, 25-29, 42-46, 59-63, 76-80, 93-97, 110-114, 127-131, 144-148, 161-165, 178-182, 195-199, 212-216, 229-233, 246-250, 263-267, 280-284, 297-301, 314-318, 331-335, 348-352, 365-369, 382-386, 399-403, 416-420, 433-437, 450-454, 467-471, 484-488, 501-505, 518-522, 535-539, 552-556, 569-573, 586-590, 603-607, 620-624, 637-641, 654-658, 671-675, 688-692, 705-709, 722-726, 739-743, 756-760, 773-777, 790-794, 807-811, 824-828, 841-845, 858-862, 875-879, 892-896, 909-913, 926-930, 943-947, 960-964, 977-981, 994-998, 1011-1015, 1028-1032, 1045-1049, 1062-1066, 1079-1083, 1096-1100, 1113-1117, 1130-1134, 1147-1151, 1164-1168, 1181-1185, 1198-1202, 1215-1219, 1232-1236, 1249-1253, 1266-1270, 1283-1287, 1300-1304, 1317-1321, 1334-1338, 1351-1355, 1368-1372, 1385-1389, 1402-1406, 1419-1423, 1436-1440, 1453-1457, 1470-1474, 1487-1491, 1504-1508, 1521-1525, 1538-1542, 1555-1559, 1572-1576, 1589-1593, 1606-1610, 1623-1627, 1640-1644, 1657-1661, 1674-1678, 1691-1695, 1708-1712, 1725-1729, 1742-1746, 1759-1763, 1776-1780, 1793-1797, 1810-1814, 1827-1831, 1844-1848, 1861-1865, 1878-1882, 1895-1899, 1912-1916, 1929-1933, 1946-1950, 1963-1967, 1980-1984, 1997-2001, 2014-2018, 2031-2035, 2048-2052, 2065-2069, 2082-2086, 2099-2103, 2116-2120, 2133-2137, 2150-2154, 2167-2171, 2184-2188, 2201-2205, 2218-2222, 2235-2239, 2252-2256, 2269-2273, 2286-2290, 2303-2307, 2320-2324, 2337-2341, 2354-2358, 2371-2375, 2388-2392, 2405-2409, 2422-2426, 2439-2443, 2456-2460, 2473-2477, 2490-2494, 2507-2511, 2524-2528, 2541-2545, 2558-2562, 2575-2579, 2592-2596, 2609-2613, 2626-2630, 2643-2647, 2660-2664, 2677-2681, 2694-2698, 2711-2715, 2728-2732, 2745-2749, 2762-2766, 2779-2783, 2796-2800, 2813-2817, 2830-2834, 2847-2851, 2864-2868, 2881-2885, 2898-2902, 2915-2919, 2932-2936, 2949-2953, 2966-2970, 2983-2987, 3000-3004, 3017-3021, 3034-3038, 3051-3055, 3068-3072, 3085-3089, 3102-3106, 3119-3123, 3136-3140, 3153-3157, 3170-3174, 3187-3191, 3204-3208, 3221-3225, 3238-3242, 3255-3259, 3272-3276, and 3289-3293.

Thus, according to one embodiment of the invention, substitutions or mutation may be made at positions that are generally conserved among proteins of that function. In a further embodiment, nucleic acid sequences may be mutated or substituted such that the amino acid they code for is unchanged (degenerate substitutions and/mutations) and/or mutated or substituted such that any resulting amino acid substitutions or mutation are made at positions that are generally conserved among proteins of that function. Examples of such nucleic acid sequences may include, but are not limited to, those found in the nucleotide sequences of SEQ ID NOS:13-17, 30-34, 47-51, 64-68, 81-85, 98-102, 115-119, 132-136, 149-153, 166-170, 183-187, 200-204, 217-221, 234-238, 251-255, 268-272, 285-289, 302-306, 319-323, 336-340, 353-357, 370-374, 387-391, 404-408, 421-425, 438-442, 455-459, 472-476, 489-493, 506-510, 523-527, 540-544, 557-561, 574-578, 591-595, 608-612, 625-629, 642-646, 659-663, 676-680, 693-697, 710-714, 727-731, 744-748, 761-765, 778-782, 795-799, 812-816, 829-833, 846-850, 863-867, 880-884, 897-901, 914-918, 931-935, 948-952, 965-969, 982-986, 999-1003, 1016-1020, 1033-1037, 1050-1054, 1067-1071, 1084-1088, 1101-1105, 1118-1122, 1135-1139, 1152-1156, 1169-1173, 1186-1190, 1203-1207, 1220-1224, 1237-1241, 1254-1258, 1271-1275, 1288-1292, 1305-1309, 1322-1326, 1339-1343, 1356-1360, 1373-1377, 1390-1394, 1407-1411, 1424-1428, 1441-1445, 1458-1462, 1475-1479, 1492-1496, 1509-1513, 1526-1530, 1543-1547, 1560-1564, 1577-1581, 1594-1598, 1611-1615, 1628-1632, 1645-1649, 1662-1666, 1679-1683, 1696-1700, 1713-1717, 1730-1734, 1747-1751, 1764-1768, 1781-1785, 1798-1802, 1815-1819, 1832-1836, 1849-1853, 1866-1870, 1883-1887, 1900-1904, 1917-1921, 1934-1938, 1951-1955, 1968-1972, 1985-1989, 2002-2006, 2019-2023, 2036-2040, 2053-2057, 2070-2074, 2087-2091, 2104-2108, 2121-2125, 2138-2142, 2155-2159, 2172-2176, 2189-2193, 2206-2210, 2223-2227, 2240-2244, 2257-2261, 2274-2278, 2291-2295, 2308-2312, 2325-2329, 2342-2346, 2359-2363, 2376-2380, 2393-2397, 2410-2414, 2427-2431, 2444-2448, 2461-2465, 2478-2482, 2495-2499, 2512-2516, 2529-2533, 2546-2550, 2563-2567, 2580-2584, 2597-2601, 2614-2618, 2631-2635, 2648-2652, 2665-2669, 2682-2686, 2699-2703, 2716-2720, 2733-2737, 2750-2754, 2767-2771, 2784-2788, 2801-2805, 2818-2822, 2835-2839, 2852-2856, 2869-2873, 2886-2890, 2903-2907, 2920-2924, 2937-2941, 2954-2958, 2971-2975, 2988-2992, 3005-3009, 3022-3026, 3039-3043, 3056-3060, 3073-3077, 3090-3094, 3107-3111, 3124-3128, 3141-3145, 3158-3162, 3175-3179, 3192-3196, 3209-3213, 3226-3230, 3243-3247, 3260-3264, 3277-3281, and 3294-3298; or fragments thereof.

The specific homologous polypeptides likewise correspond to polypeptides coded for by the specific homologous nucleotide sequences such as defined above and thus comprise in the present definition the polypeptides that are mutated or correspond to variants that can exist in *Alicyclobacillus acidocaldarius*, and that especially correspond to truncations, substitutions, deletions, and/or additions of at least one amino acid residue.

"Specific biologically active fragment of a polypeptide" according to an embodiment of the invention will be understood in particular as designating a specific polypeptide fragment, such as defined above, having at least one of the characteristics of polypeptides according to the invention. In certain embodiments the peptide is capable of behaving as at least one of the types of proteins outlined in Table 1.

The polypeptide fragments according to embodiments of the invention can correspond to isolated or purified fragments naturally present in *Alicyclobacillus* acidocaldarius or correspond to fragments that can be obtained by cleavage of said polypeptide by a proteolytic enzyme, such as trypsin or chymotrypsin or collagenase, or by a chemical reagent, such as cyanogen bromide (CNBr). Such polypeptide fragments can likewise just as easily be prepared by chemical synthesis, from hosts transformed by an expression vector according to the invention containing a nucleic acid allowing the expression of said fragments, placed under the control of appropriate regulation and/or expression elements.

"Modified polypeptide" of a polypeptide according to an embodiment of the invention is understood as designating a polypeptide obtained by genetic recombination or by chemical synthesis as will be described below, having at least one modification with respect to the normal sequence. These modifications may or may not be able to bear on amino acids at the origin of specificity, and/or of activity, or at the origin of the structural conformation, localization, and of the capacity of membrane insertion of the polypeptide according to the invention. It will thus be possible to create polypeptides of equivalent, increased, or decreased activity, and of equivalent, narrower, or wider specificity. Among the modified polypeptides, it is necessary to mention the polypeptides in which up to 5 or more amino acids can be modified, truncated at the N- or C-terminal end, or even deleted or added.

The methods allowing said modulations on eukaryotic or prokaryotic cells to be demonstrated are well known to the person of ordinary skill in the art. It is likewise well understood that it will be possible to use the nucleotide sequences coding for said modified polypeptides for said modulations, for example through vectors according to the invention and described below.

The preceding modified polypeptides can be obtained by using combinatorial chemistry, in which it is possible to systematically vary parts of the polypeptide before testing them on models, cell cultures or microorganisms for example, to select the compounds that are most active or have the properties sought.

Chemical synthesis likewise has the advantage of being able to use normatural amino acids, or nonpeptide bonds.

Thus, in order to improve the duration of life of the polypeptides according to the invention, it may be of interest to use normatural amino acids, for example in D form, or else amino acid analogs, especially sulfur-containing forms, for example.

Finally, it will be possible to integrate the structure of the polypeptides according to the invention, its specific or modified homologous forms, into chemical structures of polypeptide type or others. Thus, it may be of interest to provide at the N- and C-terminal ends molecules not recognized by proteases.

The nucleotide sequences coding for a polypeptide according to the invention are likewise part of the invention.

The invention likewise relates to nucleotide sequences utilizable as a primer or probe, characterized in that said sequences are selected from the nucleotide sequences according to the invention.

It is well understood that the present invention, in various embodiments, likewise relates to specific polypeptides of *Alicyclobacillus acidocaldarius*, coded for by nucleotide sequences, capable of being obtained by purification from natural polypeptides, by genetic recombination or by chemical synthesis by procedures well known to the person skilled in the art and such as described in particular below. In the same manner, the labeled or unlabeled mono- or polyclonal antibodies directed against said specific polypeptides coded for by said nucleotide sequences are also encompassed by the invention.

Embodiments of the invention additionally relate to the use of a nucleotide sequence according to the invention as a primer or probe for the detection and/or the amplification of nucleic acid sequences.

The nucleotide sequences according to embodiments of the invention can thus be used to amplify nucleotide sequences, especially by the PCR technique (polymerase chain reaction) (Erlich, 1989; Innis et al., 1990; Rolfs et al., 1991; and White et al., 1997).

These oligodeoxyribonucleotide or oligoribonucleotide primers advantageously have a length of at least 8 nucleotides, preferably of at least 12 nucleotides, and even more preferentially at least 20 nucleotides.

Other amplification techniques of the target nucleic acid can be advantageously employed as alternatives to PCR.

The nucleotide sequences of the invention, in particular the primers according to the invention, can likewise be employed in other procedures of amplification of a target nucleic acid, such as: the TAS technique (Transcription-based Amplification System), described by Kwoh et al. in 1989; the 3SR technique (Self-Sustained Sequence Replication), described by Guatelli et al. in 1990; the NASBA technique (Nucleic Acid Sequence Based Amplification), described by Kievitis et al. in 1991; the SDA technique (Strand Displacement Amplification) (Walker et al., NAR, 1992); the TMA technique (Transcription Mediated Amplification).

The polynucleotides of the invention can also be employed in techniques of amplification or of modification of the nucleic acid serving as a probe, such as: the LCR technique (Ligase Chain Reaction), described by Landegren et al. in 1988 and improved by Barany et al. in 1991, which employs a thermostable ligase; the RCR technique (Repair Chain Reaction), described by Segev in 1992; the CPR technique (Cycling Probe Reaction), described by Duck et al. in 1990; the amplification technique with Q-beta replicase, described by Miele et al. in 1983 and especially improved by Chu et al. in 1986, Lizardi et al. in 1988, then by Burg et al. as well as by Stone et al. in 1996.

In the case where the target polynucleotide to be detected is possibly an RNA, for example an mRNA, it will be possible to use, prior to the employment of an amplification reaction with the aid of at least one primer according to the invention or to the employment of a detection procedure with the aid of at least one probe of the invention, an enzyme of reverse transcriptase type in order to obtain a cDNA from the RNA contained in the biological sample. The cDNA obtained will thus serve as a target for the primer(s) or the probe(s) employed in the amplification or detection procedure according to the invention.

The detection probe will be chosen in such a manner that it hybridizes with the target sequence or the amplicon generated from the target sequence. By way of sequence, such a probe will advantageously have a sequence of at least 12 nucleotides, in particular of at least 20 nucleotides, and preferably of at least 100 nucleotides.

Embodiments of the invention also comprise the nucleotide sequences utilizable as a probe or primer according to the invention, characterized in that they are labeled with a radioactive compound or with a nonradioactive compound.

The unlabeled nucleotide sequences can be used directly as probes or primers, although the sequences are generally labeled with a radioactive isotope ($^{32}P$, $^{35}S$, $^{3}H$, $^{125}I$) or with a nonradioactive molecule (biotin, acetylaminofluorene, digoxigenin, 5-bromodeoxyuridine, fluorescein) to obtain probes that are utilizable for numerous applications.

Examples of nonradioactive labeling of nucleotide sequences are described, for example, in French Patent No. 78.10975 or by Urdea et al. or by Sanchez-Pescador et al. in 1988.

In the latter case, it will also be possible to use one of the labeling methods described in patents FR-2 422 956 and FR-2 518 755.

The hybridization technique can be carried out in various manners (Matthews et al., 1988). The most general method consists in immobilizing the nucleic acid extract of cells on a support (such as nitrocellulose, nylon, polystyrene) and in incubating, under well-defined conditions, the immobilized target nucleic acid with the probe. After hybridization, the excess of probe is eliminated and the hybrid molecules foamed are detected by the appropriate method (measurement of the radioactivity, of the fluorescence or of the enzymatic activity linked to the probe).

The invention, in various embodiments, likewise comprises the nucleotide sequences according to the invention, characterized in that they are immobilized on a support, covalently or noncovalently.

According to another advantageous mode of employing nucleotide sequences according to the invention, the latter can be used immobilized on a support and can thus serve to capture, by specific hybridization, the target nucleic acid obtained from the biological sample to be tested. If necessary, the solid support is separated from the sample and the hybridization complex formed between said capture probe and the target nucleic acid is then detected with the aid of a second probe, a so-called detection probe, labeled with an easily detectable element.

Another aspect of the present invention is a vector for the cloning and/or expression of a sequence, characterized in that it contains a nucleotide sequence according to the invention.

The vectors according to the invention, characterized in that they contain the elements allowing the integration, expression and/or the secretion of said nucleotide sequences in a determined host cell, are likewise part of the invention.

The vector may then contain a promoter, signals of initiation and termination of translation, as well as appropriate regions of regulation of transcription. It may be able to be maintained stably in the host cell and can optionally have particular signals specifying the secretion of the translated protein. These different elements may be chosen as a function of the host cell used. To this end, the nucleotide sequences according to the invention may be inserted into autonomous replication vectors within the chosen host, or integrated vectors of the chosen host.

Such vectors will be prepared according to the methods currently used by the person skilled in the art, and it will be possible to introduce the resulting vectors into an appropriate host by standard methods, such as, for example, lipofection, electroporation, conjugation, and thermal shock.

The vectors according to the invention are, for example, vectors of plasmid or viral origin. One example of a vector for the expression of polypeptides of the invention is baculovirus.

These vectors are useful for transforming host cells in order to clone or to express the nucleotide sequences of the invention.

The invention likewise comprises the host cells transformed by a vector according to the invention.

These cells can be obtained by the introduction into host cells of a nucleotide sequence inserted into a vector such as defined above, then the culturing of said cells under conditions allowing the replication and/or expression of the transfected nucleotide sequence.

The host cell can be selected from prokaryotic or eukaryotic systems, such as, for example, bacterial cells (Olins and Lee, 1993), but likewise yeast cells (Buckholz, 1993), as well as plants cells, such as *Arabidopsis* sp., and animal cells, in particular the cultures of mammalian cells (Edwards and Aruffo, 1993), for example, Chinese hamster ovary (CHO) cells, but likewise the cells of insects in which it is possible to use procedures employing baculoviruses, for example sf9 insect cells (Luckow, 1993).

Embodiments of the invention likewise relate to organisms comprising one of such transformed cells according to the invention.

The obtainment of transgenic organisms according to the invention expressing one or more of the coding sequences of *Alicyclobacillus acidocaldarius* or part of the coding sequences may be carried out in, for example, rats, mice, or rabbits according to methods well known to the person skilled in the art, such as by viral or nonviral transfections. It will be possible to obtain the transgenic organisms expressing one or more of such coding sequences by transfection of multiple copies of such coding sequences under the control of a strong promoter of ubiquitous nature, or selective for one type of tissue. It will likewise be possible to obtain the transgenic organisms by homologous recombination in embryonic cell strains, transfer of these cell strains to embryos, selection of the affected chimeras at the level of the reproductive lines, and growth of said chimeras.

The transformed cells as well as the transgenic organisms according to the invention are utilizable in procedures for preparation of recombinant polypeptides.

It is today possible to produce recombinant polypeptides in relatively large quantity by genetic engineering using the cells transformed by expression vectors according to the invention or using transgenic organisms according to the invention.

The procedures for preparation of a polypeptide of the invention in recombinant form, characterized in that they employ a vector and/or a cell transformed by a vector according to the invention and/or a transgenic organism comprising one of said transformed cells according to the invention are themselves comprised in the present invention.

As used herein, "transformation" and "transformed" relate to the introduction of nucleic acids into a cell, whether prokaryotic or eukaryotic. Further, "transformation" and "transformed," as used herein, need not relate to growth control or growth deregulation.

Among the procedures for preparation of a polypeptide of the invention in recombinant form, the preparation procedures employing a vector, and/or a cell transformed by the vector and/or a transgenic organism comprising one of the transformed cells, containing a nucleotide sequence according to the invention coding for a polypeptide of *Alicyclobacillus acidocaldarius*.

A variant according to the invention may consist of producing a recombinant polypeptide fused to a "carrier" protein (chimeric protein). The advantage of this system is that it may allow stabilization of and/or a decrease in the proteolysis of the recombinant product, an increase in the solubility in the course of renaturation in vitro and/or a simplification of the purification when the fusion partner has an affinity for a specific ligand.

More particularly, the invention relates to a procedure for preparation of a polypeptide of the invention comprising the following steps: a) culture of transformed cells under conditions allowing the expression of a recombinant polypeptide of nucleotide sequence according to the invention; b) if need be, recovery of the recombinant polypeptide.

When the procedure for preparation of a polypeptide of the invention employs a transgenic organism according to the invention, the recombinant polypeptide is then extracted from said organism.

The invention also relates to a polypeptide that is capable of being obtained by a procedure of the invention such as described previously.

The invention also comprises a procedure for preparation of a synthetic polypeptide, characterized in that it uses a sequence of amino acids of polypeptides according to the invention.

The invention likewise relates to a synthetic polypeptide obtained by a procedure according to the invention.

The polypeptides according to the invention can likewise be prepared by techniques that are conventional in the field of the synthesis of peptides. This synthesis can be carried out in homogeneous solution or in solid phase.

For example, recourse can be made to the technique of synthesis in homogeneous solution described by Houben-Weyl in 1974.

This method of synthesis consists in successively condensing, two by two, the successive amino acids in the order required, or in condensing amino acids and fragments formed previously and already containing several amino acids in the appropriate order, or alternatively several fragments previously prepared in this way, it being understood that it will be necessary to protect beforehand all the reactive functions carried by these amino acids or fragments, with the exception of amine functions of one and carboxyls of the other or vice-versa, which must normally be involved in the formation of peptide bonds, especially after activation of the carboxyl function, according to the methods well known in the synthesis of peptides.

Recourse may also be made to the technique described by Merrifield in 1966.

To make a peptide chain according to the Merrifield procedure, recourse is made to a very porous polymeric resin, on which is immobilized the first C-terminal amino acid of the chain. This amino acid is immobilized on a resin through its carboxyl group and its amine function is protected. The amino acids that are going to form the peptide chain are thus immobilized, one after the other, on the amino group, which is deprotected beforehand each time, of the portion of the peptide chain already foinied, and which is attached to the resin. When the whole of the desired peptide chain has been formed, the protective groups of the different amino acids forming the peptide chain are eliminated and the peptide is detached from the resin with the aid of an acid.

The invention additionally relates to hybrid polypeptides having at least one polypeptide according to the invention, and a sequence of a polypeptide capable of inducing an immune response in man or animals.

Advantageously, the antigenic determinant is such that it is capable of inducing a humoral and/or cellular response.

It will be possible for such a determinant to comprise a polypeptide according to the invention in glycosylated, pegylated, and/or otherwise post-translationally modified form used with a view to obtaining immunogenic compositions capable of inducing the synthesis of antibodies directed against multiple epitopes.

These hybrid molecules can be formed, in part, of a polypeptide carrier molecule or of fragments thereof according to the invention, associated with a possibly immunogenic part, in particular an epitope of the diphtheria toxin, the tetanus toxin, a surface antigen of the hepatitis B virus (patent FR 79 21811), the VP1 antigen of the poliomyelitis virus or any other viral or bacterial toxin or antigen.

The procedures for synthesis of hybrid molecules encompass the methods used in genetic engineering for constructing hybrid nucleotide sequences coding for the polypeptide sequences sought. It will be possible, for example, to refer advantageously to the technique for obtainment of genes coding for fusion proteins described by Minton in 1984.

The hybrid nucleotide sequences coding for a hybrid polypeptide as well as the hybrid polypeptides according to the invention characterized in that they are recombinant polypeptides obtained by the expression of the hybrid nucleotide sequences are likewise part of the invention.

The invention likewise comprises the vectors characterized in that they contain one of the hybrid nucleotide sequences. The host cells transformed by the vectors, the transgenic organisms comprising one of said transformed cells as well as the procedures for preparation of recombinant polypeptides using the vectors, the transformed cells and/or said transgenic organisms are, of course, likewise part of the invention.

The polypeptides according to the invention, the antibodies according to the invention described below and the nucleotide sequences according to the invention can advantageously be employed in procedures for the detection and/or identification of *Alicyclobacillus acidocaldarius*, in a sample capable of containing them. These procedures, according to the specificity of the polypeptides, the antibodies and the nucleotide sequences according to the invention that will be used, will in particular be able to detect and/or to identify *Alicyclobacillus acidocaldarius*.

The polypeptides according to the invention can advantageously be employed in a procedure for the detection and/or the identification of *Alicyclobacillus acidocaldarius* in a sample capable of containing them, characterized in that it comprises the following steps: a) contacting of this sample with a polypeptide or one of its fragments according to the invention (under conditions allowing an immunological reaction between said polypeptide and the antibodies possibly present in the biological sample); b) demonstration of the antigen-antibody complexes possibly formed.

Any conventional procedure can be employed for carrying out such a detection of the antigen-antibody complexes possibly formed.

By way of nonlimiting example, one method brings into play immunoenzymatic processes according to the ELISA technique, by immunofluorescence, or radioimmunological processes (RIA) or their equivalent.

Thus, the invention likewise relates to the polypeptides according to the invention, labeled with the aid of an adequate label, such as, of the enzymatic, fluorescent or radioactive type.

Such methods comprise, for example, the following acts: deposition of determined quantities of a polypeptide composition according to the invention in the wells of a microtiter plate, introduction into the wells of increasing dilutions of serum, or of a biological sample other than that defined previously, having to be analyzed, incubation of the microtiter plate, introduction into the wells of the microtiter plate of labeled antibodies directed against pig immunoglobulins, the labeling of these antibodies having been carried out with the aid of an enzyme selected from those that are capable of hydrolyzing a substrate by modifying the absorption of the radiation of the latter, at least at a determined wavelength, for example at 550 nm, detection, by comparison with a control test, of the quantity of hydrolyzed substrate.

The polypeptides according to the invention allow monoclonal or polyclonal antibodies to be prepared that are characterized in that they specifically recognize the polypeptides according to the invention. It will advantageously be possible to prepare the monoclonal antibodies from hybridomas according to the technique described by Kohler and Milstein in 1975. It will be possible to prepare the polyclonal antibodies, for example, by immunization of an animal, in particular a mouse, with a polypeptide or a DNA, according to the invention, associated with an adjuvant of the immune response, and then purification of the specific antibodies contained in the serum of the immunized animals on an affinity column on which the polypeptide that has served as an antigen has previously been immobilized. The polyclonal antibodies according to the invention can also be prepared by purification, on an affinity column on which a polypeptide according to the invention has previously been immobilized, of the antibodies contained in the serum of an animal immunologically challenged by *Alicyclobacillus acidocaldarius*, or a polypeptide or fragment according to the invention.

The invention likewise relates to mono- or polyclonal antibodies or their fragments, or chimeric antibodies, characterized in that they are capable of specifically recognizing a polypeptide according to the invention.

It will likewise be possible for the antibodies of the invention to be labeled in the same manner as described previously for the nucleic probes of the invention, such as a labeling of enzymatic, fluorescent or radioactive type.

The invention is additionally directed at a procedure for the detection and/or identification of *Alicyclobacillus acidocaldarius* in a sample, characterized in that it comprises the following steps: a) contacting of the sample with a mono- or polyclonal antibody according to the invention (under conditions allowing an immunological reaction between said antibodies and the polypeptides of *Alicyclobacillus acidocaldarius* possibly present in the biological sample); b) demonstration of the antigen-antibody complex possibly formed.

The present invention likewise relates to a procedure for the detection and/or the identification of *Alicyclobacillus acidocaldarius* in a sample, characterized in that it employs a nucleotide sequence according to the invention.

More particularly, the invention relates to a procedure for the detection and/or the identification of *Alicyclobacillus acidocaldarius* in a sample, characterized in that it contains the following steps: a) if need be, isolation of the DNA from the sample to be analyzed; b) specific amplification of the DNA of the sample with the aid of at least one primer, or a pair of primers, according to the invention; c) demonstration of the amplification products.

These can be detected, for example, by the technique of molecular hybridization utilizing a nucleic probe according to the invention. This probe will advantageously be labeled with a nonradioactive (cold probe) or radioactive isotope.

For the purposes of the present invention, "DNA of the biological sample" or "DNA contained in the biological sample" will be understood as meaning either the DNA present in the biological sample considered, or possibly the cDNA obtained after the action of an enzyme of reverse transcriptase type on the RNA present in said biological sample.

A further embodiment of the invention comprises a method, characterized in that it comprises the following acts: a) contacting of a nucleotide probe according to the invention with a biological sample, the DNA contained in the biological sample having, if need be, previously been made accessible to hybridization under conditions allowing the hybridization of the probe with the DNA of the sample; b) demonstration of the hybrid formed between the nucleotide probe and the DNA of the biological sample.

The present invention also relates to a procedure according to the invention, characterized in that it comprises the following acts: a) contacting of a nucleotide probe immobilized on a support according to the invention with a biological sample, the DNA of the sample having, if need be, previously been made accessible to hybridization, under conditions allowing the hybridization of the probe with the DNA of the sample; b) contacting of the hybrid formed between the nucleotide probe immobilized on a support and the DNA contained in the biological sample, if need be after elimination of the DNA of the biological sample that has not hybridized with the probe, with a nucleotide probe labeled according to the invention; c) demonstration of the novel hybrid formed in act b).

According to an advantageous embodiment of the procedure for detection and/or identification defined previously, this is characterized in that, prior to act a), the DNA of the biological sample is first amplified with the aid of at least one primer according to the invention. Embodiments of methods include methods of altering recombination inside or outside of a cell, the methods comprising: providing a recombinant, purified, and/or isolated nucleotide sequence comprising a nucleotide sequence selected from the group consisting of nucleotide sequences having at least 90% sequence identity to at least one of the sequences of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283; and/or a recombinant, purified, and/or isolated polypeptide selected from the group consisting of a polypeptide having at least 90% sequence identity to at least one of the sequences of SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282 to a nucleotide sequence with which recombination event is desired.

Further embodiments of methods include placing a cell producing or encoding a recombinant, purified, and/or isolated nucleotide sequence comprising a nucleotide sequence selected from the group consisting of a nucleotide sequences having at least 90% sequence identity to at least one of the sequences of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283; and/or a recombinant, purified, and/or isolated polypeptide selected from the group consisting of a polypeptide having at least 90% sequence identity to at least one of the sequences of SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282 in a environment comprising temperatures at or above about 25, 30, 35, 40, 45, 50, 55, 60, 65, 70, 75, 80, 85, 90, and/or 95 degrees Celsius and/or a pH at, below, and/or above 8, 7, 6, 5, 4, 3, 2, 1, and/or 0

The present invention provides cells that have been genetically manipulated to have an altered capacity to produce expressed proteins. In particular, the present invention relates to Gram-positive microorganisms, such as Bacillus species having enhanced expression of a protein of interest, wherein one or more chromosomal genes have been inactivated, and/or wherein one or more chromosomal genes have been deleted from the Bacillus chromosome. In some further embodiments, one or more indigenous chromosomal regions have been deleted from a corresponding wild-type Bacillus host chromosome. In further embodiments, the Bacillus is an *Alicyclobacillus* sp. or *Alicyclobacillus acidocaldarius*.

Additional embodiments, include methods of modulating recombination at temperatures at or above about 25, 30, 35, 40, 45, 50, 55, 60, 65, 70, 75, 80, 85, 90, and/or 95 degrees Celsius and/or at a pH at, below, and/or above 8, 7, 6, 5, 4, 3, 2, 1, and/or 0 via providng a recombinant, purified, and/or isolated nucleotide sequence comprising a nucleotide sequence selected from the group consisting of a nucleotide sequences having at least 90% sequence identity to at least one of the sequences of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283; and/or a recombinant, purified, and/or isolated polypeptide selected from the group consisting of a polypeptide having at least 90% sequence identity to at least one of the sequences of SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282 to a nucleotide sequence in with which a recombination event is desired.

In embodiments of the invention any one of the isolated and/or purified polypeptides according to the invention may be enzymatically or functionally active at temperatures at or above about 25, 30, 35, 40, 45, 50, 55, 60, 65, 70, 75, 80, 85, 90, and/or 95 degrees Celsius and/or may be enzymatically or functionally active at a pH at, below, and/or above 8, 7, 6, 5, 4, 3, 2, 1, and/or 0. In further embodiments of the invention, glycosylation, pegylation, and/or other posttranslational modification may be required for the isolated and/or purified polypeptides according to the invention to be enzymatically or functionally active at pH at or below 8, 7, 6, 5, 4, 3, 2, 1, and/or 0 or at a temperatures at or above about 25, 30, 35, 40, 45, 50, 55, 60, 65, 70, 75, 80, 85, 90, and/or 95 degrees Celsius.

The invention is described in additional detail in the following illustrative examples. Although the examples may represent only selected embodiments of the invention, it should be understood that the following examples are illustrative and not limiting.

EXAMPLES

Example 1

Recombination Using Nucleotide and Amino Acid Sequences from *Alicyclobacillus acidocaldarius*

Provided in SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283 are a nucleotide sequences isolated from *Alicyclobacillus acidocaldarius* and coding for the polypeptides of SEQ ID NOS: 1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282, and respectively. The nucleotide sequences of SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283 are placed into expression vectors using techniques standard in the art. The vectors are then provided to cells such as bacteria cells or eukaryotic cells such as Sf9 cells or CHO cells. In conjunction with the normal machinery in present in the cells, the vectors comprising SEQ ID NOS:2, 19, 36, 53, 70, 87, 104, 121, 138, 155, 172, 189, 206, 223, 240, 257, 274, 291, 308, 325, 359, 376, 410, 427, 444, 512, 529, 546, 597, 614, 648, 665, 682, 699, 716, 733, 750, 767, 784, 818, 835, 852, 886, 903, 920, 937, 954, 971, 988, 1005, 1039, 1056, 1073, 1090, 1107, 1124, 1141, 1158, 1175, 1192, 1209, 1226, 1243, 1260, 1277, 1294, 1311, 1328, 1345, 1362, 1379, 1396, 1413, 1430, 1447, 1464, 1481, 1498, 1515, 1532, 1549, 1566, 1583, 1600, 1634, 1651, 1685, 1702, 1719, 1787, 1804, 1821, 1872, 1889, 1923, 1940, 1957, 1974, 1991, 2008, 2025, 2042, 2059, 2093, 2110, 2127, 2161, 2178, 2195, 2212, 2229, 2246, 2263, 2280, 2314, 2331, 2348, 2365, 2382, 2399, 2416, 2433, 2450, 2467, 2484, 2501, 2518, 2535, 2552, 2569, 2586, 2603, 2620, 2637, 2654, 2671, 2688, 2705, 2722, 2739, 2773, 2790, 2824, 2841, 2858, 2926, 2943, 2960, 3011, 3028, 3062, 3079, 3096, 3113, 3130, 3147, 3164, 3181, 3198, 3232, 3249, 3266, and 3283. The polypeptides of SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282 are then isolated and/or purified. The isolated and/or purified polypeptides of SEQ ID NOS:1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 819, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282 are then each demonstrated to have one or more of the activities provided in Table 1.

The isolated and/or purified polypeptides of SEQ ID NOS: 1, 18, 35, 52, 69, 86, 103, 120, 137, 154, 171, 188, 205, 222, 239, 256, 273, 290, 307, 324, 358, 375, 409, 426, 443, 511, 528, 545, 596, 613, 647, 664, 681, 698, 715, 732, 749, 766, 783, 817, 834, 851, 885, 902, 919, 936, 953, 970, 987, 1004, 1038, 1055, 1072, 1089, 1106, 1123, 1140, 1157, 1174, 1191, 1208, 1225, 1242, 1259, 1276, 1293, 1310, 1327, 1344, 1361, 1378, 1395, 1412, 1429, 1446, 1463, 1480, 1497, 1514, 1531, 1548, 1565, 1582, 1599, 1633, 1650, 1684, 1701, 1718, 1786, 1803, 1820, 1871, 1888, 1922, 1939, 1956, 1973, 1990, 2007, 2024, 2041, 2058, 2092, 2109, 2126, 2160, 2177, 2094, 2211, 2228, 2245, 2262, 2279, 2313, 2330, 2347, 2364, 2381, 2398, 2415, 2432, 2449, 2466, 2483, 2500, 2517, 2534, 2551, 2568, 2585, 2602, 2619, 2636, 2653, 2670, 2687, 2704, 2721, 2738, 2772, 2789, 2823, 2840, 2857, 2925, 2942, 2959, 3010, 3027, 3061, 3078, 3095, 3112, 3129, 3146, 3163, 3180, 3197, 3231, 3248, 3265, and 3282 are demonstrated to have activity as at least one of a ATP-dependent DNA helicase recG, ATP-dependent DNA ligase, ATP-dependent endopeptidase clp proteolytic subunit, Chromosome partitioning protein, Crossover junction endodeoxyribonuclease ruvC, Deoxyuridine 5'-triphosphate nucleotidohydrolase, DNA adenine methylase, DNA helicase, DNA integration/recombination/inversion, DNA polymerase I, DNA polymerase III beta chain, DNA polymerase IV, DNA primase, DNA repair protein radC, DNA replication and repair protein recF, DNA replication protein dnaD, DNA topoisomerase I, DNA/RNA helicase (DEAD/DEAH box family), DNA-binding protein HU, Fe—S oxidoreductase, Glycerophosphoryl diester phosphodiesterase, HNH endonuclease family protein, Holliday junction DNA helicase ruvB, Integrase/recombinase (XerC/CodV family), Ligase/carboxyalse family protein, LtrC-like protein, Macrolide-efflux protein, NAD-dependent DNA ligase, Nicotinate phosphoribosyltransferase, nodulin-26, Phage antirepressor protein, Phage protein, Phosphinothricin N-acetyltransferase, Phosphohydrolase, RecA protein, Recombination protein recR, Replicative DNA helicase, Ribonucleoside-diphosphate reductase alpha chain, Ribonucleoside-diphosphate reductase beta chain, Ribose-phosphate pyrophosphokinase, Serine/threonine protein phosphatase, Single-strand DNA binding protein, Single-stranded DNA-binding protein, Site-specific recombinase, Site-specific resolvase/integrase, Thioredoxin, Thymidine kinase, Transcriptional regulator/Lex A repressor, Transcriptional regulator, Cro/CI family, Transposase, TRSE protein, Two-component response regulator, Type II restriction-modification system methylation subunit.

All references, including publications, patents, and patent applications, cited herein are hereby incorporated by reference to the same extent as if each reference were individually and specifically indicated to be incorporated by reference and were set forth in its entirety herein.

While this invention has been described in certain embodiments, the present invention can be further modified within the spirit and scope of this disclosure. This application is therefore intended to cover any variations, uses, or adaptations of the invention using its general principles. Further, this application is intended to cover such departures from the present disclosure as come within known or customary practice in the art to which this invention pertains and that fall within the limits of the appended claims and their legal equivalents.

BIBLIOGRAPHIC REFERENCES

Barany, F., 1991, *PNAS. USA* 88:189-193.
Buckholz, R. G., 1993, Yeast systems for the expression of heterologous gene products. *Curr. Op. Biotechnology* 4:538-542.
Burg, J. L. et al., 1996, *Mol. and Cell. Probes* 10:257-271.
Chu, B. C. F. et al., 1986, *NAR* 14:5591-5603.
Duck, P. et al., 1990, *Biotechniques* 9:142-147.
Edwards, C. P., and A. Aruffo, 1993, Current applications of COS cell based transient expression systems. *Curr. Op. Biotechnology* 4:558-563.
Guatelli, J. C. et al., 1990, *PNAS. USA* 87:1874-1878.
Houben-Weyl, 1974, in *Methode der Organischen Chemie*, E. Wunsch Ed., Volume 15-I and 15-II, Thieme, Stuttgart.
Innis, M. A. et al., 1990, in *PCR Protocols. A guide to Methods and Applications*, San Diego, Academic Press.
Kievitis, T. et al., 1991, *J. Virol. Methods* 35:273-286.
Kohler, G. et al., 1975, *Nature* 256(5517):495497.
Kwoh, D. Y. et al., 1989, *PNAS. USA* 86:1173-1177.
Luckow, V. A., 1993, Baculovirus systems for the expression of human gene products. *Curr. Op. Biotechnology* 4:564-572.
Matthews, J. A. et al., 1988, *Anal. Biochem.* 169:1-25.
Merrifield, R. D., 1966, *J. Am. Chem. Soc.* 88(21):5051-5052.
Miele, E. A. et al., 1983, *J. Mol. Biol.* 171:281-295.
Olins, P. O., and S. C. Lee, 1993, Recent advances in heterologous gene expression in *E. coli. Curr. Op. Biotechnology* 4:520-525.
Rolfs, A. et al., 1991, In *PCR Topics. Usage of Polymerase Chain reaction in Genetic and Infectious Disease*. Berlin: Springer-Verlag.
Sambrook, J. et al., 1989, In *Molecular cloning: A Laboratory Manual*, Cold Spring Harbor, N.Y.: Cold Spring Harbor Laboratory Press.
Sanchez-Pescador, R., 1988, *J. Clin. Microbiol.* 26(10):1934-1938.
Segev D., 1992, in *Non-radioactive Labeling and Detection of Biomolecules*. Kessler C. Springer Verlag, Berlin, New-York: 197-205.
Urdea, M. S., 1988, *Nucleic Acids Research* 11:4937-4957.
Walker, G. T. et al., 1992, *NAR* 20:1691-1696.
Walker, G. T. et al., 1992, *PNAS. USA* 89:392-396.
White, B. A. et al., 1997, *Methods in Molecular Biology* 67, Humana Press, Totowa, N.J.

SEQUENCE LISTING (3298 sequences)

SEQ ID NO: 1 - protein, 191 aa, Alicyclobacillus acidocaldarius
MLGCVKVGLETGKEAIQRVLNWSCTHFIQRERFMMRKTIAAIVTLGTVSSMLAGTVYAATNTTNATSTGNTANTTASATSNATSNTTGSAPTNPNVLTQKSAVYQLIEVFNTIPSWPTGLQSIDPATQNAQWDWKYKPIPPSQWVGLACVFPGDPESKYAADLGIQMTDPNGPVTAGQLAQWIVDWEVKAR

SEQ ID NO: 2 - DNA, 574 bp, Alicyclobacillus acidocaldarius
atgcttggatgcgttaaagtcggcttggaaacgggcaaggaggcgatccaacgtgtgctaaattggtcttgcactcatttcatccaaagggagcgattcatgatgcgaaagacgattgcagcgattgtgacgttggggacggtttcgtcgatgttggcgggcacggtatacgcggccacaaacacgaccaacgcgacgagcacgggtaatacggcgaatacgacggcaagtgcgacatcgaatgccacgtcgaacacgacgggcagtgcgccgacgaaccccaacgtgctcacgcagaagagcgcggtgtatcagctgattgaggtgttcaacacgatcccgagttggccgacaggtctccaaagcatcgatcctgccacccaaaatgcccagtgggattggaagtacaagccaattccaccgtcacagtgggttgggttggcgtgtgtatttccgggagacccggagtcgaagtacgcggccgacttgggcattcagatgacggacccgaacggaccggtgacggcggggcaactggcgcagtggattgtggactgggaagtgaaggcgcgcc

SEQ ID NO: 3 - protein, 88 aa, Limnobacter MED105
SGPLQGSGEQGQNTVTAPNSSESGALTNSAPQNRTSTSTSSNSPGSAPANPGIATQKSAPSEPVRPSRPTPPAPSGSSGPQPAAPVSQ

SEQ ID NO: 4 - protein, 98 aa, Dehalococcoides CBDB1
TGSSFIEGNVYADDGIDLGWSTPITGDAVTPADINRPGNISGTVTTGAAPQLPNVLTDAEIAAIVTDIQNETAFAAFSPGAITRSSDWNIKYYPVPAS

SEQ ID NO: 5 - protein, 50 aa, Lodderomyces elongisporus
TSTTSTTSTTNTNVPANSTASTTTNSTANSTTSTANNSNQLAQDKAAKYE

SEQ ID NO: 6 - protein, 78 aa, Bovine herpesvirus
SVSTTVSSTSSPSTTLTSTSTTNQTTNTTTASSTPANTTLTSTSPTNQTTTTNNSSGTQTSNTSSTQPPTSQSLDTST

SEQ ID NO: 7 - protein, 98 aa, Monosiga brevicollis
TTSTTSTTSTTSTNSTNSTTSTTSTTSTTSTTSTTSTTSTTSTTSTTSTTSTTSTSSTGNTSSSAISNTTANSTDTSTSMSPSRTNGSDTPSSPAPPA

SEQ ID NO: 8 - protein, 191 aa, Artificial
  Alicyclobacillus acidocaldarius mutated SEQ ID NO 1
MLGCVKVGLETGKEAIQRVLNWSCTHFIQRERFMMRKTIAAIVTLGTVSSMLAGTVYAATNTTNATSTGQTANTTASATSNATSNTTGSAPTNPNVLTQKSAVYQLIEVFNTIPSWPTGLQSIDPATQNAQWDWKYKPIPPSQWVGLACVFPGDPESKYAADLGIQMTDPNGPVTAGQLAQWIVDWEVKAR

SEQ ID NO: 9 - protein, 191 aa, Artificial
  Alicyclobacillus acidocaldarius mutated SEQ ID NO 1
MLGCVKVGLETGKEAIQRVLNWSCTHFIQRERFMMRKTIAAIVTLGTVSSMLAGTVYAATNTTNATSTGNTANTTASATSNATSNTTGSAPTNPNVLTQKSAVYQIIEVFNTIPSWPTGLQSIDPATQNAQWDWKYKPIPPSQWVGLACVFPGDPESKYAADLGIQMTDPNGPVTAGQLAQWIVDWEVKAR

SEQ ID NO: 10 - protein, 191 aa, Artificial
  Alicyclobacillus acidocaldarius mutated SEQ ID NO 1
MLGCVKVGLETGKEAIQRVLNWSCTHFIQRERFMMRKTIAAIVTLGTVSSMLAGTVYAATQTTNATSTGNTANTTASATSNATSNTTGSAPTNPNVLTQKSAVYQLIEVFNTIPSWPTGLQSIDPATQNAQWDWKYKPIPPSQWVGLACVFPGDPESKYAADLGIQMTDPNGPVTAGQLAQWIVDWEVKAR

SEQ ID NO: 11 - protein, 191 aa, Artificial
  Alicyclobacillus acidocaldarius mutated SEQ ID NO 1
MLGCVKVGLETGKEAIQRVLNWSCTHFIQRERFMMRKTIAAIVTLGTVSSMLAGTVYAATNTTNATSTGNTANTTASATSNATSNTTGSAPTNPNVLTQKSAVYQLIEVFNTIPSWPTGLQSIDPATQNAQWDWKYKPLPPSQWVGLACVFPGDPESKYAADLGIQMTDPNGPVTAGQLAQWIVDWEVKAR

SEQ ID NO: 12 - protein, 191 aa, Artificial
  Alicyclobacillus acidocaldarius mutated SEQ ID NO 1
MLGCVKVGLETGKEAIQRVLNWSCTHFIQRERFMMRKTIAAIVTLGTVSSMLAGTVYAATNTTNATSTGNTANTTASATSNATSNTTGSAPTNPNVLTQKSAVYQLIDVFNTIPSWPTGLQSIDPATQNAQWDWKYKPIPPSQWVGLACVFPGDPESKYAADLGIQMTDPNGPVTAGQLAQWIVDWEVKAR

SEQ ID NO: 13 - DNA, 574 bp, Artificial
  Alicyclobacillus acidocaldarius mutated SEQ ID NO 2
atgcttggatgcgttaaagtcggcttggaaacgggcaaggaggcgatccaacgtgtgctaaattggtcttgcactcatttcatccaaagggagcgattcatgatgcgaaagacgattgcagcgattgtgacgttggggacggtttcgtcgatgttggcgggcacggtatacgcggccacaaacacgaccaacgcgacgagcacgggtcaaacggcgaatacgacggcaagtgcgacatcgaatgccacgtcgaacacgacgggcagtgcgccgacgaaccccaacgtgctcacgcagaagagcgcggtgtatcagctgattgaggtgttcaacacgatcccgagttggccgacaggtctccaaagcatcgatcctgccacccaaaatgcccagtgggattggaagtacaagccaattccaccgtcacagtgggttgggttggcgtgtgtatttccgggagacccggagtcgaagtacgcggccgacttgggcattcagatgacggacccgaacggaccggtgacggcggggcaactggcgcagtggattgtggactgggaagtgaaggcgcgcc

SEQ ID NO: 14 - DNA, 574 bp, Artificial
  Alicyclobacillus acidocaldarius mutated SEQ ID NO 2
atgcttggatgcgttaaagtcggcttggaaacgggcaaggaggcgatccaacgtgtgctaaattggtcttgcactcatttcatccaaagggagcgattcatgatgcgaaagacgattgcagcgattgtgacgttggggacggtttcgtcgatgttggcgggcacggtatacgcggccacaaacacgaccaacgcgacgagcacgggtaatacggcgaatacgacggcaagtgcgacatcgaatgccacgtcgaacacgacgggcagtgcgccgacgaaccccaacgtgctcacgcagaagagcgcggtgtatcagattattgaggtgttcaacacgatcccgagttggccgacaggtctccaaagcatcgatcctgccacccaaaatgcccagtgggattggaagtacaagccaattccaccgtcacagtgggttgggttggcgtgtgtatttccgggagacccggagtcgaagtacgcggccgacttgggcattcagatgacggacccgaacggaccggtgacggcggggcaactggcgcagtggattgtggactgggaagtgaaggcgcgcc

SEQ ID NO: 15 - DNA, 574 bp, Artificial
  Alicyclobacillus acidocaldarius mutated SEQ ID NO 2
atgcttggatgcgttaaagtcggcttggaaacgggcaaggaggcgatccaacgtgtgctaaattggtcttgcactcatttcatccaaagggagcgattcatgatgcgaaagacgattgcagcgattgtgacgttggggacggtttcgtcgatgttggcgggcacggtatacgcggccacacaaacgaccaacgcgacgagcacgggtaatacggcgaatacgacggcaagtgcgacatcgaatgccacgtcgaacacgacgggcagtgcgccgacgaaccccaacgtgctcacgcagaagagcgcggtgtatcagctgattgaggtgttcaacacgatcccgagttggccgacaggtctccaaagcatcgatcctgccacccaaaatgcccagtgggattggaagtacaagccaattccaccgtcacagtgggttgggttggcgtgtgtatttccgggagacccggagtcgaagtacgcggccgacttgggcattcagatgacggacccgaacggaccggtgacggcggggcaactggcgcagtggattgtggactgggaagtgaaggcgcgcc

SEQ ID NO: 16 - DNA, 574 bp, Artificial
  Alicyclobacillus acidocaldarius mutated SEQ ID NO 2
atgcttggatgcgttaaagtcggcttggaaacgggcaaggaggcgatccaacgtgtgctaaattggtcttgcactcatttcatccaaagggagcgattcatgatgcgaaagacgattgcagcgattgtgacgttggggacggtttcgtcgatgttggcgggcacggtatacgcggccacaaacacgaccaacgcgacgagcacgggtaatacggcgaatacgacggcaagtgcgacatcgaatgccacgtcgaacacgacgggcagtgcgccgacgaaccccaacgtgctcacgcagaagagcgcggtgtatcagctgattgaggtgttcaacacgatcccgagttggccgacaggtctccaaagcatcgatcctgccacccaaaatgcccagtgggattggaagtacaagccattaccaccgtcacagtgggttgggttggcgtgtgtatttccgggagacccggagtcgaagtacgcggccgacttgggcattcagatgacggacccgaacggaccggtgacggcggggcaactggcgcagtggattgtggactgggaagtgaaggcgcgcc

SEQ ID NO: 17 - DNA, 574 bp, Artificial
  Alicyclobacillus acidocaldarius mutated SEQ ID NO 2
atgcttggatgcgttaaagtcggcttggaaacgggcaaggaggcgatccaacgtgtgctaaattggtcttgcactcatttcatccaaagggagcgattcatgatgcgaaagacgattgcagcgattgtgacgttggggacggtttcgtcgatgttggcgggcacggtatacgcggccacaaacacgaccaacgcgacgagcacgggtaatacggcgaatacgacggcaagtgcgacatcgaatgccacgtcgaacacgacgggcagtgcgccgacgaaccccaacgtgctcacgcagaagagcgcggtgtatcagctgattgatgtgttcaacacgatcccgagttggccgacaggtctccaaagcatcgatcctgccacccaaaatgcccagtgggattggaagtacaagccaattccaccgtcacagtgggttgggttggcgtgtgtatttccgggagacccggagtcgaagtacgcggccgacttgggcattcagatgacggacccgaacggaccggtgacggcggggcaactggcgcagtggattgtggactgggaagtgaaggcgcgcc

SEQ ID NO: 18 - protein, 314 aa, Alicyclobacillus acidocaldarius
MVPFDPSCHARFVHHRNHVLQAETGHLKGGDNGMGYVILALGLVPSVLLVMGAGQGEYAGIRTRARIAAGWYGAKMRVRKRLEDEQLVSLLRKSGLTLKAYQYHYLRIGLTLVFLLMGVVGLLHGRLLPMLFPLVVWFGLEYRRPFPMYYGFLALQKQAALERDKALYLLYRLLLQEAVAFRGRPLGVYDMLRRQLHRVPVLSPFLERCLHDWVDDPAVALRRFGDEVGTSQAKALAHMLIEIEEAGVAVALDVLQTNLERFRADRIAAFRAHLNTRSILATALTMLGLGATSFDLMVVIQVYAGALMRASAGG

SEQ ID NO: 19 - DNA, 945 bp, Alicyclobacillus acidocaldarius
gtggttccttttgacccttcttgccacgctcggttcgttcatcatcggaatcacgttctacaagccgaaacaggacatctgaaggggggtgacaacggcatgggttacgtgattttagccttgggactcgttccaagcgtgctgctggtcatgggggcagggcaaggtgagtatgccggaatacggacacgcgcgcggattgcggccgggtggtatggagccaagatgcgggtgcggaagaggctcgaagacgagcagctcgtctcgttgctgcggaaaagcggcctcacgctgaaggcgtatcagtatcactacctgcgaatcgggttgacgctcgtctttttgcttatgggagtcgtggggcttctccacggacggctgttgccgatgttgtttccgctcgtcgtatggtttgggctcgagtatcggcgtccgttcccgatgtactacggcttccttgccctgcaaaagcaggcggcgttggagcgagacaaggcgctctatctcctctaccgcctgctccttcaagaggcggtcgcgtttcgagggcgaccgctcggggtgtatgacatgttacgccgccaattgcaccgtgtgcctgtcttaagcccgtttttggagcggtgcctgcatgattgggtcgatgatcccgcagttgcactccgacgctttggcgatgaagtgggaacgtcccaagcgaaggcgctggcgcacatgctcatcgagatcgaggaggcaggcgtcgccgtggcgctcgatgtcctccagacgaacctggagcgattccgagccgaccgcattgccgccttccgggcgcacctgaacacgcgctccatcttggcgacggcgcttaccatgctcggacttggagcgacgagtttcgatctgatggtcgtcatccaagtctacgccggcgcactcatgcgcgcgagtgcaggtggatga

SEQ ID NO: 20 - protein, 152 aa, Bacillus NRRL
KRNSELFSLYDMLLSEIEMMQQTRINAYSLIRTLKPYFKELDGTITRLLANWTNDKGPEYALDIFAKEIGTNEAKSLANVLKKFDENKRDTIILSLKGMEDMFINSQIENYRRKRKLYVDLAKLPIKATHGLIILNFVVVIIFMVSYLMKDS

SEQ ID NO: 21 - protein, 65 aa, Moorella thermoacetica
LLRPAVERCIASWSGGALRAIEQLGNDINLKEADVLIAVLMQIVEGGVAKLAGVMEEEALRLDEL

SEQ ID NO: 22 - protein, 85 aa, Oryza sativa
ARVVHHREHAMRAQAGLDRVEQQQAAMGTGQFTGHGIERRRHRAAGVAFAHHRLQEHRFDEPLVTCGILEHLAQAGLVVRRHGDH

SEQ ID NO: 23 - protein, 121 aa, Unknown
  uncultured marine bacterium 582
NGLLVGSYYTLLALGLSIIFSLGGVVNLAHGAFYAVGAYLTVLFTDILGFGLAFLITPAVVGLIGIAIEALFLRRLYNKDPILTLLFTFGLAMSGEQALRLIFGASGIPFSIPEFLSGQLH

SEQ ID NO: 24 - protein, 88 aa, Geobacter bemidjiensis
IARVAAVDRDQLLLVDETHAFRGRVAGGYLHRHHLSQELPCVGDWVCLEKAPGDDVGVVRALLERRTLLRRKSAGDAIEYQMIASNLD

SEQ ID NO: 25 - protein, 314 aa, Artificial
  Alicyclobacillus acidocaldarius mutated SEQ ID NO 18
MVPFDPSCHARFVHHRNHVLQAETGHLKGGDNGMGYVILALGLVPSVLLVMGAGQGEYAGIRTRARIAAGWYGAKMRVRKRLDDEQLVSLLRKSGLTLKAYQYHYLRIGLTLVFLLMGVVGLLHGRLLPMLFPLVVWFGLEYRRPFPMYYGFLALQKQAALERDKALYLLYRLLLQEAVAFRGRPLGVYDMLRRQLHRVPVLSPFLERCLHDWVDDPAVALRRFGDEVGTSQAKALAHMLIEIEEAGVAVALDVLQTNLERFRADRIAAFRAHLNTRSILATALTMLGLGATSFDLMVVIQVYAGALMRASAGG

SEQ ID NO: 26 - protein, 314 aa, Artificial
  Alicyclobacillus acidocaldarius mutated SEQ ID NO 18
MVPFDPSCHARFVHHRNHVLQAETGHIKGGDNGMGYVILALGLVPSVLLVMGAGQGEYAGIRTRARIAAGWYGAKMRVRKRLEDEQLVSLLRKSGLTLKAYQYHYLRIGLTLVFLLMGVVGLLHGRLLPMLFPLVVWFGLEYRRPFPMYYGFLALQKQAALERDKALYLLYRLLLQEAVAFRGRPLGVYDMLRRQLHRVPVLSPFLERCLHDWVDDPAVALRRFGDEVGTSQAKALAHMLIEIEEAGVAVALDVLQTNLERFRADRIAAFRAHLNTRSILATALTMLGLGATSFDLMVVIQVYAGALMRASAGG

SEQ ID NO: 27 - protein, 314 aa, Artificial
  Alicyclobacillus acidocaldarius mutated SEQ ID NO 18
MVPFDPSCHARFVHHRNHVLQAETGHLKGGDNGMGYVILALGLVPSVLLVMGAGQGEYAGIRTRARIAAGWYGAKMRVRKRLEDEQLVSLLRKSGLTLKAYQYHYLRIGLTLVFLLMGVVGLLHGRLLPMLFPLVVWFGLEYRRPFPMYYGFLALQKQAALERDKALYLLYRLLLQEAVAFRGRPLGVYDMLRRQLHRVPVLSPFLERCLHDWVDDPAVALRRFGDEVGTSQAKALAHMLIEIEEAGVAVAIDVLQTNLERFRADRIAAFRAHLNTRSILATALTMLGLGATSFDLMVVIQVYAGALMRASAGG

SEQ ID NO: 28 - protein, 314 aa, Artificial
  Alicyclobacillus acidocaldarius mutated SEQ ID NO 18
MVPFDPSCHARFVHHRNHVLQAETGHLKGGDNGMGYVILALGLVPSVLLVMGAGQGEYAGIRTRARIAAGWYGAKMRVRKRIEDEQLVSLLRKSGLTLKAYQYHYLRIGLTLVFLLMGVVGLLHGRLLPMLFPLVVWFGLEYRRPFPMYYGFLALQKQAALERDKALYLLYRLLLQEAVAFRGRPLGVYDMLRRQLHRVPVLSPFLERCLHDWVDDPAVALRRFGDEVGTSQAKALAHMLIEIEEAGVAVALDVLQTNLERFRADRIAAFRAHLNTRSILATALTMLGLGATSFDLMVVIQVYAGALMRASAGG

SEQ ID NO: 29 - protein, 314 aa, Artificial
  Alicyclobacillus acidocaldarius mutated SEQ ID NO 18
MVPFDPSCHARFVHHRNHVLQAETGHLKGGDNGMGYVILALGLVPSVLLVMGAGQGEYAGIRTRARIAAGWYGAKMRVRKRLEDEQLVSLLRKSGLTLKAYQYHYLRIGLTLVFLLMGVVGLLHGRLLPMLFPLVVWFGLEYRRPFPMYYGFLALQKQAALERDKALYLLYRLILQEAVAFRGRPLGVYDMLRRQLHRVPVLSPFLERCLHDWVDDPAVALRRFGDEVGTSQAKALAHMLIEIEEAGVAVALDVLQTNLERFRADRIAAFRAHLNTRSILATALTMLGLGATSFDLMVVIQVYAGALMRASAGG

SEQ ID NO: 30 - DNA, 945 bp, Artificial
  Alicyclobacillus acidocaldarius mutated SEQ ID NO 19
gtggttccttttgacccttcttgccacgctcggttcgttcatcatcggaatcacgttctacaagccgaaacaggacatctgaaggggggtgacaacggcatgggttacgtgattttagccttgggactcgttccaagcgtgctgctggtcatgggggcagggcaaggtgagtatgccggaatacggacacgcgcgcggattgcggccgggtggtatggagccaagatgcgggtgcggaagaggctcgatgacgagcagctcgtctcgttgctgcggaaaagcggcctcacgctgaaggcgtatcagtatcactacctgcgaatcgggttgacgctcgtctttttgcttatgggagtcgtggggcttctccacggacggctgttgccgatgttgtttccgctcgtcgtatggtttgggctcgagtatcggcgtccgttcccgatgtactacggcttccttgccctgcaaaagcaggcggcgttggagcgagacaaggcgctctatctcctctaccgcctgctccttcaagaggcggtcgcgtttcgagggcgaccgctcggggtgtatgacatgttacgccgccaattgcaccgtgtgcctgtcttaagcccgtttttggagcggtgcctgcatgattgggtcgatgatcccgcagttgcactccgacgctttggcgatgaagtgggaacgtcccaagcgaaggcgctggcgcacatgctcatcgagatcgaggaggcaggcgtcgccgtggcgctcgatgtcctccagacgaacctggagcgattccgagccgaccgcattgccgccttccgggcgcacctgaacacgcgctccatcttggcgacggcgcttaccatgctcggacttggagcgacgagtttcgatctgatggtcgtcatccaagtctacgccggcgcactcatgcgcgcgagtgcaggtggatga

SEQ ID NO: 31 - DNA, 945 bp, Artificial
  Alicyclobacillus acidocaldarius mutated SEQ ID NO 19
gtggttccttttgacccttcttgccacgctcggttcgttcatcatcggaatcacgttctacaagccgaaacaggacatattaaggggggtgacaacggcatgggttacgtgattttagccttgggactcgttccaagcgtgctgctggtcatgggggcagggcaaggtgagtatgccggaatacggacacgcgcgcggattgcggccgggtggtatggagccaagatgcgggtgcggaagaggctcgaagacgagcagctcgtctcgttgctgcggaaaagcggcctcacgctgaaggcgtatcagtatcactacctgcgaatcgggttgacgctcgtctttttgcttatgggagtcgtggggcttctccacggacggctgttgccgatgttgtttccgctcgtcgtatggtttgggctcgagtatcggcgtccgttcccgatgtactacggcttccttgccctgcaaaagcaggcggcgttggagcgagacaaggcgctctatctcctctaccgcctgctccttcaagaggcggtcgcgtttcgagggcgaccgctcggggtgtatgacatgttacgccgccaattgcaccgtgtgcctgtcttaagcccgtttttggagcggtgcctgcatgattgggtcgatgatcccgcagttgcactccgacgctttggcgatgaagtgggaacgtcccaagcgaaggcgctggcgcacatgctcatcgagatcgaggaggcaggcgtcgccgtggcgctcgatgtcctccagacgaacctggagcgattccgagccgaccgcattgccgccttccgggcgcacctgaacacgcgctccatcttggcgacggcgcttaccatgctcggacttggagcgacgagtttcgatctgatggtcgtcatccaagtctacgccggcgcactcatgcgcgcgagtgcaggtggatga

SEQ ID NO: 32 - DNA, 945 bp, Artificial
  Alicyclobacillus acidocaldarius mutated SEQ ID NO 19
gtggttccttttgacccttcttgccacgctcggttcgttcatcatcggaatcacgttctacaagccgaaacaggacatctgaaggggggtgacaacggcatgggttacgtgattttagccttgggactcgttccaagcgtgctgctggtcatgggggcagggcaaggtgagtatgccggaatacggacacgcgcgcggattgcggccgggtggtatggagccaagatgcgggtgcggaagaggctcgaagacgagcagctcgtctcgttgctgcggaaaagcggcctcacgctgaaggcgtatcagtatcactacctgcgaatcgggttgacgctcgtctttttgcttatgggagtcgtggggcttctccacggacggctgttgccgatgttgtttccgctcgtcgtatggtttgggctcgagtatcggcgtccgttcccgatgtactacggcttccttgccctgcaaaagcaggcggcgttggagcgagacaaggcgctctatctcctctaccgcctgctccttcaagaggcggtcgcgtttcgagggcgaccgctcggggtgtatgacatgttacgccgccaattgcaccgtgtgcctgtcttaagcccgtttttggagcggtgcctgcatgattgggtcgatgatcccgcagttgcactccgacgctttggcgatgaagtgggaacgtcccaagcgaaggcgctggcgcacatgctcatcgagatcgaggaggcaggcgtcgccgtggcgattgatgtcctccagacgaacctggagcgattccgagccgaccgcattgccgccttccgggcgcacctgaacacgcgctccatcttggcgacggcgcttaccatgctcggacttggagcgacgagtttcgatctgatggtcgtcatccaagtctacgccggcgcactcatgcgcgcgagtgcaggtggatga

SEQ ID NO: 33 - DNA, 945 bp, Artificial
  Alicyclobacillus acidocaldarius mutated SEQ ID NO 19
gtggttccttttgacccttcttgccacgctcggttcgttcatcatcggaatcacgttctacaagccgaaacaggacatctgaaggggggtgacaacggcatgggttacgtgattttagccttgggactcgttccaagcgtgctgctggtcatgggggcagggcaaggtgagtatgccggaatacggacacgcgcgcggattgcggccgggtggtatggagccaagatgcgggtgcggaagaggattgaagacgagcagctcgtctcgttgctgcggaaaagcggcctcacgctgaaggcgtatcagtatcactacctgcgaatcgggttgacgctcgtctttttgcttatgggagtcgtggggcttctccacggacggctgttgccgatgttgtttccgctcgtcgtatggtttgggctcgagtatcggcgtccgttcccgatgtactacggcttccttgccctgcaaaagcaggcggcgttggagcgagacaaggcgctctatctcctctaccgcctgctccttcaagaggcggtcgcgtttcgagggcgaccgctcggggtgtatgacatgttacgccgccaattgcaccgtgtgcctgtcttaagcccgtttttggagcggtgcctgcatgattgggtcgatgatcccgcagttgcactccgacgctttggcgatgaagtgggaacgtcccaagcgaaggcgctggcgcacatgctcatcgagatcgaggaggcaggcgtcgccgtggcgctcgatgtcctccagacgaacctggagcgattccgagccgaccgcattgccgccttccgggcgcacctgaacacgcgctccatcttggcgacggcgcttaccatgctcggacttggagcgacgagtttcgatctgatggtcgtcatccaagtctacgccggcgcactcatgcgcgcgagtgcaggtggatga

SEQ ID NO: 34 - DNA, 945 bp, Artificial
  Alicyclobacillus acidocaldarius mutated SEQ ID NO 19
gtggttccttttgacccttcttgccacgctcggttcgttcatcatcggaatcacgttctacaagccgaaacaggacatctgaaggggggtgacaacggcatgggttacgtgattttagccttgggactcgttccaagcgtgctgctggtcatgggggcagggcaaggtgagtatgccggaatacggacacgcgcgcggattgcggccgggtggtatggagccaagatgcgggtgcggaagaggctcgaagacgagcagctcgtctcgttgctgcggaaaagcggcctcacgctgaaggcgtatcagtatcactacctgcgaatcgggttgacgctcgtctttttgcttatgggagtcgtggggcttctccacggacggctgttgccgatgttgtttccgctcgtcgtatggtttgggctcgagtatcggcgtccgttcccgatgtactacggcttccttgccctgcaaaagcaggcggcgttggagcgagacaaggcgctctatctcctctaccgcctgattcttcaagaggcggtcgcgtttcgagggcgaccgctcggggtgtatgacatgttacgccgccaattgcaccgtgtgcctgtcttaagcccgtttttggagcggtgcctgcatgattgggtcgatgatcccgcagttgcactccgacgctttggcgatgaagtgggaacgtcccaagcgaaggcgctggcgcacatgctcatcgagatcgaggaggcaggcgtcgccgtggcgctcgatgtcctccagacgaacctggagcgattccgagccgaccgcattgccgccttccgggcgcacctgaacacgcgctccatcttggcgacggcgcttaccatgctcggacttggagcgacgagtttcgatctgatggtcgtcatccaagtctacgccggcgcactcatgcgcgcgagtgcaggtggatga

SEQ ID NO: 35 - protein, 331 aa, Alicyclobacillus acidocaldarius
MGGDIVANALNTLAQIVLYGVACAGLLWLFEQVWRDGWAWAKRTYYGIGHRQLLRVSEGFRGRQTTQLPWWMGWHDHLETLLQATLKRPHRDAVSRFIVGSVTAAVIVGVLTSVVTHNPFYALVMFALTVVAPYGVLQIRRYHMSIRNSYDIGTLLSVIVPEYRKQHGSMLHALQSTVEHLPPSPIRRAVARLTDRLTDYTTPDDARRALHRFVKELGTSWAAQLASDIEHALLDGVNVEASLALLHKEFQEIEDARKSQNLARIDTLLISCVPFLMWPVMMVLFYLFVSRNIFQYQFANPTGFTWFLLTLLATLGSFIIGITFYKPKQDI

SEQ ID NO: 36 - DNA, 996 bp, Alicyclobacillus acidocaldarius
ttggggggtgacatcgtggcgaatgcgctgaatacccttgcgcaaatcgtcttgtatggcgtggcctgtgcgggtctcctgtggctgtttgagcaggtctggcgagatggatgggcgtgggcgaagcggacgtactacggcatcgggcatcggcagctcctccgcgtgagcgaggggtttcgcggccgacagacaacgcagttgccgtggtggatgggctggcatgaccacctcgaaacgctcttgcaggccacgctcaaacgtccgcaccgtgacgcggtgtcgcggttcatcgtgggctcagtcacggcggccgtgatcgtgggtgtgctcacctctgtggtgacgcacaacccgttctatgcgcttgtcatgtttgcgttgaccgtagtcgcaccgtacggcgtgctccaaatccgccgctatcacatgagcatccggaactcctacgacatcggcacgctcttgagtgtcatcgtgccggagtatcgcaagcaacatgggagcatgctgcatgcgctgcaatcgacggtggagcatctgccgccaagcccgattcggcgggcggtggcgcgcttgaccgaccgactgacggattacaccacgcctgacgatgcgaggcgcgccctgcatcgcttcgtgaaggagctcggaacctcgtgggcggcgcaactcgcaagtgacatcgagcatgccctgttggacggcgtgaacgtggaagcgagtttagcgcttttacacaaggagtttcaggagattgaagacgcgcgcaagtcgcagaacctggcccggatcgacacgctcctcatctcgtgtgttccgtttctgatgtggccggtcatgatggtgctcttctacctctttgtgtcgcggaacatcttccagtaccagtttgcgaatccgacaggcttcacgtggttccttttgacccttcttgccacgctcggttcgttcatcatcggaatcacgttctacaagccgaaacaggacatctga

SEQ ID NO: 37 - protein, 260 aa, Clostridium cellulolyticum
NHIYKVLTASLSKEISDLGTYSFMIGSISLFIFSFLTALKLFNFIISLGIAIIIAASPYVLLRLKLRSVQIEGSYDANVLVPSITNEYKQHYFNMINAIENCAVREDIGSYSRKNLFRLSLALKAYYSEEDLDKAIERFVFAYNTEWAMLLGLNIKMAIHKGIVVSSGLEDILKKLKDSSEQVEVSKRYNTDAFAIKFLLIPLYIGGILFSISTFDFTLRKYFEYQFLNPIGLRTGIISFMGIIVSFISLRMIRKPKYDI

SEQ ID NO: 38 - protein, 239 aa, Bacillus NRRL B-14911
VSTFIVLSLLIGFLTFSLILVKYQDAFLGLIIGTVVSIIPYIILHVQLRNTRNAVGNQLTEIVELIIHAYGSSSSDMYQALKVTQSHIAEKELRSILVRLISDLQTARTEEEMRLSIDLFIFTCGNSWSMRLGNIILKSYLHQENVMSALIQLQNQMVNNQKMLEQEKASSYDAFVDATLTVILFPISLIGAKFMTKPQSWMALQFGEKATLMLFILTTIMVVISLLVGLIIRKPKNDL

SEQ ID NO: 39 - protein, 255 aa, Bacillus cereus
HLELLLSSISKNSKKINVFNFLFASMLVFVITVSVLYFLIHDLVFALGIGITFGILPYVAIRYRLTMLRLKTQYAFLIEYHVLFQNYQSTSKDIYYTMLNAVKETKNKELKHIYMKLLSSLQKDRGNLEFERAVNVFSYSINSTFAKRFAKLLKKAHIDRGDITMSLMDLNADIKKRKQDIQTDKTRKLETVILGYSPMVLFPLMIFLAYRISGVVDFWYVFQQKTPIILFTISLVMSIFSVLTAIVMSKPRADI

SEQ ID NO: 40 - protein, 73 aa, Moritella PE36
IETISYRLSDHTTADDASRYRSEDNVGEAWQKEPMTRLRTLLMDELIIDNAAIELLEKECSEEIDAAVTRYLA

SEQ ID NO: 41 - protein, 68 aa, Sphingomonas SKA58
LGSRIAKKTLQAMEHHLVYGAALAGAFALLMLAWAWFYFTRTGRGLGSNQFLRGARFGTARQLRRLLW

SEQ ID NO: 42 - protein, 331 aa, Artificial
  Alicyclobacillus acidocaldarius mutated SEQ ID NO 35
MGGDIVANALNTLAQIVLYGVACAGLLWLFEQVWRDGWAWAKRTYYGIGHRQLLRVSEGFRGRQTTQLPWWMGWHDHLETLLQATLKRPHRDAVSRFIVGSVTAAVIVGVLTSVVTHNPFYALVMFALTVVAPYGVLQIRRYHMSIRNSYDIGTLLSVIVPEYRKQHGSMLHALQSTVEHLPPSPIRRAVARLTDRLTDYTTPDDARRALHRFVKELGTSWAAQLASDIEHALLDGVNVEASLALLHKEFQEIEDARKSQNLARIDTLLISCVPFLMWPVMMVLFYLFVSRNIFQYQFANPTGFTWFLLTLLATLGSFILGITFYKPKQDI

SEQ ID NO: 43 - protein, 331 aa, Artificial
  Alicyclobacillus acidocaldarius mutated SEQ ID NO 35
MGGDIVANALNTLAQIVLYGVACAGLLWLFEQVWRDGWAWAKRTYYGIGHRQLLRVSEGFRGRQTTQLPWWMGWHDHLETLLQATLKRPHRDAVSRFIVGSVTAAVIVGVLTSVVTHNPFYALVMFALTVIAPYGVLQIRRYHMSIRNSYDIGTLLSVIVPEYRKQHGSMLHALQSTVEHLPPSPIRRAVARLTDRLTDYTTPDDARRALHRFVKELGTSWAAQLASDIEHALLDGVNVEASLALLHKEFQEIEDARKSQNLARIDTLLISCVPFLMWPVMMVLFYLFVSRNIFQYQFANPTGFTWFLLTLLATLGSFIIGITFYKPKQDI

SEQ ID NO: 44 - protein, 331 aa, Artificial
  Alicyclobacillus acidocaldarius mutated SEQ ID NO 35
MGGDIVANALNTLAQIVLYGVACAGLLWLFEQVWRDGWAWAKRTYYGIGHRQLLRVSEGFRGRQTTQLPWWMGWHDHLETLLQATLKRPHRDAVSRFIVGSVTAAVIVGVLTSVVTHNPFYALVMFALTVVAPYGVLQIRRYHMSIRNSYDIGTLLSVIIPEYRKQHGSMLHALQSTVEHLPPSPIRRAVARLTDRLTDYTTPDDARRALHRFVKELGTSWAAQLASDIEHALLDGVNVEASLALLHKEFQEIEDARKSQNLARIDTLLISCVPFLMWPVMMVLFYLFVSRNIFQYQFANPTGFTWFLLTLLATLGSFIIGITFYKPKQDI

SEQ ID NO: 45 - protein, 331 aa, Artificial
  Alicyclobacillus acidocaldarius mutated SEQ ID NO 35
MGGDIVANALNTLAQIILYGVACAGLLWLFEQVWRDGWAWAKRTYYGIGHRQLLRVSEGFRGRQTTQLPWWMGWHDHLETLLQATLKRPHRDAVSRFIVGSVTAAVIVGVLTSVVTHNPFYALVMFALTVVAPYGVLQIRRYHMSIRNSYDIGTLLSVIVPEYRKQHGSMLHALQSTVEHLPPSPIRRAVARLTDRLTDYTTPDDARRALHRFVKELGTSWAAQLASDIEHALLDGVNVEASLALLHKEFQEIEDARKSQNLARIDTLLISCVPFLMWPVMMVLFYLFVSRNIFQYQFANPTGFTWFLLTLLATLGSFIIGITFYKPKQDI

SEQ ID NO: 46 - protein, 331 aa, Artificial
  Alicyclobacillus acidocaldarius mutated SEQ ID NO 35
MGGDIVANALNTLAQIVLYGVACAGLLWLFEQVWRDGWAWAKRTYYGIGHRQLLRVSEGFRGRQTTQLPWWMGWHDHLETLLQATLKRPHRDAVSRFIVGSVTAAVIVGVLTSVVTHNPFYALVMFALTVVAPYGVLQIRRYHMSIRNSYDIGTLLSVIVPEYRKQHGSMLHALQSTVEHLPPSPIRRAVARLTDRLTDYTTPDDARKALHRFVKELGTSWAAQLASDIEHALLDGVNVEASLALLHKEFQEIEDARKSQNLARIDTLLISCVPFLMWPVMMVLFYLFVSRNIFQYQFANPTGFTWFLLTLLATLGSFIIGITFYKPKQDI

SEQ ID NO: 47 - DNA, 996 bp, Artificial
  Alicyclobacillus acidocaldarius mutated SEQ ID NO 36
ttggggggtgacatcgtggcgaatgcgctgaatacccttgcgcaaatcgtcttgtatggcgtggcctgtgcgggtctcctgtggctgtttgagcaggtctggcgagatggatgggcgtgggcgaagcggacgtactacggcatcgggcatcggcagctcctccgcgtgagcgaggggtttcgcggccgacagacaacgcagttgccgtggtggatgggctggcatgaccacctcgaaacgctcttgcaggccacgctcaaacgtccgcaccgtgacgcggtgtcgcggttcatcgtgggctcagtcacggcggccgtgatcgtgggtgtgctcacctctgtggtgacgcacaacccgttctatgcgcttgtcatgtttgcgttgaccgtagtcgcaccgtacggcgtgctccaaatccgccgctatcacatgagcatccggaactcctacgacatcggcacgctcttgagtgtcatcgtgccggagtatcgcaagcaacatgggagcatgctgcatgcgctgcaatcgacggtggagcatctgccgccaagcccgattcggcgggcggtggcgcgcttgaccgaccgactgacggattacaccacgcctgacgatgcgaggcgcgccctgcatcgcttcgtgaaggagctcggaacctcgtgggcggcgcaactcgcaagtgacatcgagcatgccctgttggacggcgtgaacgtggaagcgagtttagcgcttttacacaaggagtttcaggagattgaagacgcgcgcaagtcgcagaacctggcccggatcgacacgctcctcatctcgtgtgttccgtttctgatgtggccggtcatgatggtgctcttctacctctttgtgtcgcggaacatcttccagtaccagtttgcgaatccgacaggcttcacgtggttccttttgacccttcttgccacgctcggttcgttcatcttaggaatcacgttctacaagccgaaacaggacatctga

SEQ ID NO: 48 - DNA, 996 bp, Artificial
  Alicyclobacillus acidocaldarius mutated SEQ ID NO 36
ttggggggtgacatcgtggcgaatgcgctgaatacccttgcgcaaatcgtcttgtatggcgtggcctgtgcgggtctcctgtggctgtttgagcaggtctggcgagatggatgggcgtgggcgaagcggacgtactacggcatcgggcatcggcagctcctccgcgtgagcgaggggtttcgcggccgacagacaacgcagttgccgtggtggatgggctggcatgaccacctcgaaacgctcttgcaggccacgctcaaacgtccgcaccgtgacgcggtgtcgcggttcatcgtgggctcagtcacggcggccgtgatcgtgggtgtgctcacctctgtggtgacgcacaacccgttctatgcgcttgtcatgtttgcgttgaccgtaattgcaccgtacggcgtgctccaaatccgccgctatcacatgagcatccggaactcctacgacatcggcacgctcttgagtgtcatcgtgccggagtatcgcaagcaacatgggagcatgctgcatgcgctgcaatcgacggtggagcatctgccgccaagcccgattcggcgggcggtggcgcgcttgaccgaccgactgacggattacaccacgcctgacgatgcgaggcgcgccctgcatcgcttcgtgaaggagctcggaacctcgtgggcggcgcaactcgcaagtgacatcgagcatgccctgttggacggcgtgaacgtggaagcgagtttagcgcttttacacaaggagtttcaggagattgaagacgcgcgcaagtcgcagaacctggcccggatcgacacgctcctcatctcgtgtgttccgtttctgatgtggccggtcatgatggtgctcttctacctctttgtgtcgcggaacatcttccagtaccagtttgcgaatccgacaggcttcacgtggttccttttgacccttcttgccacgctcggttcgttcatcatcggaatcacgttctacaagccgaaacaggacatctga

SEQ ID NO: 49 - DNA, 996 bp, Artificial
  Alicyclobacillus acidocaldarius mutated SEQ ID NO 36
ttggggggtgacatcgtggcgaatgcgctgaatacccttgcgcaaatcgtcttgtatggcgtggcctgtgcgggtctcctgtggctgtttgagcaggtctggcgagatggatgggcgtgggcgaagcggacgtactacggcatcgggcatcggcagctcctccgcgtgagcgaggggtttcgcggccgacagacaacgcagttgccgtggtggatgggctggcatgaccacctcgaaacgctcttgcaggccacgctcaaacgtccgcaccgtgacgcggtgtcgcggttcatcgtgggctcagtcacggcggccgtgatcgtgggtgtgctcacctctgtggtgacgcacaacccgttctatgcgcttgtcatgtttgcgttgaccgtagtcgcaccgtacggcgtgctccaaatccgccgctatcacatgagcatccggaactcctacgacatcggcacgctcttgagtgtcatcattccggagtatcgcaagcaacatgggagcatgctgcatgcgctgcaatcgacggtggagcatctgccgccaagcccgattcggcgggcggtggcgcgcttgaccgaccgactgacggattacaccacgcctgacgatgcgaggcgcgccctgcatcgcttcgtgaaggagctcggaacctcgtgggcggcgcaactcgcaagtgacatcgagcatgccctgttggacggcgtgaacgtggaagcgagtttagcgcttttacacaaggagtttcaggagattgaagacgcgcgcaagtcgcagaacctggcccggatcgacacgctcctcatctcgtgtgttccgtttctgatgtggccggtcatgatggtgctcttctacctctttgtgtcgcggaacatcttccagtaccagtttgcgaatccgacaggcttcacgtggttccttttgacccttcttgccacgctcggttcgttcatcatcggaatcacgttctacaagccgaaacaggacatctga

SEQ ID NO: 50 - DNA, 996 bp, Artificial
  Alicyclobacillus acidocaldarius mutated SEQ ID NO 36
ttggggggtgacatcgtggcgaatgcgctgaatacccttgcgcaaatcattttgtatggcgtggcctgtgcgggtctcctgtggctgtttgagcaggtctggcgagatggatgggcgtgggcgaagcggacgtactacggcatcgggcatcggcagctcctccgcgtgagcgaggggtttcgcggccgacagacaacgcagttgccgtggtggatgggctggcatgaccacctcgaaacgctcttgcaggccacgctcaaacgtccgcaccgtgacgcggtgtcgcggttcatcgtgggctcagtcacggcggccgtgatcgtgggtgtgctcacctctgtggtgacgcacaacccgttctatgcgcttgtcatgtttgcgttgaccgtagtcgcaccgtacggcgtgctccaaatccgccgctatcacatgagcatccggaactcctacgacatcggcacgctcttgagtgtcatcgtgccggagtatcgcaagcaacatgggagcatgctgcatgcgctgcaatcgacggtggagcatctgccgccaagcccgattcggcgggcggtggcgcgcttgaccgaccgactgacggattacaccacgcctgacgatgcgaggcgcgccctgcatcgcttcgtgaaggagctcggaacctcgtgggcggcgcaactcgcaagtgacatcgagcatgccctgttggacggcgtgaacgtggaagcgagtttagcgcttttacacaaggagtttcaggagattgaagacgcgcgcaagtcgcagaacctggcccggatcgacacgctcctcatctcgtgtgttccgtttctgatgtggccggtcatgatggtgctcttctacctctttgtgtcgcggaacatcttccagtaccagtttgcgaatccgacaggcttcacgtggttccttttgacccttcttgccacgctcggttcgttcatcatcggaatcacgttctacaagccgaaacaggacatctga

SEQ ID NO: 51 - DNA, 996 bp, Artificial
  Alicyclobacillus acidocaldarius mutated SEQ ID NO 36
ttggggggtgacatcgtggcgaatgcgctgaatacccttgcgcaaatcgtcttgtatggcgtggcctgtgcgggtctcctgtggctgtttgagcaggtctggcgagatggatgggcgtgggcgaagcggacgtactacggcatcgggcatcggcagctcctccgcgtgagcgaggggtttcgcggccgacagacaacgcagttgccgtggtggatgggctggcatgaccacctcgaaacgctcttgcaggccacgctcaaacgtccgcaccgtgacgcggtgtcgcggttcatcgtgggctcagtcacggcggccgtgatcgtgggtgtgctcacctctgtggtgacgcacaacccgttctatgcgcttgtcatgtttgcgttgaccgtagtcgcaccgtacggcgtgctccaaatccgccgctatcacatgagcatccggaactcctacgacatcggcacgctcttgagtgtcatcgtgccggagtatcgcaagcaacatgggagcatgctgcatgcgctgcaatcgacggtggagcatctgccgccaagcccgattcggcgggcggtggcgcgcttgaccgaccgactgacggattacaccacgcctgacgatgcgaggaaagccctgcatcgcttcgtgaaggagctcggaacctcgtgggcggcgcaactcgcaagtgacatcgagcatgccctgttggacggcgtgaacgtggaagcgagtttagcgcttttacacaaggagtttcaggagattgaagacgcgcgcaagtcgcagaacctggcccggatcgacacgctcctcatctcgtgtgttccgtttctgatgtggccggtcatgatggtgctcttctacctctttgtgtcgcggaacatcttccagtaccagtttgcgaatccgacaggcttcacgtggttccttttgacccttcttgccacgctcggttcgttcatcatcggaatcacgttctacaagccgaaacaggacatctga

SEQ ID NO: 52 - protein, 477 aa, Alicyclobacillus acidocaldarius
MSVHELLPSEPFRADRYVLETQRERAKDYGEVPFDRVIEAFQQYLGEEVGGKDDVDSQYLHRKYRALIGDEAAKQYFIHRIHDFLRERPEFQNTRYPRYYPDLPEAIFQHALGFGPMSVWFANPTESATVNGTQILFGVKGSNTKVLQPFAFDSIDQVKRLVRTLTLRDPANQVNQTNHWTQVDMLNGTRVTIFAPPLSETYVLVFRQYTFHRYTFEHEAEMRTIPADSVEWWKLLSRLMLTMVTTGIRRSGKTTFLKVIFGARDPNLEVVTVERGTFEAHLKRDFPERAGRIIALKSPLDEMASLFPAFLRSDAHYMMVPEIRSSEVDLLILSRERGNGCLASYHSPYVTNIPRELADLALENNPSRDYRATYIRTAQSLDVAITMWEDPTGRKIVTGVYAYEFDHETESYTVTTWMKYHRATDTWTFHAEIPPSMRARLEDTYPDVLAAFEAEFQRLASAYPFQGEAKRRVKIGG

SEQ ID NO: 53 - DNA, 1434 bp, Alicyclobacillus acidocaldarius
gtgtccgtgcatgagctcctgccaagcgagccctttcgcgcggatcggtatgtgctcgagacgcagcgcgagcgggccaaagactacggtgaagtgccatttgaccgagtgatcgaggcgtttcagcagtacctcggtgaggaagtcggcgggaaagacgacgtggactcgcagtacctgcaccgcaaataccgggcgctcatcggggatgaggcggcgaagcagtattttatccaccgcatccatgactttttgcgggaacgtcccgagtttcaaaacacgcgatatccgcggtactacccggacttgccggaagcgatctttcaacacgcgctcggcttcgggcccatgagcgtgtggtttgcaaatcctacggaatcagcgacggtcaatggaacgcagatcctgtttggcgtcaaggggtcaaacacgaaggtcctccaacccttcgcgtttgactccatcgaccaggtgaagcggttggtgcgcacgctcaccttgcgcgacccggcgaaccaggtcaatcagacgaatcattggacgcaggtcgatatgctcaatggcacgcgcgtcacgatcttcgcaccgcccttgtcggaaacgtacgtgctcgtcttccggcaatacaccttccatcgctacacgttcgagcacgaggctgagatgcgcacgatcccggccgattctgtcgagtggtggaagctcctgagccgactcatgctcacgatggtgacgaccgggattcgacggtcggggaagaccacgttcttgaaggtcatctttggcgcgcgcgatccgaatctcgaagtggtgacagtggaacgcggcacctttgaggcccatctgaagcgagactttccagaacgcgcgggacggatcattgcgctcaagtcaccgctcgatgagatggcatccctattcccggcgtttctacggtcggacgcgcactacatgatggtgccggagatccgaagcagtgaggtcgatttgctcatcctgtcgcgcgagcgcggcaacggatgtttggcaagctatcacagtccgtacgtgacgaacatcccgcgagagcttgcggatttggcactcgagaacaatccgagccgggattatcgggcgacctacatccgcacggcgcaaagcctcgatgtcgcgatcacgatgtgggaggacccgacggggcgaaagattgtgacgggcgtctacgcttatgaattcgaccatgagacggaatcctacacggtcacgacgtggatgaagtatcaccgcgccacagatacttggacgttccacgcggagattccgccgtccatgcgggcgcgcttggaggatacgtacccggacgttttggcggcgtttgaggcggagtttcagcgtttggcgtcggcgtatccattccagggcgaggccaagcgtcgcgtgaagattggggggtga

SEQ ID NO: 54 - protein, 375 aa, Bacillus NRRL B-14911
NSEWLERQHQAIIGDKVAIEYFLAEIEKVLRTKNITSKDFPSFFNSLSEAIFHEIWGLSVLAKWERYPESEACCIRGTQLWIDIDGQFVKQEEEFESLTVVERIKRAFVIRRPDSVINRESPELEIEREDGSRITMIQPPRSRENYIMIRRFIVNKYSLHDQASRGTIPQEDIPIFQALARTMANMIVAGRVRSAKSTFMTTLIGERDDSFVGAVLEKHFEVALSKHFPNRLFFEIQAKEGDLHKAIPRLLRMEHDFVVVGEIRSLEIEAYLQSTERGERGSLSTFHLTDVEQVVEQLARLTLDEFPTRRFEVEVERIARNIDIIITMDTERDRSKKRVVGVTEVIWDNQQRRHYTQDLIRYSKLKDKYYYSSNI

SEQ ID NO: 55 - protein, 420 aa, Bacillus cereus
EKAKSVKQTHEFSEVLEIVKKSIENIYEDRGISSDEKIKRQEIEHNAILGDHEAEKILTKEIEKCLREQNLLDVKYPDFFDSLAQALFHEIYGFGAFYKWKKYPESVSASIIGKEIWFKINGKFVKQEEELRDEEHIYEIFRALEVGHKGLKINHENPRAEIEMKDGTRVNIIRPPANLFPVIVFRRFIIKNFSFEEQARRKTISSEDVELMEIISQLYLNMIIAGHVESGKSTMLKTIFASRSPEKIAICIETSPESFLKKDFPDRLVYDMYTINGNIEDVIYSALRTDHDYIIFQEVRGIEADGAMKGAERGTTGMMMTYHITDPSRTPEQLAQHIVDAYANRKLENEIRRVAKNLDLGIIMKNDEPKNEKRLMSIYEICYDYKGDKAWINYLMKYNELDERWEYNSEVSEALIKKMK

SEQ ID NO: 56 - protein, 402 aa, Clostridium cellulolyticum
LERHRNAILGKPTEVNYLKDKIREYLKAKRLENERYPTWYKNLIDAIFHENWGIAGIAEWMDMPESSSAKIIGDRIYFFINGKQVLKEQRISKKRFEQLRQAFMLSDETKRANENYSELYMYSGERVTVYTGRKVIDGQSVMVFRKYVVKVLTFEEQARRGTIPVELVPALEALVNCGVKVAFIGPVRSGKSTMLLTWQLYEDPELEGVLIQTDPEIRIHEVMPKAPIMPLIAGGKELFELSSEILKSDADYLVVQEVRDGYTAYIAVEAANKGTNRLKITAHLSNPEDFCYDIANKIQGVFGGNIDYQMVRVANSFNFLFEMVQLPGNRSQKRLKSIYEIRYDTEANVISYHKICEYNKDTDSWCFSYSVGNKVTELGEFENPKALEVYKNTLKFLSEKYP

SEQ ID NO: 57 - protein, 437 aa, Paenibacillus  JDR-2
SARLRLDQSAVTDPLDRGEAAGRGADFGRLAEEIRSYLAAPRGLTEEERRQYSETLNRAVLGFASEREQVLAIIADRLIRLRIHQLDGYKHPYATLAEALFAEVIGLNVLELVLARKDGLEEIQVVGSQIYEVRDGQTMLSSYRFDHERDVERIQQNLVLYNNDRINPRKRWAEVMLRDGSRVTMTGFGFTSKPTLTIRFFTVRSFSLEALCSAPYHTLSLAMRNMLLDVLEARFNLVIIGPTNSGKTHLMKALIAELPDEERIVTIEGRFEMMLGRDFPMKNTVEYEADEDDPQHRAEQAFKLALRQSPQRIVHAEIRDMDANIYVRACTRGHSGSMTTVHANTLEDVPEAITDMCMLDGRGMNPERLTKRIAEYVTQVGIEMRYLGGRRVIARIGELSWANNEVNVRDWARFDETSEQWIYPEKPSPKARTRLSE

SEQ ID NO: 58 - protein, 302 aa, Streptomyces coelicolor
EQLRSELVGSGPLEPLLADPSVTDVLVSAPDRVWVDRGGGLELAPVSFPDAAAVRRLAQRLATVAGRRLDDARPWVDARLPDGTRLHAVLPPVAVDCTCLALRVVRPRAFTLRELAAAGTVPPGGDRVLRALLRARLSFLVSGGTGSGKTTLLSALLGLVGPDERIVLAEDSAELRPDHPHVVRLETRPANQEGAGLVTLEDLVRQALRMRPDRLVVGEVRGPEVVHLLAALNTGHEGGCGTVHANAAADVPARLEALGTTAGLNRAALHSQLAAALSVVLHLVRDRAGRRRIAEVHVLERD

SEQ ID NO: 59 - protein, 477 aa, Artificial
  Alicyclobacillus acidocaldarius mutated SEQ ID NO 52
MSVHELLPSEPFRADRYVLETQRERAKDYGEVPFDRVIEAFQQYLGEEVGGKDDVDSQYLHRKYRALIGDEAAKQYFIHRIHDFLRERPEFQNTRYPRYYPDLPEAIFQHALGFGPMSVWFANPTESATVNGTQILFGVKGSNTKVLQPFAFDSIDQVKRLVRTLTLRDPANQVNQTNHWTQVDMLNGTRVTIFAPPLSETYVLVFRQYTFHRYTFEHEAEMRTIPADSVEWWKLLSRLMLTMVTTGIRRSGKTTFLKVIFGARDPNLEVVTVERGTFEAHLKRDFPERAGRIIALKSPLDEMASLFPAFLRSDAHYMMVPEIRSSEVDLLILSRERGNGCLASYHSPYITNIPRELADLALENNPSRDYRATYIRTAQSLDVAITMWEDPTGRKIVTGVYAYEFDHETESYTVTTWMKYHRATDTWTFHAEIPPSMRARLEDTYPDVLAAFEAEFQRLASAYPFQGEAKRRVKIGG

SEQ ID NO: 60 - protein, 477 aa, Artificial
  Alicyclobacillus acidocaldarius mutated SEQ ID NO 52
MSVHELLPSEPFRADRYVLETQRERAKDYGEVPFDRVIEAFQQYLGEEVGGKDDVDSQYLHRKYRALIGDEAAKQYFIHRIHDFLRERPEFQNTRYPRYYPDLPEAIFQHALGFGPMSVWFANPTESATVNGTQILFGVKGSNTKVLQPFAFDSIDQVKRLVRTLTLRDPANQVNQTNHWTQVDMLNGTRVTIFAPPLSETYVLVFRQYTFHRYTFEHEAEMRTIPADSVEWWKLLSRLMLTMVTTGIRRSGKTTFLKVIFGARDPNLEVVTVERGTFEAHLKRDFPERAGRIIALKSPLDEMASLFPAFLRSDAHYMMVPEIRSSEVDLLILSRERGNGCLASYHSPYVTNIPRELADLALENNPSRDYRATYIRTAQSLDVAITMWDDPTGRKIVTGVYAYEFDHETESYTVTTWMKYHRATDTWTFHAEIPPSMRARLEDTYPDVLAAFEAEFQRLASAYPFQGEAKRRVKIGG

SEQ ID NO: 61 - protein, 477 aa, Artificial
  Alicyclobacillus acidocaldarius mutated SEQ ID NO 52
MSVHELLPSEPFRADRYVLETQRERAKDYGEVPFDRVIEAFQQYLGEEVGGKDDVDSQYLHRKYRALIGDEAAKQYFIHRIHDFIRERPEFQNTRYPRYYPDLPEAIFQHALGFGPMSVWFANPTESATVNGTQILFGVKGSNTKVLQPFAFDSIDQVKRLVRTLTLRDPANQVNQTNHWTQVDMLNGTRVTIFAPPLSETYVLVFRQYTFHRYTFEHEAEMRTIPADSVEWWKLLSRLMLTMVTTGIRRSGKTTFLKVIFGARDPNLEVVTVERGTFEAHLKRDFPERAGRIIALKSPLDEMASLFPAFLRSDAHYMMVPEIRSSEVDLLILSRERGNGCLASYHSPYVTNIPRELADLALENNPSRDYRATYIRTAQSLDVAITMWEDPTGRKIVTGVYAYEFDHETESYTVTTWMKYHRATDTWTFHAEIPPSMRARLEDTYPDVLAAFEAEFQRLASAYPFQGEAKRRVKIGG

SEQ ID NO: 62 - protein, 477 aa, Artificial
  Alicyclobacillus acidocaldarius mutated SEQ ID NO 52
MSVHELLPSEPFRADRYVLETQRERAKDYGEVPFDRVIEAFQQYLGEEVGGKDDVDSQYLHRKYRALIGDEAAKQYFIHRIHDFLRERPEFQNTRYPRYYPDLPEAIFQHALGFGPMSVWFANPTESATVNGTQILFGVKGSNTKVLQPFAFDSIDQVKRLVRTLTLRDPANQVNQTNHWTQVDMLNGTRVTIFAPPLSETYVLVFRQYTFHRYTFEHEAEMRTIPADSVEWWKLLSRLMLTMVTTGIRRSGKTTFLKVIFGARDPNLEVVTVERGTFEAHLKREFPERAGRIIALKSPLDEMASLFPAFLRSDAHYMMVPEIRSSEVDLLILSRERGNGCLASYHSPYVTNIPRELADLALENNPSRDYRATYIRTAQSLDVAITMWEDPTGRKIVTGVYAYEFDHETESYTVTTWMKYHRATDTWTFHAEIPPSMRARLEDTYPDVLAAFEAEFQRLASAYPFQGEAKRRVKIGG

SEQ ID NO: 63 - protein, 477 aa, Artificial
  Alicyclobacillus acidocaldarius mutated SEQ ID NO 52
MSVHELLPSEPFRADRYVLETQRERAKDYGEVPFDRVIEAFQQYLGEEVGGKDDVDSQYLHRKYRALIGDEAAKQYFIHRIHDFLRERPEFQNTRYPRYYPDLPEAIFQHALGFGPMSVWFANPTESATVNGTQILFGVKGSNTKVLQPFAFDSIDQVKRLVRTLTLRDPANQVNQTNHWTQVDMLNGTRVTIFAPPLSETYVLVFRQYTFHRYTFEHEAEMRTIPADSVEWWKLLSRLMLTMVTTGIRRSGKTTFLKVIFGARDPNLEVVTVERGTFEAHLKRDFPERAGRIIALKSPLDEMASLFPAFLRSDAHYMMVPEIRSSEVDLLILSRERGNGCLASYHSPYVTNIPRELADLALENNPSRDYRATYIRTAQSLDVAITMWEDPTGRKIVTGVYAYEFDHETESYTVTTWMKYHRATDTWTFHAEIPPSMRARLEDTYPDVLAAFEAEFQRLASAYPFQGEARRRVKIGG

SEQ ID NO: 64 - DNA, 1434 bp, Artificial
  Alicyclobacillus acidocaldarius mutated SEQ ID NO 53
gtgtccgtgcatgagctcctgccaagcgagccctttcgcgcggatcggtatgtgctcgagacgcagcgcgagcgggccaaagactacggtgaagtgccatttgaccgagtgatcgaggcgtttcagcagtacctcggtgaggaagtcggcgggaaagacgacgtggactcgcagtacctgcaccgcaaataccgggcgctcatcggggatgaggcggcgaagcagtattttatccaccgcatccatgactttttgcgggaacgtcccgagtttcaaaacacgcgatatccgcggtactacccggacttgccggaagcgatctttcaacacgcgctcggcttcgggcccatgagcgtgtggtttgcaaatcctacggaatcagcgacggtcaatggaacgcagatcctgtttggcgtcaaggggtcaaacacgaaggtcctccaacccttcgcgtttgactccatcgaccaggtgaagcggttggtgcgcacgctcaccttgcgcgacccggcgaaccaggtcaatcagacgaatcattggacgcaggtcgatatgctcaatggcacgcgcgtcacgatcttcgcaccgcccttgtcggaaacgtacgtgctcgtcttccggcaatacaccttccatcgctacacgttcgagcacgaggctgagatgcgcacgatcccggccgattctgtcgagtggtggaagctcctgagccgactcatgctcacgatggtgacgaccgggattcgacggtcggggaagaccacgttcttgaaggtcatctttggcgcgcgcgatccgaatctcgaagtggtgacagtggaacgcggcacctttgaggcccatctgaagcgagactttccagaacgcgcgggacggatcattgcgctcaagtcaccgctcgatgagatggcatccctattcccggcgtttctacggtcggacgcgcactacatgatggtgccggagatccgaagcagtgaggtcgatttgctcatcctgtcgcgcgagcgcggcaacggatgtttggcaagctatcacagtccgtacattacgaacatcccgcgagagcttgcggatttggcactcgagaacaatccgagccgggattatcgggcgacctacatccgcacggcgcaaagcctcgatgtcgcgatcacgatgtgggaggacccgacggggcgaaagattgtgacgggcgtctacgcttatgaattcgaccatgagacggaatcctacacggtcacgacgtggatgaagtatcaccgcgccacagatacttggacgttccacgcggagattccgccgtccatgcgggcgcgcttggaggatacgtacccggacgttttggcggcgtttgaggcggagtttcagcgtttggcgtcggcgtatccattccagggcgaggccaagcgtcgcgtgaagattggggggtga

SEQ ID NO: 65 - DNA, 1434 bp, Artificial
  Alicyclobacillus acidocaldarius mutated SEQ ID NO 53
gtgtccgtgcatgagctcctgccaagcgagccctttcgcgcggatcggtatgtgctcgagacgcagcgcgagcgggccaaagactacggtgaagtgccatttgaccgagtgatcgaggcgtttcagcagtacctcggtgaggaagtcggcgggaaagacgacgtggactcgcagtacctgcaccgcaaataccgggcgctcatcggggatgaggcggcgaagcagtattttatccaccgcatccatgactttttgcgggaacgtcccgagtttcaaaacacgcgatatccgcggtactacccggacttgccggaagcgatctttcaacacgcgctcggcttcgggcccatgagcgtgtggtttgcaaatcctacggaatcagcgacggtcaatggaacgcagatcctgtttggcgtcaaggggtcaaacacgaaggtcctccaacccttcgcgtttgactccatcgaccaggtgaagcggttggtgcgcacgctcaccttgcgcgacccggcgaaccaggtcaatcagacgaatcattggacgcaggtcgatatgctcaatggcacgcgcgtcacgatcttcgcaccgcccttgtcggaaacgtacgtgctcgtcttccggcaatacaccttccatcgctacacgttcgagcacgaggctgagatgcgcacgatcccggccgattctgtcgagtggtggaagctcctgagccgactcatgctcacgatggtgacgaccgggattcgacggtcggggaagaccacgttcttgaaggtcatctttggcgcgcgcgatccgaatctcgaagtggtgacagtggaacgcggcacctttgaggcccatctgaagcgagactttccagaacgcgcgggacggatcattgcgctcaagtcaccgctcgatgagatggcatccctattcccggcgtttctacggtcggacgcgcactacatgatggtgccggagatccgaagcagtgaggtcgatttgctcatcctgtcgcgcgagcgcggcaacggatgtttggcaagctatcacagtccgtacgtgacgaacatcccgcgagagcttgcggatttggcactcgagaacaatccgagccgggattatcgggcgacctacatccgcacggcgcaaagcctcgatgtcgcgatcacgatgtgggatgacccgacggggcgaaagattgtgacgggcgtctacgcttatgaattcgaccatgagacggaatcctacacggtcacgacgtggatgaagtatcaccgcgccacagatacttggacgttccacgcggagattccgccgtccatgcgggcgcgcttggaggatacgtacccggacgttttggcggcgtttgaggcggagtttcagcgtttggcgtcggcgtatccattccagggcgaggccaagcgtcgcgtgaagattggggggtga

SEQ ID NO: 66 - DNA, 1434 bp, Artificial
  Alicyclobacillus acidocaldarius mutated SEQ ID NO 53
gtgtccgtgcatgagctcctgccaagcgagccctttcgcgcggatcggtatgtgctcgagacgcagcgcgagcgggccaaagactacggtgaagtgccatttgaccgagtgatcgaggcgtttcagcagtacctcggtgaggaagtcggcgggaaagacgacgtggactcgcagtacctgcaccgcaaataccgggcgctcatcggggatgaggcggcgaagcagtattttatccaccgcatccatgactttattcgggaacgtcccgagtttcaaaacacgcgatatccgcggtactacccggacttgccggaagcgatctttcaacacgcgctcggcttcgggcccatgagcgtgtggtttgcaaatcctacggaatcagcgacggtcaatggaacgcagatcctgtttggcgtcaaggggtcaaacacgaaggtcctccaacccttcgcgtttgactccatcgaccaggtgaagcggttggtgcgcacgctcaccttgcgcgacccggcgaaccaggtcaatcagacgaatcattggacgcaggtcgatatgctcaatggcacgcgcgtcacgatcttcgcaccgcccttgtcggaaacgtacgtgctcgtcttccggcaatacaccttccatcgctacacgttcgagcacgaggctgagatgcgcacgatcccggccgattctgtcgagtggtggaagctcctgagccgactcatgctcacgatggtgacgaccgggattcgacggtcggggaagaccacgttcttgaaggtcatctttggcgcgcgcgatccgaatctcgaagtggtgacagtggaacgcggcacctttgaggcccatctgaagcgagactttccagaacgcgcgggacggatcattgcgctcaagtcaccgctcgatgagatggcatccctattcccggcgtttctacggtcggacgcgcactacatgatggtgccggagatccgaagcagtgaggtcgatttgctcatcctgtcgcgcgagcgcggcaacggatgtttggcaagctatcacagtccgtacgtgacgaacatcccgcgagagcttgcggatttggcactcgagaacaatccgagccgggattatcgggcgacctacatccgcacggcgcaaagcctcgatgtcgcgatcacgatgtgggaggacccgacggggcgaaagattgtgacgggcgtctacgcttatgaattcgaccatgagacggaatcctacacggtcacgacgtggatgaagtatcaccgcgccacagatacttggacgttccacgcggagattccgccgtccatgcgggcgcgcttggaggatacgtacccggacgttttggcggcgtttgaggcggagtttcagcgtttggcgtcggcgtatccattccagggcgaggccaagcgtcgcgtgaagattggggggtga

SEQ ID NO: 67 - DNA, 1434 bp, Artificial
  Alicyclobacillus acidocaldarius mutated SEQ ID NO 53
gtgtccgtgcatgagctcctgccaagcgagccctttcgcgcggatcggtatgtgctcgagacgcagcgcgagcgggccaaagactacggtgaagtgccatttgaccgagtgatcgaggcgtttcagcagtacctcggtgaggaagtcggcgggaaagacgacgtggactcgcagtacctgcaccgcaaataccgggcgctcatcggggatgaggcggcgaagcagtattttatccaccgcatccatgactttttgcgggaacgtcccgagtttcaaaacacgcgatatccgcggtactacccggacttgccggaagcgatctttcaacacgcgctcggcttcgggcccatgagcgtgtggtttgcaaatcctacggaatcagcgacggtcaatggaacgcagatcctgtttggcgtcaaggggtcaaacacgaaggtcctccaacccttcgcgtttgactccatcgaccaggtgaagcggttggtgcgcacgctcaccttgcgcgacccggcgaaccaggtcaatcagacgaatcattggacgcaggtcgatatgctcaatggcacgcgcgtcacgatcttcgcaccgcccttgtcggaaacgtacgtgctcgtcttccggcaatacaccttccatcgctacacgttcgagcacgaggctgagatgcgcacgatcccggccgattctgtcgagtggtggaagctcctgagccgactcatgctcacgatggtgacgaccgggattcgacggtcggggaagaccacgttcttgaaggtcatctttggcgcgcgcgatccgaatctcgaagtggtgacagtggaacgcggcacctttgaggcccatctgaagcgagaatttccagaacgcgcgggacggatcattgcgctcaagtcaccgctcgatgagatggcatccctattcccggcgtttctacggtcggacgcgcactacatgatggtgccggagatccgaagcagtgaggtcgatttgctcatcctgtcgcgcgagcgcggcaacggatgtttggcaagctatcacagtccgtacgtgacgaacatcccgcgagagcttgcggatttggcactcgagaacaatccgagccgggattatcgggcgacctacatccgcacggcgcaaagcctcgatgtcgcgatcacgatgtgggaggacccgacggggcgaaagattgtgacgggcgtctacgcttatgaattcgaccatgagacggaatcctacacggtcacgacgtggatgaagtatcaccgcgccacagatacttggacgttccacgcggagattccgccgtccatgcgggcgcgcttggaggatacgtacccggacgttttggcggcgtttgaggcggagtttcagcgtttggcgtcggcgtatccattccagggcgaggccaagcgtcgcgtgaagattggggggtga

SEQ ID NO: 68 - DNA, 1434 bp, Artificial
  Alicyclobacillus acidocaldarius mutated SEQ ID NO 53
gtgtccgtgcatgagctcctgccaagcgagccctttcgcgcggatcggtatgtgctcgagacgcagcgcgagcgggccaaagactacggtgaagtgccatttgaccgagtgatcgaggcgtttcagcagtacctcggtgaggaagtcggcgggaaagacgacgtggactcgcagtacctgcaccgcaaataccgggcgctcatcggggatgaggcggcgaagcagtattttatccaccgcatccatgactttttgcgggaacgtcccgagtttcaaaacacgcgatatccgcggtactacccggacttgccggaagcgatctttcaacacgcgctcggcttcgggcccatgagcgtgtggtttgcaaatcctacggaatcagcgacggtcaatggaacgcagatcctgtttggcgtcaaggggtcaaacacgaaggtcctccaacccttcgcgtttgactccatcgaccaggtgaagcggttggtgcgcacgctcaccttgcgcgacccggcgaaccaggtcaatcagacgaatcattggacgcaggtcgatatgctcaatggcacgcgcgtcacgatcttcgcaccgcccttgtcggaaacgtacgtgctcgtcttccggcaatacaccttccatcgctacacgttcgagcacgaggctgagatgcgcacgatcccggccgattctgtcgagtggtggaagctcctgagccgactcatgctcacgatggtgacgaccgggattcgacggtcggggaagaccacgttcttgaaggtcatctttggcgcgcgcgatccgaatctcgaagtggtgacagtggaacgcggcacctttgaggcccatctgaagcgagactttccagaacgcgcgggacggatcattgcgctcaagtcaccgctcgatgagatggcatccctattcccggcgtttctacggtcggacgcgcactacatgatggtgccggagatccgaagcagtgaggtcgatttgctcatcctgtcgcgcgagcgcggcaacggatgtttggcaagctatcacagtccgtacgtgacgaacatcccgcgagagcttgcggatttggcactcgagaacaatccgagccgggattatcgggcgacctacatccgcacggcgcaaagcctcgatgtcgcgatcacgatgtgggaggacccgacggggcgaaagattgtgacgggcgtctacgcttatgaattcgaccatgagacggaatcctacacggtcacgacgtggatgaagtatcaccgcgccacagatacttggacgttccacgcggagattccgccgtccatgcgggcgcgcttggaggatacgtacccggacgttttggcggcgtttgaggcggagtttcagcgtttggcgtcggcgtatccattccagggcgaggcccgtcgtcgcgtgaagattggggggtga

SEQ ID NO: 69 - protein, 349 aa, Alicyclobacillus acidocaldarius
MIAVGLRESLQRELTGRVEIAEDWHALEGRKVDALLLDAKRVPETELYEIREWFSETPITYIVDEFTSALTAFAAAHNIRLVHVSRVQSYLDEAIGQGQSTPILAFWGVYPRLGTTTIALAVAHVLAAQHGKSVGVLGLNAYDPGTVMVPGAEHHLDDILSYLAQQKLDPETLQAAMEFVLRVKYLPGLQNQTRALAVMPEHVRHLLRVAQSQFEVLVLDVGSALNTALALEGLQAATHRYVIANDLVATQRQLLRQMDYILRPLGVEPSDLMLVGSQVHGKGSLAKSVGLMQVTSIPYYPSIDLFAEQSPEPMKVFLAEKTFRKAVETLAQSAMTTPVTPEVAASVRA

SEQ ID NO: 70 - DNA, 1050 bp, Alicyclobacillus acidocaldarius
gtgatcgcggtgggacttcgtgagtcgcttcaaagggaacttaccgggcgcgtggaaatcgcggaagactggcatgcgcttgagggccgtaaggtagacgcccttttgctcgatgccaagcgtgtgccggagacggagctgtacgagattcgagagtggttttccgagacgcctatcacctacatcgtggacgagttcacgtccgcactcaccgcgtttgcagcggcacacaacatccgtctcgtgcatgtctcgcgcgtccagtcttatctggacgaagccatcgggcaaggccaatccacgccgatcctcgcgttttggggtgtgtacccgcgacttggcaccacgaccattgcgctcgccgtcgcgcacgtcttggccgcacagcatggcaagtccgtcggggtcttgggcctcaacgcctatgacccaggcacggtcatggtgccaggggcagaacatcatctggacgacattctgtcctatctcgcgcagcaaaagctcgatccggagaccctgcaggccgcgatggagtttgtgctgcgcgtgaagtacctgccgggactgcaaaaccaaacgcgggcactggcggtgatgcctgagcacgtccgacacctgctccgcgtggcacagtcacagtttgaggtgttggtgctggacgtgggaagcgcgctcaacacggcgctcgcgctcgaaggtctccaagcggccacgcaccgctacgtcatcgccaatgacctggtggcgacccagcggcaactcctgcggcagatggattacattctgcggcctttgggtgttgagccaagcgacctgatgcttgtgggcagtcaagtgcatggcaaggggagcctcgcgaagtcggtggggctgatgcaggtaacatccatcccgtattacccgtccattgaccttttcgcggagcaatcaccagagccgatgaaggtgtttctggcggaaaagaccttccgcaaggcggtcgagaccctggctcaatcggcaatgacgacgcctgtgaccccggaggtggctgcgagtgtccgtgcatga

SEQ ID NO: 71 - protein, 319 aa, Bacillus cereus
LLISDRVLPYSELSTIEFENKKVFYMLENQYKPQLESTVKAICNSKDIYLIPPRLVVEQIVDFIDQNLNLAMVQKTNIITFFSSVSNIGTTSTCLSVGKALSQYTNAKVGVLLLNAWDSGTDQLNFKGNYMDQVKSKLASKTISSEQEFLSQFHMVNPNLYILGGNRDTKMERLFTKEEINYLIEHSKQTFDVVLVDAGSHFDNANMVQALNESNLRFLIMNQQTKAIRKFNQFHRDILYPLGYEKEDLLMIINQFEDLSHLPTTKDIHKDIDIPLLTTIEKSENGMLSEIERTVLYDYEDIGYKQSINAVAKSIASSV

SEQ ID NO: 72 - protein, 256 aa, Bacillus NRRL B-14911
AIVIDGKCFPQSELKELRKLYPEIPVFYQFYQVTNEQQMKNLQMICAAHRIVLLSEFLSEKQIEEEVEKHLFAKESVYKNRIISFFGTHSGAGVSTTVLNVADLLAQQVNEKVLVLSLNPWDPADYFLPYEGKYLSDIKIELKTGGITEEKLQKAVHHYPNSFYHLAGNRDIKLQRYYRTEEISTLLDTAKKVFDVILIDAGTHFDNAAFAQAYKQSDLKFLVTTQEPKGFRGYWPHIFHQLLEPIGGKADEYLLI

SEQ ID NO: 73 - protein, 156 aa, Paenibacillus JDR-2
AAPLITFVGTTPNIGTTSAAFAAAFRMAEASGRQIGYLCLHLKSAKLHRYLGIAEPAVTLDKLRPELKSGSLTPGKLQRAVQPVRGMPNLHVLFGNMLRDQAEFYSPEEMKHLLQIAGQTFAMVIIDVGAYWDNAATICALREADTRIIVTTDALS

SEQ ID NO: 74 - protein, 338 aa, Azoarcus  EbN1
GHATSSEPLGAVNGTVPDVVVLDAFRPANLGALEQLTLRYPQIEPIVITADTSSDFLLQAFRAGVREVLPISPSPEALHAALARITRKRGGSATNGKILALTSCKGGSGATFLATNLAWVLAAAHGKRVALIDLNLQFGDAAMYVTDQKPASNLALVCQQIHRLDAAFLQSAMIEVAPGFHLLAAPDDPAHSTDVRPEHVEAILKVARTNYDFVIVDVGRSLDAVSLKPFDMADMIFPVVQLTLPFIREAKRLVEVFVSLGYPMSKVGLVVNRQHKNSDISLQDVERTVKAKLFKTVPNSYDTVAASVNQGEPIARLAKNSPVTKALREIAESLVDDP

SEQ ID NO: 75 - protein, 291 aa, Ralstonia pickettii
GQGNDLLILEASRFSSDDLQQLRRLSSEHPETLCMLLTEAPSADLLMRAMRAGVQCVLPWPPEAQEFRDEVQRCTSHALSSSHNDGQVVSFLSCRGGSGTTFIAANFAHVLSARHGKRVLLIDLCQQYGDAAFLLTDQSPPATLANVCNQIDRLDAALLDACLTHVSQDFDVLAGAGDPIKSGEIKATHLERILALAASMYDVVVFDVGQDINPASIVVLDHSNVIYPVLHLSLPYLRAGRKLMEICHSLGYRAERLRLVINQYDKHMPISQNMMESAFGMPVAHILPYDP

SEQ ID NO: 76 - protein, 349 aa, Artificial
  Alicyclobacillus acidocaldarius mutated SEQ ID NO 69
MIAVGLRESLQRELTGRVEIAEDWHALEGRKVDALLLDAKRVPETELYEIREWFSETPITYIVDEFTSALTAFAAAHNIRLVHVSRVQSYLDEAIGQGQSTPILAFWGVYPRLGTTTIALAVAHVLAAQHGKSVGVLGLNAYDPGTVMVPGAEHHLDDILSYLAQQKLDPETLQAAMEFVLRVKYLPGLQNQTRALAVMPEHVRHLLRVAQSQFEVLVLDVGSALNTALALEGLQAATHRYVIANDLVATQRNLLRQMDYILRPLGVEPSDLMLVGSQVHGKGSLAKSVGLMQVTSIPYYPSIDLFAEQSPEPMKVFLAEKTFRKAVETLAQSAMTTPVTPEVAASVRA

SEQ ID NO: 77 - protein, 349 aa, Artificial
  Alicyclobacillus acidocaldarius mutated SEQ ID NO 69
MIAVGLRESLQRELTGRVEIAEDWHALEGRKVDALLLDAKRVPETELYEIREWFSETPITYIVDEFTSALTAFAAAHNIRLVHVSRVQSYLDEAIGQGQSTPILAFWGVYPRLGTTTIALAVAHVLAAQHGKSVGVLGLNAYDPGTVMVPGAEHHLDDILSYLAQQKLDPETLQAAMEFVLRVKYLPGLQNNTRALAVMPEHVRHLLRVAQSQFEVLVLDVGSALNTALALEGLQAATHRYVIANDLVATQRQLLRQMDYILRPLGVEPSDLMLVGSQVHGKGSLAKSVGLMQVTSIPYYPSIDLFAEQSPEPMKVFLAEKTFRKAVETLAQSAMTTPVTPEVAASVRA

SEQ ID NO: 78 - protein, 349 aa, Artificial
  Alicyclobacillus acidocaldarius mutated SEQ ID NO 69
MIAVGLRESLQRELTGRVEIAEDWHALEGRKVDALLLDAKRVPETELYEIREWFSETPITYIVDEFTSALTAFAAAHNIRLVHVSRVQSYLDEAIGQGQSTPILAFWGVYPRLGTTTIALAVAHVLAAQHGKSVGVLGLNAYDPGTVMVPGAEHHLDDILSYLAQNKLDPETLQAAMEFVLRVKYLPGLQNQTRALAVMPEHVRHLLRVAQSQFEVLVLDVGSALNTALALEGLQAATHRYVIANDLVATQRQLLRQMDYILRPLGVEPSDLMLVGSQVHGKGSLAKSVGLMQVTSIPYYPSIDLFAEQSPEPMKVFLAEKTFRKAVETLAQSAMTTPVTPEVAASVRA

SEQ ID NO: 79 - protein, 349 aa, Artificial
  Alicyclobacillus acidocaldarius mutated SEQ ID NO 69
MIAVGLRESLQRELTGRVEIAEDWHALEGRKIDALLLDAKRVPETELYEIREWFSETPITYIVDEFTSALTAFAAAHNIRLVHVSRVQSYLDEAIGQGQSTPILAFWGVYPRLGTTTIALAVAHVLAAQHGKSVGVLGLNAYDPGTVMVPGAEHHLDDILSYLAQQKLDPETLQAAMEFVLRVKYLPGLQNQTRALAVMPEHVRHLLRVAQSQFEVLVLDVGSALNTALALEGLQAATHRYVIANDLVATQRQLLRQMDYILRPLGVEPSDLMLVGSQVHGKGSLAKSVGLMQVTSIPYYPSIDLFAEQSPEPMKVFLAEKTFRKAVETLAQSAMTTPVTPEVAASVRA

SEQ ID NO: 80 - protein, 349 aa, Artificial
  Alicyclobacillus acidocaldarius mutated SEQ ID NO 69
MIAVGLRESLQRELTGRVEIAEDWHALEGRKVDALLLDAKRVPETELYEIREWFSETPITYIVDEFTSALTAFAAAHNIRLVHVSRVQSYLDEAIGQGQSTPILAFWGVYPRLGTTTIALAVAHVLAAQHGKSVGVLGLNAYDPGTVMVPGAEHHLDDILSYLAQQKLDPETLQAAMEFVLRVKYLPGLQNQTRALAVMPEHVRHLLKVAQSQFEVLVLDVGSALNTALALEGLQAATHRYVIANDLVATQRQLLRQMDYILRPLGVEPSDLMLVGSQVHGKGSLAKSVGLMQVTSIPYYPSIDLFAEQSPEPMKVFLAEKTFRKAVETLAQSAMTTPVTPEVAASVRA

SEQ ID NO: 81 - DNA, 1050 bp, Artificial
  Alicyclobacillus acidocaldarius mutated SEQ ID NO 70
gtgatcgcggtgggacttcgtgagtcgcttcaaagggaacttaccgggcgcgtggaaatcgcggaagactggcatgcgcttgagggccgtaaggtagacgcccttttgctcgatgccaagcgtgtgccggagacggagctgtacgagattcgagagtggttttccgagacgcctatcacctacatcgtggacgagttcacgtccgcactcaccgcgtttgcagcggcacacaacatccgtctcgtgcatgtctcgcgcgtccagtcttatctggacgaagccatcgggcaaggccaatccacgccgatcctcgcgttttggggtgtgtacccgcgacttggcaccacgaccattgcgctcgccgtcgcgcacgtcttggccgcacagcatggcaagtccgtcggggtcttgggcctcaacgcctatgacccaggcacggtcatggtgccaggggcagaacatcatctggacgacattctgtcctatctcgcgcagcaaaagctcgatccggagaccctgcaggccgcgatggagtttgtgctgcgcgtgaagtacctgccgggactgcaaaaccaaacgcgggcactggcggtgatgcctgagcacgtccgacacctgctccgcgtggcacagtcacagtttgaggtgttggtgctggacgtgggaagcgcgctcaacacggcgctcgcgctcgaaggtctccaagcggccacgcaccgctacgtcatcgccaatgacctggtggcgacccagcggaatctcctgcggcagatggattacattctgcggcctttgggtgttgagccaagcgacctgatgcttgtgggcagtcaagtgcatggcaaggggagcctcgcgaagtcggtggggctgatgcaggtaacatccatcccgtattacccgtccattgaccttttcgcggagcaatcaccagagccgatgaaggtgtttctggcggaaaagaccttccgcaaggcggtcgagaccctggctcaatcggcaatgacgacgcctgtgaccccggaggtggctgcgagtgtccgtgcatga

SEQ ID NO: 82 - DNA, 1050 bp, Artificial
  Alicyclobacillus acidocaldarius mutated SEQ ID NO 70
gtgatcgcggtgggacttcgtgagtcgcttcaaagggaacttaccgggcgcgtggaaatcgcggaagactggcatgcgcttgagggccgtaaggtagacgcccttttgctcgatgccaagcgtgtgccggagacggagctgtacgagattcgagagtggttttccgagacgcctatcacctacatcgtggacgagttcacgtccgcactcaccgcgtttgcagcggcacacaacatccgtctcgtgcatgtctcgcgcgtccagtcttatctggacgaagccatcgggcaaggccaatccacgccgatcctcgcgttttggggtgtgtacccgcgacttggcaccacgaccattgcgctcgccgtcgcgcacgtcttggccgcacagcatggcaagtccgtcggggtcttgggcctcaacgcctatgacccaggcacggtcatggtgccaggggcagaacatcatctggacgacattctgtcctatctcgcgcagcaaaagctcgatccggagaccctgcaggccgcgatggagtttgtgctgcgcgtgaagtacctgccgggactgcaaaacaatacgcgggcactggcggtgatgcctgagcacgtccgacacctgctccgcgtggcacagtcacagtttgaggtgttggtgctggacgtgggaagcgcgctcaacacggcgctcgcgctcgaaggtctccaagcggccacgcaccgctacgtcatcgccaatgacctggtggcgacccagcggcaactcctgcggcagatggattacattctgcggcctttgggtgttgagccaagcgacctgatgcttgtgggcagtcaagtgcatggcaaggggagcctcgcgaagtcggtggggctgatgcaggtaacatccatcccgtattacccgtccattgaccttttcgcggagcaatcaccagagccgatgaaggtgtttctggcggaaaagaccttccgcaaggcggtcgagaccctggctcaatcggcaatgacgacgcctgtgaccccggaggtggctgcgagtgtccgtgcatga

SEQ ID NO: 83 - DNA, 1050 bp, Artificial
  Alicyclobacillus acidocaldarius mutated SEQ ID NO 70
gtgatcgcggtgggacttcgtgagtcgcttcaaagggaacttaccgggcgcgtggaaatcgcggaagactggcatgcgcttgagggccgtaaggtagacgcccttttgctcgatgccaagcgtgtgccggagacggagctgtacgagattcgagagtggttttccgagacgcctatcacctacatcgtggacgagttcacgtccgcactcaccgcgtttgcagcggcacacaacatccgtctcgtgcatgtctcgcgcgtccagtcttatctggacgaagccatcgggcaaggccaatccacgccgatcctcgcgttttggggtgtgtacccgcgacttggcaccacgaccattgcgctcgccgtcgcgcacgtcttggccgcacagcatggcaagtccgtcggggtcttgggcctcaacgcctatgacccaggcacggtcatggtgccaggggcagaacatcatctggacgacattctgtcctatctcgcgcagaataagctcgatccggagaccctgcaggccgcgatggagtttgtgctgcgcgtgaagtacctgccgggactgcaaaaccaaacgcgggcactggcggtgatgcctgagcacgtccgacacctgctccgcgtggcacagtcacagtttgaggtgttggtgctggacgtgggaagcgcgctcaacacggcgctcgcgctcgaaggtctccaagcggccacgcaccgctacgtcatcgccaatgacctggtggcgacccagcggcaactcctgcggcagatggattacattctgcggcctttgggtgttgagccaagcgacctgatgcttgtgggcagtcaagtgcatggcaaggggagcctcgcgaagtcggtggggctgatgcaggtaacatccatcccgtattacccgtccattgaccttttcgcggagcaatcaccagagccgatgaaggtgtttctggcggaaaagaccttccgcaaggcggtcgagaccctggctcaatcggcaatgacgacgcctgtgaccccggaggtggctgcgagtgtccgtgcatga

SEQ ID NO: 84 - DNA, 1050 bp, Artificial
  Alicyclobacillus acidocaldarius mutated SEQ ID NO 70
gtgatcgcggtgggacttcgtgagtcgcttcaaagggaacttaccgggcgcgtggaaatcgcggaagactggcatgcgcttgagggccgtaagattgacgcccttttgctcgatgccaagcgtgtgccggagacggagctgtacgagattcgagagtggttttccgagacgcctatcacctacatcgtggacgagttcacgtccgcactcaccgcgtttgcagcggcacacaacatccgtctcgtgcatgtctcgcgcgtccagtcttatctggacgaagccatcgggcaaggccaatccacgccgatcctcgcgttttggggtgtgtacccgcgacttggcaccacgaccattgcgctcgccgtcgcgcacgtcttggccgcacagcatggcaagtccgtcggggtcttgggcctcaacgcctatgacccaggcacggtcatggtgccaggggcagaacatcatctggacgacattctgtcctatctcgcgcagcaaaagctcgatccggagaccctgcaggccgcgatggagtttgtgctgcgcgtgaagtacctgccgggactgcaaaaccaaacgcgggcactggcggtgatgcctgagcacgtccgacacctgctccgcgtggcacagtcacagtttgaggtgttggtgctggacgtgggaagcgcgctcaacacggcgctcgcgctcgaaggtctccaagcggccacgcaccgctacgtcatcgccaatgacctggtggcgacccagcggcaactcctgcggcagatggattacattctgcggcctttgggtgttgagccaagcgacctgatgcttgtgggcagtcaagtgcatggcaaggggagcctcgcgaagtcggtggggctgatgcaggtaacatccatcccgtattacccgtccattgaccttttcgcggagcaatcaccagagccgatgaaggtgtttctggcggaaaagaccttccgcaaggcggtcgagaccctggctcaatcggcaatgacgacgcctgtgaccccggaggtggctgcgagtgtccgtgcatga

SEQ ID NO: 85 - DNA, 1050 bp, Artificial
  Alicyclobacillus acidocaldarius mutated SEQ ID NO 70
gtgatcgcggtgggacttcgtgagtcgcttcaaagggaacttaccgggcgcgtggaaatcgcggaagactggcatgcgcttgagggccgtaaggtagacgcccttttgctcgatgccaagcgtgtgccggagacggagctgtacgagattcgagagtggttttccgagacgcctatcacctacatcgtggacgagttcacgtccgcactcaccgcgtttgcagcggcacacaacatccgtctcgtgcatgtctcgcgcgtccagtcttatctggacgaagccatcgggcaaggccaatccacgccgatcctcgcgttttggggtgtgtacccgcgacttggcaccacgaccattgcgctcgccgtcgcgcacgtcttggccgcacagcatggcaagtccgtcggggtcttgggcctcaacgcctatgacccaggcacggtcatggtgccaggggcagaacatcatctggacgacattctgtcctatctcgcgcagcaaaagctcgatccggagaccctgcaggccgcgatggagtttgtgctgcgcgtgaagtacctgccgggactgcaaaaccaaacgcgggcactggcggtgatgcctgagcacgtccgacacctgctcaaagtggcacagtcacagtttgaggtgttggtgctggacgtgggaagcgcgctcaacacggcgctcgcgctcgaaggtctccaagcggccacgcaccgctacgtcatcgccaatgacctggtggcgacccagcggcaactcctgcggcagatggattacattctgcggcctttgggtgttgagccaagcgacctgatgcttgtgggcagtcaagtgcatggcaaggggagcctcgcgaagtcggtggggctgatgcaggtaacatccatcccgtattacccgtccattgaccttttcgcggagcaatcaccagagccgatgaaggtgtttctggcggaaaagaccttccgcaaggcggtcgagaccctggctcaatcggcaatgacgacgcctgtgaccccggaggtggctgcgagtgtccgtgcatga

SEQ ID NO: 86 - protein, 235 aa, Alicyclobacillus acidocaldarius
MKSWVRYTLATTLFVVGVGGSIAYNQFVSPMLTSEWVYVARTQLPADTPIQASDVERIRVPKSEVSPDAITNAEGLMGTYTAQPVDQNQVLTALDTEPDPFTITPGTEDVPIPSTWIASVSETLRQGDYVDLIPIAEPQAGSNNVGMLTTTSEASEFKHLLVLSVHTDNNAEVTSQQTGAPQSVGARGNGSGVPASVDVKMTSAEAQALASLIQQKYQLLIVGVSDDNRTGGGAK

SEQ ID NO: 87 - DNA, 708 bp, Alicyclobacillus acidocaldarius
atgaagtcttgggtgagatacacccttgcgaccacgctgttcgtggtcggcgtcggggggagcatcgcgtacaaccagttcgtgtccccgatgcttacgagtgaatgggtgtacgtcgcgcgcacgcagctgcctgcggatactcccattcaagcgtcagatgtcgagcgtatccgcgtaccgaaaagcgaggtaagtcccgacgcaattacgaacgcggaagggcttatgggcacatacacggcgcaaccggtcgaccagaatcaggtgttgaccgcgcttgataccgagcccgatcccttcacgattacccccggcacggaggatgtgccgattccttcaacttggattgcgtcggtgtcggagacgcttcgccaaggggattacgttgatctgattcccattgccgagccgcaagcgggaagtaacaacgtagggatgttgaccacaaccagcgaggcctccgaattcaaacatctcctcgtgttatcggtacacaccgataacaacgccgaggtgacgtcgcaacagacgggggcgccgcaatcggtgggggcacgtgggaacggaagcggtgtgcctgcgagcgtcgatgtcaagatgacatccgcggaagcgcaggccttggcgagtttgatccagcagaagtatcagctgctcatcgtgggcgtgtcggacgacaaccggacgggaggtggggcgaagtga

SEQ ID NO: 88 - protein, 213 aa, Clostridium difficile
IKNKANILLQFSLFILFAGGVFLFTQSQVKPVAVYQYSRNIPENTVIQKGDYIKTFKPKDILTKSMITNEKDINGKILTTNVYRSEYAIKNNLEDPAKLDEFAKIDLSNLRKVSIPVEMKDAVGGNLKKGDRVDLTFVKQGDSKNNDTSDSFTYAKTFMQDVLVYNVVDDGGKKYVDQTEGTQSLANEKGEVVESGSLSIVTVAVTAQQAEEI

SEQ ID NO: 89 - protein, 135 aa, Bacillus  NRRL B-14911
MKPWLKITLGVLLSVFVIAFIIVWDTVIKDKIDSVEVAIVRPGVVIEKNQVISKDLLMMEQRNRATLVEGTVYDMDDVVGYEAKQKLYGNSILSERDVEFIPFTPDPEKGEAIRPIPASWIYASPSTIRRKDHID

SEQ ID NO: 90 - protein, 113 aa, Bdellovibrio bacteriovorus
VVVAKEDIAEMQTVYDTMVETKELPADFIQPDAITVPDEIIGNVAAVPIRKGQMIVKNNLLTPGPDTGISLQVAPSKRAVTIPVDEVRGVAKLIRPGDRIDIYAAVDSGKGVN

SEQ ID NO: 91 - protein, 113 aa, Bdellovibrio bacteriovorus
VVVAKEDIAEMQTIYDTMVETKELPADFIQPDAITIPDEIIGNVAAVPIRKGQMVVKNNLLTPGPDTGISLQVAPSKRAVTIPVDEVRGVAKLIRPGDRIDIYAAVDSGKGVN

SEQ ID NO: 92 - protein, 113 aa, Bdellovibrio bacteriovorus; identical to SEQ ID NO: 91

SEQ ID NO: 93 - protein, 235 aa, Artificial
  Alicyclobacillus acidocaldarius mutated SEQ ID NO 86
MKSWVRYTLATTLFVVGVGGSIAYNQFVSPMLTSEWVYVARTQLPADTPIQASDVERIRVPKSEVSPDAITNAEGLMGTYTAQPVDQNQVLTALDTEPDPFTITPGTEDVPIPSTWIASVSETLRQGDYVDLIPIAEPQAGSNNVGMLTTTSEASEFKHLLVLSVHTDNNAEVTSQQTGAPQSVGARGNGSGVPASVDVKMTSAEAQALASLIQQKYNLLIVGVSDDNRTGGGAK

SEQ ID NO: 94 - protein, 235 aa, Artificial
  Alicyclobacillus acidocaldarius mutated SEQ ID NO 86
MKSWVRYTLATTLFVVGVGGSIAYNQFVSPMLTSEWVYVARTQLPADTPIQASDVERIRVPKSEVSPDAITNAEGLMGTYTAQPVDQNQVLTALDTEPEPFTITPGTEDVPIPSTWIASVSETLRQGDYVDLIPIAEPQAGSNNVGMLTTTSEASEFKHLLVLSVHTDNNAEVTSQQTGAPQSVGARGNGSGVPASVDVKMTSAEAQALASLIQQKYQLLIVGVSDDNRTGGGAK

SEQ ID NO: 95 - protein, 235 aa, Artificial
  Alicyclobacillus acidocaldarius mutated SEQ ID NO 86
MKSWVRYTLATTLFVVGVGGSIAYNQFVSPMLTSEWVYVARTQLPADTPIQASDVERIRVPKSEVSPDAITNAEGLMGTYTAQPVDQNQVLTALDTEPDPFTITPGTEDVPIPSTWIASVSETLRQGDYVDLLPIAEPQAGSNNVGMLTTTSEASEFKHLLVLSVHTDNNAEVTSQQTGAPQSVGARGNGSGVPASVDVKMTSAEAQALASLIQQKYQLLIVGVSDDNRTGGGAK

SEQ ID NO: 96 - protein, 235 aa, Artificial
  Alicyclobacillus acidocaldarius mutated SEQ ID NO 86
MKSWVRYTLATTLFVVGVGGSIAYNQFVSPMLTSEWVYVARTQLPAETPIQASDVERIRVPKSEVSPDAITNAEGLMGTYTAQPVDQNQVLTALDTEPDPFTITPGTEDVPIPSTWIASVSETLRQGDYVDLIPIAEPQAGSNNVGMLTTTSEASEFKHLLVLSVHTDNNAEVTSQQTGAPQSVGARGNGSGVPASVDVKMTSAEAQALASLIQQKYQLLIVGVSDDNRTGGGAK

SEQ ID NO: 97 - protein, 235 aa, Artificial
  Alicyclobacillus acidocaldarius mutated SEQ ID NO 86
MKSWVRYTLATTLFVVGVGGSIAYNQFVSPMLTSEWVYVARTQLPADTPIQASDVERIRVPKSEVSPDAITNAEGLMGTYTAQPVDQNQVLTALDTEPDPFTITPGTEDVPIPSTWIASVSETLRQGDYVDLIPIAEPQAGSNQVGMLTTTSEASEFKHLLVLSVHTDNNAEVTSQQTGAPQSVGARGNGSGVPASVDVKMTSAEAQALASLIQQKYQLLIVGVSDDNRTGGGAK

SEQ ID NO: 98 - DNA, 708 bp, Artificial
  Alicyclobacillus acidocaldarius mutated SEQ ID NO 87
atgaagtcttgggtgagatacacccttgcgaccacgctgttcgtggtcggcgtcggggggagcatcgcgtacaaccagttcgtgtccccgatgcttacgagtgaatgggtgtacgtcgcgcgcacgcagctgcctgcggatactcccattcaagcgtcagatgtcgagcgtatccgcgtaccgaaaagcgaggtaagtcccgacgcaattacgaacgcggaagggcttatgggcacatacacggcgcaaccggtcgaccagaatcaggtgttgaccgcgcttgataccgagcccgatcccttcacgattacccccggcacggaggatgtgccgattccttcaacttggattgcgtcggtgtcggagacgcttcgccaaggggattacgttgatctgattcccattgccgagccgcaagcgggaagtaacaacgtagggatgttgaccacaaccagcgaggcctccgaattcaaacatctcctcgtgttatcggtacacaccgataacaacgccgaggtgacgtcgcaacagacgggggcgccgcaatcggtgggggcacgtgggaacggaagcggtgtgcctgcgagcgtcgatgtcaagatgacatccgcggaagcgcaggccttggcgagtttgatccagcagaagtataatctgctcatcgtgggcgtgtcggacgacaaccggacgggaggtggggcgaagtga

SEQ ID NO: 99 - DNA, 708 bp, Artificial
  Alicyclobacillus acidocaldarius mutated SEQ ID NO 87
atgaagtcttgggtgagatacacccttgcgaccacgctgttcgtggtcggcgtcggggggagcatcgcgtacaaccagttcgtgtccccgatgcttacgagtgaatgggtgtacgtcgcgcgcacgcagctgcctgcggatactcccattcaagcgtcagatgtcgagcgtatccgcgtaccgaaaagcgaggtaagtcccgacgcaattacgaacgcggaagggcttatgggcacatacacggcgcaaccggtcgaccagaatcaggtgttgaccgcgcttgataccgagcccgaacccttcacgattacccccggcacggaggatgtgccgattccttcaacttggattgcgtcggtgtcggagacgcttcgccaaggggattacgttgatctgattcccattgccgagccgcaagcgggaagtaacaacgtagggatgttgaccacaaccagcgaggcctccgaattcaaacatctcctcgtgttatcggtacacaccgataacaacgccgaggtgacgtcgcaacagacgggggcgccgcaatcggtgggggcacgtgggaacggaagcggtgtgcctgcgagcgtcgatgtcaagatgacatccgcggaagcgcaggccttggcgagtttgatccagcagaagtatcagctgctcatcgtgggcgtgtcggacgacaaccggacgggaggtggggcgaagtga

SEQ ID NO: 100 - DNA, 708 bp, Artificial
  Alicyclobacillus acidocaldarius mutated SEQ ID NO 87
atgaagtcttgggtgagatacacccttgcgaccacgctgttcgtggtcggcgtcggggggagcatcgcgtacaaccagttcgtgtccccgatgcttacgagtgaatgggtgtacgtcgcgcgcacgcagctgcctgcggatactcccattcaagcgtcagatgtcgagcgtatccgcgtaccgaaaagcgaggtaagtcccgacgcaattacgaacgcggaagggcttatgggcacatacacggcgcaaccggtcgaccagaatcaggtgttgaccgcgcttgataccgagcccgatcccttcacgattacccccggcacggaggatgtgccgattccttcaacttggattgcgtcggtgtcggagacgcttcgccaaggggattacgttgatctgttacccattgccgagccgcaagcgggaagtaacaacgtagggatgttgaccacaaccagcgaggcctccgaattcaaacatctcctcgtgttatcggtacacaccgataacaacgccgaggtgacgtcgcaacagacgggggcgccgcaatcggtgggggcacgtgggaacggaagcggtgtgcctgcgagcgtcgatgtcaagatgacatccgcggaagcgcaggccttggcgagtttgatccagcagaagtatcagctgctcatcgtgggcgtgtcggacgacaaccggacgggaggtggggcgaagtga

SEQ ID NO: 101 - DNA, 708 bp, Artificial
  Alicyclobacillus acidocaldarius mutated SEQ ID NO 87
atgaagtcttgggtgagatacacccttgcgaccacgctgttcgtggtcggcgtcggggggagcatcgcgtacaaccagttcgtgtccccgatgcttacgagtgaatgggtgtacgtcgcgcgcacgcagctgcctgcggaaactcccattcaagcgtcagatgtcgagcgtatccgcgtaccgaaaagcgaggtaagtcccgacgcaattacgaacgcggaagggcttatgggcacatacacggcgcaaccggtcgaccagaatcaggtgttgaccgcgcttgataccgagcccgatcccttcacgattacccccggcacggaggatgtgccgattccttcaacttggattgcgtcggtgtcggagacgcttcgccaaggggattacgttgatctgattcccattgccgagccgcaagcgggaagtaacaacgtagggatgttgaccacaaccagcgaggcctccgaattcaaacatctcctcgtgttatcggtacacaccgataacaacgccgaggtgacgtcgcaacagacgggggcgccgcaatcggtgggggcacgtgggaacggaagcggtgtgcctgcgagcgtcgatgtcaagatgacatccgcggaagcgcaggccttggcgagtttgatccagcagaagtatcagctgctcatcgtgggcgtgtcggacgacaaccggacgggaggtggggcgaagtga

SEQ ID NO: 102 - DNA, 708 bp, Artificial
  Alicyclobacillus acidocaldarius mutated SEQ ID NO 87
atgaagtcttgggtgagatacacccttgcgaccacgctgttcgtggtcggcgtcggggggagcatcgcgtacaaccagttcgtgtccccgatgcttacgagtgaatgggtgtacgtcgcgcgcacgcagctgcctgcggatactcccattcaagcgtcagatgtcgagcgtatccgcgtaccgaaaagcgaggtaagtcccgacgcaattacgaacgcggaagggcttatgggcacatacacggcgcaaccggtcgaccagaatcaggtgttgaccgcgcttgataccgagcccgatcccttcacgattacccccggcacggaggatgtgccgattccttcaacttggattgcgtcggtgtcggagacgcttcgccaaggggattacgttgatctgattcccattgccgagccgcaagcgggaagtaaccaagtagggatgttgaccacaaccagcgaggcctccgaattcaaacatctcctcgtgttatcggtacacaccgataacaacgccgaggtgacgtcgcaacagacgggggcgccgcaatcggtgggggcacgtgggaacggaagcggtgtgcctgcgagcgtcgatgtcaagatgacatccgcggaagcgcaggccttggcgagtttgatccagcagaagtatcagctgctcatcgtgggcgtgtcggacgacaaccggacgggaggtggggcgaagtga

SEQ ID NO: 103 - protein, 405 aa, Alicyclobacillus acidocaldarius
MLYLAFPADLRERYAESTWLVYDKQVLETSFAPGDILLLSSWVVPHRAEQLQVIHRARQEGARVIFVGSKEDETDEWKRQLCALGVYDFAFFGDEVVLSVLDDLIEHPRTPLDVRAYVDETVWHLAREDPVVVEVETPKADVDEPTQDEAPFRPRWRRPRWGKPSPPAPERLQVVQPRLVVVLGLWPRAGVTTITYLLAQLFAKQLPTRSVACIEHPRPWPRMWDYFQLDARMPAENYRHWTADGVGQEIEVDGVDLVPLPPGWIGSADYGQPMVQYIFRHMRKPVTLVDVGAQAPSEMLLGVADRIVCVLDCDPTFLSIAELGNQYRALSAKYGESMVTVLNKWTRYAHYEDLFEDAVKVPYLAPEMMQQALWAGQFPDVATLTSELHELTERVVTPLLPARVG

SEQ ID NO: 104 - DNA, 1218 bp, Alicyclobacillus acidocaldarius
atgctttatctcgcgtttccggcggacctgcgcgagcgttacgcggaaagcacatggctcgtctacgacaagcaagtgcttgagacgtcgtttgcgccaggggacatcctgctcctctcctcgtgggtggttccacatcgtgcggaacaactccaggtgatccatcgagcgcgacaagaaggtgcgcgcgtgatctttgtcggctcgaaagaggacgaaaccgacgagtggaagcggcagttgtgtgcgcttggtgtgtatgacttcgcgtttttcggagatgaagtcgtacttagcgtgctcgacgacctcattgaacatccgcggacaccgctcgacgtgcgcgcatacgtggacgagacggtgtggcacttggcacgggaagacccggtggtggttgaggtcgagacccccaaagcggatgtggacgagcctacgcaggatgaagcgccctttcgtccacgctggcggcgtccgcgatggggcaagccgagtccgcctgcacccgaacggttgcaggttgtgcagccacggcttgtcgtggtccttggcctgtggccgcgcgcaggggtcacgacgatcacgtacctgctcgcgcagctcttcgcgaaacagctgcccacgcgctctgtggcctgtatcgagcatcccaggccttggccgcggatgtgggactactttcagctggatgcacggatgccggccgagaactatcggcactggacggcggacggtgtgggacaagaaatcgaggtggatggggtggatttggtgcctctgccgcctggttggattgggagtgcggattacggccagcccatggtgcagtacatcttccggcacatgcgaaagccggtgacgctcgtcgacgtgggggcacaagcgccaagcgagatgcttttaggcgtggcggaccgcatcgtgtgcgtgctcgattgcgatccgacgtttctctcgattgccgaactcggcaaccagtaccgggcgctaagcgccaaatacggtgaatccatggtcacggtgctcaacaaatggacacgttacgcgcactacgaggacttgtttgaggacgcggtgaaggtgccgtatctagcacccgagatgatgcaacaagcgctttgggcggggcagtttccggacgtcgcgaccttgacgagtgagttacacgaattgaccgagcgcgtggtgacaccgctgttacctgcacgcgtcggatag

SEQ ID NO: 105 - protein, 298 aa, Bacillus  NRRL B-14911
EILRMIEQWRFQYNDSLRIVYICERERTDPLLGSLVARNVLDIFYTRSIPTKLLINQILEPPKFSNVAKIGVTDIDLANLEYLEEQAEKSGIEDELTEEHANQPAKPIDIPTSKSKKKVELPSLKLPKPEFHIHVHKPSKIRTEKIAKAIDRKIVVVISPFERSGSTFVSHQLAYQIAERKIGITYFENPFKRPYTYDRFGGHLLVPNFKSLYTSQPNANIDIDRKWTVEGVQIQALNPILEMPYEEKDISIEKFLRLFLSAGDTPILIVDIGADRQRPIYDELLSIASHVLVVMDCD

SEQ ID NO: 106 - protein, 132 aa, Leifsonia xyli
LDETRPRIIVRPKTVDDSGFVVKVEGGSEGPVYRVLGAKPERWVAQTDFQNDEAIGYLAARLAKLGVEDQLVRVGAVAGSTVVIGRENGVVFDWEPTLTSAAELISSPRGTDARIGVNARPTRAQRREDYFD

SEQ ID NO: 107 - protein, 84 aa, Bordetella avium
VPAEQASEALAQGRADVVLADRVDTAPMGPYWVGSGYSGQPKAVIRSDTPLRQWSEVAGKRVCMAQSNNRAEALARRYGATVQT

SEQ ID NO: 108 - protein, 65 aa, Azoarcus  EbN1
VLNLANGNPIITETNTLQAEIEGPHYRPAPVFRSVDRWLTVAPGKSVPVSPETAAAVRERLLGVL

SEQ ID NO: 109 - protein, 97 aa, Xylella fastidiosa
PDWRVAWAMRYGAPALTKALDALQAQQVRRIVILPLYPQYSTTTTASVQDVVEAWCKRTPQVQVECIQDYAEDPAWVAAVAASIRRHWQAHGRSEKL

SEQ ID NO: 110 - protein, 405 aa, Artificial
  Alicyclobacillus acidocaldarius mutated SEQ ID NO 103
MLYLAFPADLRERYAESTWLVYDKQVLETSFAPGDILLLSSWVVPHRAEQLQVIHRARQEGARVIFVGSKEDETDEWKRQLCALGVYDFAFFGDEVVLSVLDDLIEHPRTPLDVRAYVDETVWHLAREDPVVVEVETPKADVDEPTQDEAPFRPRWRRPRWGKPSPPAPERLQVVQPRLVVVLGLWPRAGVTTITYLLAQLFAKQLPTRSVACIEHPRPWPRMWDYFQLDARMPAENYRHWTADGVGQEIEVDGVDLVPLPPGWIGSADYGQPMVQYIFRHMRKPVTIVDVGAQAPSEMLLGVADRIVCVLDCDPTFLSIAELGNQYRALSAKYGESMVTVLNKWTRYAHYEDLFEDAVKVPYLAPEMMQQALWAGQFPDVATLTSELHELTERVVTPLLPARVG

SEQ ID NO: 111 - protein, 405 aa, Artificial
  Alicyclobacillus acidocaldarius mutated SEQ ID NO 103
MLYLAFPADLRERYAESTWLVYDKQVLETSFAPGDILLLSSWVVPHRAEQLQVIHRARQEGARVIFVGSKEDETDEWKRQLCALGVYDFAFFGDEVVLSVLDDLIEHPRTPLDVRAYVDETVWHLAREDPVVVEVETPKADVDEPTQDEAPFRPRWRRPRWGKPSPPAPERLQVVQPRLVVVLGLWPRAGVTTITYLLAQLFAKQLPTRSVACIEHPRPWPRMWDYFQLDARMPAENYRHWTADGVGQEIEVDGVDLVPLPPGWIGSADYGQPMVQYIFRHMRKPVTLVDVGAQAPSEMLLGVADRIVCVLDCDPTFLSIAEIGNQYRALSAKYGESMVTVLNKWTRYAHYEDLFEDAVKVPYLAPEMMQQALWAGQFPDVATLTSELHELTERVVTPLLPARVG

SEQ ID NO: 112 - protein, 405 aa, Artificial
  Alicyclobacillus acidocaldarius mutated SEQ ID NO 103
MLYLAFPADLRERYAESTWLVYDKQVLETSFAPGDILLLSSWVVPHRAEQLQVIHRARQEGARVIFVGSKEDETDEWKRQLCALGVYDFAFFGDEVVLSVLDDLIEHPRTPLDVRAYVDETVWHLAREDPVVVEVETPKADVDEPTQDEAPFRPRWRRPRWGKPSPPAPERLQVVQPRLVVVLGLWPRAGVTTITYLLAQLFAKQLPTRSVACIEHPRPWPRMWDYFQLDARMPAENYRHWTADGVGQEIEVDGVDLVPLPPGWIGSADYGQPMVQYIFRHMRKPVTLVDVGAQAPSEMLLGIADRIVCVLDCDPTFLSIAELGNQYRALSAKYGESMVTVLNKWTRYAHYEDLFEDAVKVPYLAPEMMQQALWAGQFPDVATLTSELHELTERVVTPLLPARVG

SEQ ID NO: 113 - protein, 405 aa, Artificial
  Alicyclobacillus acidocaldarius mutated SEQ ID NO 103
MLYLAFPADLRERYAESTWLVYDKQVLETSFAPGDILLLSSWVVPHRAEQLQVIHRARQEGARVIFVGSKEDETDEWKRQLCALGVYDFAFFGDEVVLSVLDDLIEHPRTPLDVRAYVDETVWHLAREDPVVVEVETPKADVDEPTQDEAPFRPRWRRPRWGKPSPPAPERLQVVQPRLVVVLGLWPRAGVTTITYLLAQLFAKQLPTRSVACIEHPRPWPRMWDYFQLDARMPAENYRHWTADGVGQELEVDGVDLVPLPPGWIGSADYGQPMVQYIFRHMRKPVTLVDVGAQAPSEMLLGVADRIVCVLDCDPTFLSIAELGNQYRALSAKYGESMVTVLNKWTRYAHYEDLFEDAVKVPYLAPEMMQQALWAGQFPDVATLTSELHELTERVVTPLLPARVG

SEQ ID NO: 114 - protein, 405 aa, Artificial
  Alicyclobacillus acidocaldarius mutated SEQ ID NO 103
MLYLAFPADLRERYAESTWLVYDKQVLETSFAPGDILLLSSWVVPHRAEQLQVIHRARQEGARVIFVGSKEDETDEWKRQLCALGVYDFAFFGDEVVLSVLDDLIEHPRTPLDVRAYVDETVWHLAREDPVVVEVETPKADVDEPTQDEAPFRPRWRRPRWGKPSPPAPERLQVVQPRLVVVLGLWPRAGVTTITYLLAQLFAKQLPTRSVACIEHPRPWPRMWDYFQLDARMPAENYRHWTADGVGQEIEVDGVDLVPLPPGWIGSADYGQPMVQYIFRHMRKPVTLVDVGAQAPSEMLLGVADRIVCVLDCDPTFLSIAELGNQYRALSAKYGESMVTVLNKWTRYAHYEDLFEDAVKVPYLAPEMMQQALWAGQFPDVATLTSELHELTERVVTPILPARVG

SEQ ID NO: 115 - DNA, 1218 bp, Artificial
  Alicyclobacillus acidocaldarius mutated SEQ ID NO 104
atgctttatctcgcgtttccggcggacctgcgcgagcgttacgcggaaagcacatggctcgtctacgacaagcaagtgcttgagacgtcgtttgcgccaggggacatcctgctcctctcctcgtgggtggttccacatcgtgcggaacaactccaggtgatccatcgagcgcgacaagaaggtgcgcgcgtgatctttgtcggctcgaaagaggacgaaaccgacgagtggaagcggcagttgtgtgcgcttggtgtgtatgacttcgcgtttttcggagatgaagtcgtacttagcgtgctcgacgacctcattgaacatccgcggacaccgctcgacgtgcgcgcatacgtggacgagacggtgtggcacttggcacgggaagacccggtggtggttgaggtcgagacccccaaagcggatgtggacgagcctacgcaggatgaagcgccctttcgtccacgctggcggcgtccgcgatggggcaagccgagtccgcctgcacccgaacggttgcaggttgtgcagccacggcttgtcgtggtccttggcctgtggccgcgcgcaggggtcacgacgatcacgtacctgctcgcgcagctcttcgcgaaacagctgcccacgcgctctgtggcctgtatcgagcatcccaggccttggccgcggatgtgggactactttcagctggatgcacggatgccggccgagaactatcggcactggacggcggacggtgtgggacaagaaatcgaggtggatggggtggatttggtgcctctgccgcctggttggattgggagtgcggattacggccagcccatggtgcagtacatcttccggcacatgcgaaagccggtgacgattgtcgacgtgggggcacaagcgccaagcgagatgcttttaggcgtggcggaccgcatcgtgtgcgtgctcgattgcgatccgacgtttctctcgattgccgaactcggcaaccagtaccgggcgctaagcgccaaatacggtgaatccatggtcacggtgctcaacaaatggacacgttacgcgcactacgaggacttgtttgaggacgcggtgaaggtgccgtatctagcacccgagatgatgcaacaagcgctttgggcggggcagtttccggacgtcgcgaccttgacgagtgagttacacgaattgaccgagcgcgtggtgacaccgctgttacctgcacgcgtcggatag

SEQ ID NO: 116 - DNA, 1218 bp, Artificial
  Alicyclobacillus acidocaldarius mutated SEQ ID NO 104
atgctttatctcgcgtttccggcggacctgcgcgagcgttacgcggaaagcacatggctcgtctacgacaagcaagtgcttgagacgtcgtttgcgccaggggacatcctgctcctctcctcgtgggtggttccacatcgtgcggaacaactccaggtgatccatcgagcgcgacaagaaggtgcgcgcgtgatctttgtcggctcgaaagaggacgaaaccgacgagtggaagcggcagttgtgtgcgcttggtgtgtatgacttcgcgtttttcggagatgaagtcgtacttagcgtgctcgacgacctcattgaacatccgcggacaccgctcgacgtgcgcgcatacgtggacgagacggtgtggcacttggcacgggaagacccggtggtggttgaggtcgagacccccaaagcggatgtggacgagcctacgcaggatgaagcgccctttcgtccacgctggcggcgtccgcgatggggcaagccgagtccgcctgcacccgaacggttgcaggttgtgcagccacggcttgtcgtggtccttggcctgtggccgcgcgcaggggtcacgacgatcacgtacctgctcgcgcagctcttcgcgaaacagctgcccacgcgctctgtggcctgtatcgagcatcccaggccttggccgcggatgtgggactactttcagctggatgcacggatgccggccgagaactatcggcactggacggcggacggtgtgggacaagaaatcgaggtggatggggtggatttggtgcctctgccgcctggttggattgggagtgcggattacggccagcccatggtgcagtacatcttccggcacatgcgaaagccggtgacgctcgtcgacgtgggggcacaagcgccaagcgagatgcttttaggcgtggcggaccgcatcgtgtgcgtgctcgattgcgatccgacgtttctctcgattgccgaaattggcaaccagtaccgggcgctaagcgccaaatacggtgaatccatggtcacggtgctcaacaaatggacacgttacgcgcactacgaggacttgtttgaggacgcggtgaaggtgccgtatctagcacccgagatgatgcaacaagcgctttgggcggggcagtttccggacgtcgcgaccttgacgagtgagttacacgaattgaccgagcgcgtggtgacaccgctgttacctgcacgcgtcggatag

SEQ ID NO: 117 - DNA, 1218 bp, Artificial
  Alicyclobacillus acidocaldarius mutated SEQ ID NO 104
atgctttatctcgcgtttccggcggacctgcgcgagcgttacgcggaaagcacatggctcgtctacgacaagcaagtgcttgagacgtcgtttgcgccaggggacatcctgctcctctcctcgtgggtggttccacatcgtgcggaacaactccaggtgatccatcgagcgcgacaagaaggtgcgcgcgtgatctttgtcggctcgaaagaggacgaaaccgacgagtggaagcggcagttgtgtgcgcttggtgtgtatgacttcgcgtttttcggagatgaagtcgtacttagcgtgctcgacgacctcattgaacatccgcggacaccgctcgacgtgcgcgcatacgtggacgagacggtgtggcacttggcacgggaagacccggtggtggttgaggtcgagacccccaaagcggatgtggacgagcctacgcaggatgaagcgccctttcgtccacgctggcggcgtccgcgatggggcaagccgagtccgcctgcacccgaacggttgcaggttgtgcagccacggcttgtcgtggtccttggcctgtggccgcgcgcaggggtcacgacgatcacgtacctgctcgcgcagctcttcgcgaaacagctgcccacgcgctctgtggcctgtatcgagcatcccaggccttggccgcggatgtgggactactttcagctggatgcacggatgccggccgagaactatcggcactggacggcggacggtgtgggacaagaaatcgaggtggatggggtggatttggtgcctctgccgcctggttggattgggagtgcggattacggccagcccatggtgcagtacatcttccggcacatgcgaaagccggtgacgctcgtcgacgtgggggcacaagcgccaagcgagatgcttttaggcattgcggaccgcatcgtgtgcgtgctcgattgcgatccgacgtttctctcgattgccgaactcggcaaccagtaccgggcgctaagcgccaaatacggtgaatccatggtcacggtgctcaacaaatggacacgttacgcgcactacgaggacttgtttgaggacgcggtgaaggtgccgtatctagcacccgagatgatgcaacaagcgctttgggcggggcagtttccggacgtcgcgaccttgacgagtgagttacacgaattgaccgagcgcgtggtgacaccgctgttacctgcacgcgtcggatag

SEQ ID NO: 118 - DNA, 1218 bp, Artificial
  Alicyclobacillus acidocaldarius mutated SEQ ID NO 104
atgctttatctcgcgtttccggcggacctgcgcgagcgttacgcggaaagcacatggctcgtctacgacaagcaagtgcttgagacgtcgtttgcgccaggggacatcctgctcctctcctcgtgggtggttccacatcgtgcggaacaactccaggtgatccatcgagcgcgacaagaaggtgcgcgcgtgatctttgtcggctcgaaagaggacgaaaccgacgagtggaagcggcagttgtgtgcgcttggtgtgtatgacttcgcgtttttcggagatgaagtcgtacttagcgtgctcgacgacctcattgaacatccgcggacaccgctcgacgtgcgcgcatacgtggacgagacggtgtggcacttggcacgggaagacccggtggtggttgaggtcgagacccccaaagcggatgtggacgagcctacgcaggatgaagcgccctttcgtccacgctggcggcgtccgcgatggggcaagccgagtccgcctgcacccgaacggttgcaggttgtgcagccacggcttgtcgtggtccttggcctgtggccgcgcgcaggggtcacgacgatcacgtacctgctcgcgcagctcttcgcgaaacagctgcccacgcgctctgtggcctgtatcgagcatcccaggccttggccgcggatgtgggactactttcagctggatgcacggatgccggccgagaactatcggcactggacggcggacggtgtgggacaagaattagaggtggatggggtggatttggtgcctctgccgcctggttggattgggagtgcggattacggccagcccatggtgcagtacatcttccggcacatgcgaaagccggtgacgctcgtcgacgtgggggcacaagcgccaagcgagatgcttttaggcgtggcggaccgcatcgtgtgcgtgctcgattgcgatccgacgtttctctcgattgccgaactcggcaaccagtaccgggcgctaagcgccaaatacggtgaatccatggtcacggtgctcaacaaatggacacgttacgcgcactacgaggacttgtttgaggacgcggtgaaggtgccgtatctagcacccgagatgatgcaacaagcgctttgggcggggcagtttccggacgtcgcgaccttgacgagtgagttacacgaattgaccgagcgcgtggtgacaccgctgttacctgcacgcgtcggatag

SEQ ID NO: 119 - DNA, 1218 bp, Artificial
  Alicyclobacillus acidocaldarius mutated SEQ ID NO 104
atgctttatctcgcgtttccggcggacctgcgcgagcgttacgcggaaagcacatggctcgtctacgacaagcaagtgcttgagacgtcgtttgcgccaggggacatcctgctcctctcctcgtgggtggttccacatcgtgcggaacaactccaggtgatccatcgagcgcgacaagaaggtgcgcgcgtgatctttgtcggctcgaaagaggacgaaaccgacgagtggaagcggcagttgtgtgcgcttggtgtgtatgacttcgcgtttttcggagatgaagtcgtacttagcgtgctcgacgacctcattgaacatccgcggacaccgctcgacgtgcgcgcatacgtggacgagacggtgtggcacttggcacgggaagacccggtggtggttgaggtcgagacccccaaagcggatgtggacgagcctacgcaggatgaagcgccctttcgtccacgctggcggcgtccgcgatggggcaagccgagtccgcctgcacccgaacggttgcaggttgtgcagccacggcttgtcgtggtccttggcctgtggccgcgcgcaggggtcacgacgatcacgtacctgctcgcgcagctcttcgcgaaacagctgcccacgcgctctgtggcctgtatcgagcatcccaggccttggccgcggatgtgggactactttcagctggatgcacggatgccggccgagaactatcggcactggacggcggacggtgtgggacaagaaatcgaggtggatggggtggatttggtgcctctgccgcctggttggattgggagtgcggattacggccagcccatggtgcagtacatcttccggcacatgcgaaagccggtgacgctcgtcgacgtgggggcacaagcgccaagcgagatgcttttaggcgtggcggaccgcatcgtgtgcgtgctcgattgcgatccgacgtttctctcgattgccgaactcggcaaccagtaccgggcgctaagcgccaaatacggtgaatccatggtcacggtgctcaacaaatggacacgttacgcgcactacgaggacttgtttgaggacgcggtgaaggtgccgtatctagcacccgagatgatgcaacaagcgctttgggcggggcagtttccggacgtcgcgaccttgacgagtgagttacacgaattgaccgagcgcgtggtgacaccgattttacctgcacgcgtcggatag

SEQ ID NO: 120 - protein, 451 aa, Alicyclobacillus acidocaldarius
MKRIGLFRIPTEPKDVFPWLVKRLVLSLGLGGVLGYLALLVVALSLLGFLVGDYQANGRGTVENGNIVLSNATQARETALKNTYQQVADEWQQGLSASQIAQVEQQQVDLPAAVLMGIGKMINNLNPPNAQEYYDYLAPVYTWHTYIDVTITYQTVCSKNGCHVVTHEVDTPVTMLQTANTWDGTLVDTYKWVTSMSGTTQNGVYTKKIELASSKRTYDWSRVWNLFAHIPTAQHTHIKESQEDEDILAGFIGAIDYTISDPEVQKMVTSVLFPDGVVVTDLPHVSTALPSGNAIQNILHYKAEIEAAARMFNIPAVLIAGVMYQESGGNQLDPTGHVLTSSAGAMGLMQVEPSTAAGLTINGVPVGSNWYADLSNPTTNILLGAELLSELYHEFNENVDETLSAYNAGPGAEEEALSQGYTVAQNSQTLEYVAAITQQWIPALEPYFGSL

SEQ ID NO: 121 - DNA, 1356 bp, Alicyclobacillus acidocaldarius
atgaagcgcatcggactttttcgcatcccaaccgagccgaaagacgtgtttccgtggctggtgaagcgccttgtcctatcgcttggactcggcggcgtactcggttatctggcgctccttgttgtcgcgttgtcgctgttggggtttctcgtgggagattatcaggcgaatgggaggggcacggtggaaaacgggaacatcgtgctatccaacgccacgcaggcaagggaaacagcgctcaaaaacacgtatcaacaggttgccgatgagtggcaacaaggactctccgcatcgcaaattgcgcaggttgagcagcaacaggttgatttgccggccgcggtgctcatgggcatcggcaaaatgatcaataacctcaacccgccgaacgcccaggaatactacgactacctggcgcctgtgtacacgtggcacacctacatcgacgtgaccatcacgtaccagacggtgtgcagcaagaacggctgtcatgtggttacccatgaagtggacacgcccgtcacgatgctccaaacggccaatacgtgggacgggacgctcgtggacacgtacaagtgggtgacgtccatgtcaggcacgacccaaaatggcgtgtatacgaagaagattgagcttgcgtcatccaagcggacctatgactggtcgcgcgtatggaatctgttcgcgcacatcccgacggcgcaacacacgcacatcaaggagtcccaagaagatgaggacatcttagcaggtttcatcggggccatcgactacacgatctcagatccagaagtgcagaagatggtcacgtctgtgctgtttccggacggcgttgtggtgaccgatcttccgcacgtatctacagcattgccaagcgggaacgcgattcaaaacatcctgcactacaaggcagaaattgaggccgcggcgcgaatgttcaacatcccggccgtgctcatcgcgggcgtcatgtaccaggaatcaggcgggaatcagttggatccaaccggacacgtgttgacgtcgagtgccggggcgatggggctgatgcaagtcgaaccgagtacggcagcagggctcacgataaacggtgtacctgtcgggtcaaactggtacgcggatttgtccaaccctacgaccaacattctgcttggcgcggagctcttatcggagctctatcacgagttcaacgagaacgtggacgagacattatccgcctacaacgccggtcctggtgctgaagaagaggcgctatcacagggctacacggtggcgcagaacagccagacactcgagtacgtcgcggcgatcacgcagcagtggatcccggctttggaaccgtacttcggcagtctctaa

SEQ ID NO: 122 - protein, 144 aa, Ochrobactrum anthropi
IAPLPGLAQIAVMGRAVAVHPHGAHIEEASQRFGIPAAWIIAVMQVESAGNMHAISSAGAMGLMQVMPSTWAELRIRHALGRDPFEPRDNILAGTAYLREMWDRYGNVAAMLAAYNAGPGRYDEYRATARPLPAETRAYVAALT

SEQ ID NO: 123 - protein, 125 aa, Acidiphi1ium cryptum
IEQASARFDVPAKWIRAVMHVESGGHEYMNGHLTVSSAGAMGLMQLEPETYQEMAARYGLGPDPFNPLDNIMAGTAYIHQMYEIYGSPGFLAAYNAGPGRLDDYLDYRQPLPAQTRHYVAMIAPQ

SEQ ID NO: 124 - protein, 123 aa, Mesorhizobium  BNC1
YAANIHQASRRFGIPAAWIRAVLRTESAGDVHAISSEGAMGLMQVMPDTWAELRVRYRLGLDPFDPRDNIIAGTAYLREMFDRYGNVGAMLAAYNAGPDRYDEYLSKGRALPAETRAYVAALT

SEQ ID NO: 125 - protein, 118 aa, Bacillus SPBc2
GIVTSTTSSGGTPSSTGGSYSGKYSSYINSAASKYNVDPALIAAVIQQESGFNAKARSGVGAMGLMQLMPATAKSLGVNNAYDPYQNVMGGTKYLAQQLEKFGGNVEKALAAYNAGPG

SEQ ID NO: 126 - protein, 122 aa, Paracoccus denitrificans
YAAQVTEASQRFGIPTTWIMAVMRTESAGDLRAVSSAGAMGLMQVMPDTWAGLRIRHGLGHDPFEPRDNILAGAAYLREMWDRYGNVAAMLAAYNAGPARYDGYRLADRPLPAETRAYVAAL

SEQ ID NO: 127 - protein, 451 aa, Artificial
  Alicyclobacillus acidocaldarius mutated SEQ ID NO 120
MKRIGIFRIPTEPKDVFPWLVKRLVLSLGLGGVLGYLALLVVALSLLGFLVGDYQANGRGTVENGNIVLSNATQARETALKNTYQQVADEWQQGLSASQIAQVEQQQVDLPAAVLMGIGKMINNLNPPNAQEYYDYLAPVYTWHTYIDVTITYQTVCSKNGCHVVTHEVDTPVTMLQTANTWDGTLVDTYKWVTSMSGTTQNGVYTKKIELASSKRTYDWSRVWNLFAHIPTAQHTHIKESQEDEDILAGFIGAIDYTISDPEVQKMVTSVLFPDGVVVTDLPHVSTALPSGNAIQNILHYKAEIEAAARMFNIPAVLIAGVMYQESGGNQLDPTGHVLTSSAGAMGLMQVEPSTAAGLTINGVPVGSNWYADLSNPTTNILLGAELLSELYHEFNENVDETLSAYNAGPGAEEEALSQGYTVAQNSQTLEYVAAITQQWIPALEPYFGSL

SEQ ID NO: 128 - protein, 451 aa, Artificial
  Alicyclobacillus acidocaldarius mutated SEQ ID NO 120
MKRIGLFRIPTEPKDVFPWLVKRLVLSLGLGGVLGYLALLVVALSLLGFLVGDYQANGRGTVENGNIVLSNATQARETALKNTYQQVADEWQQGLSASQIAQVEQQQVDLPAAVLMGIGKMINNLNPPNAQEYYDYIAPVYTWHTYIDVTITYQTVCSKNGCHVVTHEVDTPVTMLQTANTWDGTLVDTYKWVTSMSGTTQNGVYTKKIELASSKRTYDWSRVWNLFAHIPTAQHTHIKESQEDEDILAGFIGAIDYTISDPEVQKMVTSVLFPDGVVVTDLPHVSTALPSGNAIQNILHYKAEIEAAARMFNIPAVLIAGVMYQESGGNQLDPTGHVLTSSAGAMGLMQVEPSTAAGLTINGVPVGSNWYADLSNPTTNILLGAELLSELYHEFNENVDETLSAYNAGPGAEEEALSQGYTVAQNSQTLEYVAAITQQWIPALEPYFGSL

SEQ ID NO: 129 - protein, 451 aa, Artificial
  Alicyclobacillus acidocaldarius mutated SEQ ID NO 120
MKRIGLFRIPTEPKDVFPWLVKRLVLSLGLGGVLGYLALLVVALSLLGFLVGDYQANGRGTVENGNIVLSNATQARETALKNTYQQVADEWQQGLSASQIAQVEQQQVDLPAAVLMGIGKMINNLNPPNAQEYYDYLAPVYTWHTYIDVTITYQTVCSKNGCHVVTHEVDTPVTMLQTANTWDGTLVDTYKWVTSMSGTTQNGVYTKKIELASSKRTYDWSRVWNLFAHIPTAQHTHIKESQEDEDILAGFIGAIDYTISDPEVQKMVTSVLFPDGVVVTDLPHVSTALPSGNAIQNILHYKAEIEAAARMFNIPAVLIAGVMYQESGGNQLDPTGHVLTSSAGAMGLMQVEPSTAAGLTINGVPVGSNWYADLSNPTTNILLGAELLSELYHEFNENVDETLSAYNAGPGAEEEALSQGYTVAQNSQTLEYVAAITQQWIPAIEPYFGSL

SEQ ID NO: 130 - protein, 451 aa, Artificial
  Alicyclobacillus acidocaldarius mutated SEQ ID NO 120
MKRIGLFRIPTEPKDVFPWLVKRLVLSLGLGGVLGYLALLVVALSLLGFLVGDYQANGRGTVENGNIVLSNATQARETALKNTYQQVADEWQQGLSASQIAQVEQQQVDLPAAVLMGIGKMINNLNPPNAQEYYDYLAPVYTWHTYIDVTITYQTVCSKNGCHVVTHEVDTPVTMLQTANTWDGTLVDTYKWVTSMSGTTQNGVYTKKIELASSKRTYDWSRVWNLFAHIPTANHTHIKESQEDEDILAGFIGAIDYTISDPEVQKMVTSVLFPDGVVVTDLPHVSTALPSGNAIQNILHYKAEIEAAARMFNIPAVLIAGVMYQESGGNQLDPTGHVLTSSAGAMGLMQVEPSTAAGLTINGVPVGSNWYADLSNPTTNILLGAELLSELYHEFNENVDETLSAYNAGPGAEEEALSQGYTVAQNSQTLEYVAAITQQWIPALEPYFGSL

SEQ ID NO: 131 - protein, 451 aa, Artificial
  Alicyclobacillus acidocaldarius mutated SEQ ID NO 120
MKRIGLFRIPTEPKDVFPWLVKRLVLSLGLGGVLGYLALLVVALSLLGFLVGDYQANGRGTVENGNLVLSNATQARETALKNTYQQVADEWQQGLSASQIAQVEQQQVDLPAAVLMGIGKMINNLNPPNAQEYYDYLAPVYTWHTYIDVTITYQTVCSKNGCHVVTHEVDTPVTMLQTANTWDGTLVDTYKWVTSMSGTTQNGVYTKKIELASSKRTYDWSRVWNLFAHIPTAQHTHIKESQEDEDILAGFIGAIDYTISDPEVQKMVTSVLFPDGVVVTDLPHVSTALPSGNAIQNILHYKAEIEAAARMFNIPAVLIAGVMYQESGGNQLDPTGHVLTSSAGAMGLMQVEPSTAAGLTINGVPVGSNWYADLSNPTTNILLGAELLSELYHEFNENVDETLSAYNAGPGAEEEALSQGYTVAQNSQTLEYVAAITQQWIPALEPYFGSL

SEQ ID NO: 132 - DNA, 1356 bp, Artificial
  Alicyclobacillus acidocaldarius mutated SEQ ID NO 121
atgaagcgcatcggaatttttcgcatcccaaccgagccgaaagacgtgtttccgtggctggtgaagcgccttgtcctatcgcttggactcggcggcgtactcggttatctggcgctccttgttgtcgcgttgtcgctgttggggtttctcgtgggagattatcaggcgaatgggaggggcacggtggaaaacgggaacatcgtgctatccaacgccacgcaggcaagggaaacagcgctcaaaaacacgtatcaacaggttgccgatgagtggcaacaaggactctccgcatcgcaaattgcgcaggttgagcagcaacaggttgatttgccggccgcggtgctcatgggcatcggcaaaatgatcaataacctcaacccgccgaacgcccaggaatactacgactacctggcgcctgtgtacacgtggcacacctacatcgacgtgaccatcacgtaccagacggtgtgcagcaagaacggctgtcatgtggttacccatgaagtggacacgcccgtcacgatgctccaaacggccaatacgtgggacgggacgctcgtggacacgtacaagtgggtgacgtccatgtcaggcacgacccaaaatggcgtgtatacgaagaagattgagcttgcgtcatccaagcggacctatgactggtcgcgcgtatggaatctgttcgcgcacatcccgacggcgcaacacacgcacatcaaggagtcccaagaagatgaggacatcttagcaggtttcatcggggccatcgactacacgatctcagatccagaagtgcagaagatggtcacgtctgtgctgtttccggacggcgttgtggtgaccgatcttccgcacgtatctacagcattgccaagcgggaacgcgattcaaaacatcctgcactacaaggcagaaattgaggccgcggcgcgaatgttcaacatcccggccgtgctcatcgcgggcgtcatgtaccaggaatcaggcgggaatcagttggatccaaccggacacgtgttgacgtcgagtgccggggcgatggggctgatgcaagtcgaaccgagtacggcagcagggctcacgataaacggtgtacctgtcgggtcaaactggtacgcggatttgtccaaccctacgaccaacattctgcttggcgcggagctcttatcggagctctatcacgagttcaacgagaacgtggacgagacattatccgcctacaacgccggtcctggtgctgaagaagaggcgctatcacagggctacacggtggcgcagaacagccagacactcgagtacgtcgcggcgatcacgcagcagtggatcccggctttggaaccgtacttcggcagtctctaa

SEQ ID NO: 133 - DNA, 1356 bp, Artificial
  Alicyclobacillus acidocaldarius mutated SEQ ID NO 121
atgaagcgcatcggactttttcgcatcccaaccgagccgaaagacgtgtttccgtggctggtgaagcgccttgtcctatcgcttggactcggcggcgtactcggttatctggcgctccttgttgtcgcgttgtcgctgttggggtttctcgtgggagattatcaggcgaatgggaggggcacggtggaaaacgggaacatcgtgctatccaacgccacgcaggcaagggaaacagcgctcaaaaacacgtatcaacaggttgccgatgagtggcaacaaggactctccgcatcgcaaattgcgcaggttgagcagcaacaggttgatttgccggccgcggtgctcatgggcatcggcaaaatgatcaataacctcaacccgccgaacgcccaggaatactacgactacattgcgcctgtgtacacgtggcacacctacatcgacgtgaccatcacgtaccagacggtgtgcagcaagaacggctgtcatgtggttacccatgaagtggacacgcccgtcacgatgctccaaacggccaatacgtgggacgggacgctcgtggacacgtacaagtgggtgacgtccatgtcaggcacgacccaaaatggcgtgtatacgaagaagattgagcttgcgtcatccaagcggacctatgactggtcgcgcgtatggaatctgttcgcgcacatcccgacggcgcaacacacgcacatcaaggagtcccaagaagatgaggacatcttagcaggtttcatcggggccatcgactacacgatctcagatccagaagtgcagaagatggtcacgtctgtgctgtttccggacggcgttgtggtgaccgatcttccgcacgtatctacagcattgccaagcgggaacgcgattcaaaacatcctgcactacaaggcagaaattgaggccgcggcgcgaatgttcaacatcccggccgtgctcatcgcgggcgtcatgtaccaggaatcaggcgggaatcagttggatccaaccggacacgtgttgacgtcgagtgccggggcgatggggctgatgcaagtcgaaccgagtacggcagcagggctcacgataaacggtgtacctgtcgggtcaaactggtacgcggatttgtccaaccctacgaccaacattctgcttggcgcggagctcttatcggagctctatcacgagttcaacgagaacgtggacgagacattatccgcctacaacgccggtcctggtgctgaagaagaggcgctatcacagggctacacggtggcgcagaacagccagacactcgagtacgtcgcggcgatcacgcagcagtggatcccggctttggaaccgtacttcggcagtctctaa

SEQ ID NO: 134 - DNA, 1356 bp, Artificial
  Alicyclobacillus acidocaldarius mutated SEQ ID NO 121
atgaagcgcatcggactttttcgcatcccaaccgagccgaaagacgtgtttccgtggctggtgaagcgccttgtcctatcgcttggactcggcggcgtactcggttatctggcgctccttgttgtcgcgttgtcgctgttggggtttctcgtgggagattatcaggcgaatgggaggggcacggtggaaaacgggaacatcgtgctatccaacgccacgcaggcaagggaaacagcgctcaaaaacacgtatcaacaggttgccgatgagtggcaacaaggactctccgcatcgcaaattgcgcaggttgagcagcaacaggttgatttgccggccgcggtgctcatgggcatcggcaaaatgatcaataacctcaacccgccgaacgcccaggaatactacgactacctggcgcctgtgtacacgtggcacacctacatcgacgtgaccatcacgtaccagacggtgtgcagcaagaacggctgtcatgtggttacccatgaagtggacacgcccgtcacgatgctccaaacggccaatacgtgggacgggacgctcgtggacacgtacaagtgggtgacgtccatgtcaggcacgacccaaaatggcgtgtatacgaagaagattgagcttgcgtcatccaagcggacctatgactggtcgcgcgtatggaatctgttcgcgcacatcccgacggcgcaacacacgcacatcaaggagtcccaagaagatgaggacatcttagcaggtttcatcggggccatcgactacacgatctcagatccagaagtgcagaagatggtcacgtctgtgctgtttccggacggcgttgtggtgaccgatcttccgcacgtatctacagcattgccaagcgggaacgcgattcaaaacatcctgcactacaaggcagaaattgaggccgcggcgcgaatgttcaacatcccggccgtgctcatcgcgggcgtcatgtaccaggaatcaggcgggaatcagttggatccaaccggacacgtgttgacgtcgagtgccggggcgatggggctgatgcaagtcgaaccgagtacggcagcagggctcacgataaacggtgtacctgtcgggtcaaactggtacgcggatttgtccaaccctacgaccaacattctgcttggcgcggagctcttatcggagctctatcacgagttcaacgagaacgtggacgagacattatccgcctacaacgccggtcctggtgctgaagaagaggcgctatcacagggctacacggtggcgcagaacagccagacactcgagtacgtcgcggcgatcacgcagcagtggatcccggctattgaaccgtacttcggcagtctctaa

SEQ ID NO: 135 - DNA, 1356 bp, Artificial
  Alicyclobacillus acidocaldarius mutated SEQ ID NO 121
atgaagcgcatcggactttttcgcatcccaaccgagccgaaagacgtgtttccgtggctggtgaagcgccttgtcctatcgcttggactcggcggcgtactcggttatctggcgctccttgttgtcgcgttgtcgctgttggggtttctcgtgggagattatcaggcgaatgggaggggcacggtggaaaacgggaacatcgtgctatccaacgccacgcaggcaagggaaacagcgctcaaaaacacgtatcaacaggttgccgatgagtggcaacaaggactctccgcatcgcaaattgcgcaggttgagcagcaacaggttgatttgccggccgcggtgctcatgggcatcggcaaaatgatcaataacctcaacccgccgaacgcccaggaatactacgactacctggcgcctgtgtacacgtggcacacctacatcgacgtgaccatcacgtaccagacggtgtgcagcaagaacggctgtcatgtggttacccatgaagtggacacgcccgtcacgatgctccaaacggccaatacgtgggacgggacgctcgtggacacgtacaagtgggtgacgtccatgtcaggcacgacccaaaatggcgtgtatacgaagaagattgagcttgcgtcatccaagcggacctatgactggtcgcgcgtatggaatctgttcgcgcacatcccgacggcgaatcacacgcacatcaaggagtcccaagaagatgaggacatcttagcaggtttcatcggggccatcgactacacgatctcagatccagaagtgcagaagatggtcacgtctgtgctgtttccggacggcgttgtggtgaccgatcttccgcacgtatctacagcattgccaagcgggaacgcgattcaaaacatcctgcactacaaggcagaaattgaggccgcggcgcgaatgttcaacatcccggccgtgctcatcgcgggcgtcatgtaccaggaatcaggcgggaatcagttggatccaaccggacacgtgttgacgtcgagtgccggggcgatggggctgatgcaagtcgaaccgagtacggcagcagggctcacgataaacggtgtacctgtcgggtcaaactggtacgcggatttgtccaaccctacgaccaacattctgcttggcgcggagctcttatcggagctctatcacgagttcaacgagaacgtggacgagacattatccgcctacaacgccggtcctggtgctgaagaagaggcgctatcacagggctacacggtggcgcagaacagccagacactcgagtacgtcgcggcgatcacgcagcagtggatcccggctttggaaccgtacttcggcagtctctaa

SEQ ID NO: 136 - DNA, 1356 bp, Artificial
  Alicyclobacillus acidocaldarius mutated SEQ ID NO 121
atgaagcgcatcggactttttcgcatcccaaccgagccgaaagacgtgtttccgtggctggtgaagcgccttgtcctatcgcttggactcggcggcgtactcggttatctggcgctccttgttgtcgcgttgtcgctgttggggtttctcgtgggagattatcaggcgaatgggaggggcacggtggaaaacgggaacttagtgctatccaacgccacgcaggcaagggaaacagcgctcaaaaacacgtatcaacaggttgccgatgagtggcaacaaggactctccgcatcgcaaattgcgcaggttgagcagcaacaggttgatttgccggccgcggtgctcatgggcatcggcaaaatgatcaataacctcaacccgccgaacgcccaggaatactacgactacctggcgcctgtgtacacgtggcacacctacatcgacgtgaccatcacgtaccagacggtgtgcagcaagaacggctgtcatgtggttacccatgaagtggacacgcccgtcacgatgctccaaacggccaatacgtgggacgggacgctcgtggacacgtacaagtgggtgacgtccatgtcaggcacgacccaaaatggcgtgtatacgaagaagattgagcttgcgtcatccaagcggacctatgactggtcgcgcgtatggaatctgttcgcgcacatcccgacggcgcaacacacgcacatcaaggagtcccaagaagatgaggacatcttagcaggtttcatcggggccatcgactacacgatctcagatccagaagtgcagaagatggtcacgtctgtgctgtttccggacggcgttgtggtgaccgatcttccgcacgtatctacagcattgccaagcgggaacgcgattcaaaacatcctgcactacaaggcagaaattgaggccgcggcgcgaatgttcaacatcccggccgtgctcatcgcgggcgtcatgtaccaggaatcaggcgggaatcagttggatccaaccggacacgtgttgacgtcgagtgccggggcgatggggctgatgcaagtcgaaccgagtacggcagcagggctcacgataaacggtgtacctgtcgggtcaaactggtacgcggatttgtccaaccctacgaccaacattctgcttggcgcggagctcttatcggagctctatcacgagttcaacgagaacgtggacgagacattatccgcctacaacgccggtcctggtgctgaagaagaggcgctatcacagggctacacggtggcgcagaacagccagacactcgagtacgtcgcggcgatcacgcagcagtggatcccggctttggaaccgtacttcggcagtctctaa

SEQ ID NO: 137 - protein, 214 aa, Alicyclobacillus acidocaldarius
MIIVHSLTSLFESIAFVAEYGEPDADRHVKRVATYARFVGEHVLRWSPAACERLALAALVHDVGKVVIPREILRKPGPLMPAERQYVQCHTVYGRDMLVELARRYSGLDGGLFELAQQVALYHHERWDGDGYPEGLCREEIPLAARVVHLVDVIDARLSPRPYKPGQSWHQVKQALVEGMFLDFDGMLVTGLLEVESAFLELVQAQTYRQLVTI

SEQ ID NO: 138 - DNA, 645 bp, Alicyclobacillus acidocaldarius
atgatcatcgtgcattcgctgacgtcactcttcgaatccatcgcttttgtcgccgaatacggcgagcctgacgcggatcgacacgtgaagcgcgtcgccacctatgcgcgtttcgttggagagcacgtcctgcggtggtcacctgccgcatgtgagcgtctggcgctcgcagcactcgtgcatgatgtggggaaagtggtgattccgcgagaaatcctccgcaagccagggccactgatgccagcggagcggcagtacgtgcagtgtcacacggtgtacggccgtgacatgctcgtggagttggcgcgtcgctatagtgggttagacggtgggttgtttgagctcgcgcagcaggtcgcgctttatcatcacgaacgatgggatggggacgggtatccggaaggcttatgtcgcgaggagattccgcttgctgcgcgggtcgtgcatctcgtggatgtgattgacgcaagacttagtccgcgtccgtacaaaccagggcaatcgtggcaccaggtgaagcaggcgctcgtcgaagggatgttcctggattttgacgggatgctggtgacaggccttttggaggttgaatcggcctttcttgagcttgtccaagcgcaaacgtacaggcagctggtgaccatatga

SEQ ID NO: 139 - protein, 202 aa, Pseudomonas aeruginosa
AVIEALATLGDLRDNPRSRHLPRIERYVRLLAEHLAAQRAFADELTPEAVDLLSKSALLHDIGKVAVPDRVLLNPGQLDAADTALLQGHTRAGRDALASAERRLGQPSGFLRFARQIAYSHHERWDGRGFPEGLAGERIPLAARIVALADRYDELTSRHAYRPPLAHAEAVLLIQAGADSEFDPRLVEAFVAVADAFAEVAQ

SEQ ID NO: 140 - protein, 198 aa, Desulfovibrio desulfuricans
SLASLAETRDNETGAHIMRTQAYVRVLARQLRTHVRFRSVLTPEGIEQLCKSAPLHDIGKVGVPDAILRKQGPLTPQEMDQIKLHTVYGRDALRHASMRLGGSSFLQMAEELVHTHHECWDGTGYPQQLTGEQIPVAGRLMALADVYDALISRRCYKKPVPHHQAREIILKGRGTRFDPAVVDAFLRAEHDFLAIAAA

SEQ ID NO: 141 - protein, 187 aa, Shewanella  ANA-3
IIQKLGLAAEYRDNETGLHITRMSHYGRILAQYVCDSQAWCEMYFTALPMHDIGKIGIPDSILSKPGKLTDDERRQMQQHASFGAQILGDDDDPLLSLAKEIALYHHERWDGTGYPHRLAGEQIPLSARIAAIADVFDALTSDRPYKVAWSTQKAFDYIEENAGTQFDPKLTRAFIECKAQVLEVQQ

SEQ ID NO: 142 - protein, 202 aa, Pseudomonas aeruginosa
AVIEALATLGDLRDNPRSRHLPRIERYVRLLAEHLAAQRAFADELTPEAVDLLSKSALLHDIGKVAVPDRVLLNPGQLDAADTALLQGHTRAGRDALASAERRLGQPSGFLRFARQIAYSHHERWDGRGFPEGLAGERIPLAARIVALADRYDELTSRHAYRPPLAHAEAVLLIQAGAGSEFDPRLVEAFVAVADAFAEVAR

SEQ ID NO: 143 - protein, 197 aa, Geobacter lovleyi
AMAKLAEFRDEDTGGHLERVKEYCRLLAEDLNRHSPYSDLITAEFIDCIQHAAPLHDIGKVAIPDHILQKPEKLTPEEFDRMKTHTVIGADNLQLVYNNYPGNLFVGMGIEIALYHHEQWDGSGYPDGLVGKNIPLPARIMALADVYDALRSDRCYRKAMSHEQARTIILEGDGRHFDPEVVMAFLRVETIFAKTAE

SEQ ID NO: 144 - protein, 214 aa, Artificial
  Alicyclobacillus acidocaldarius mutated SEQ ID NO 137
MIIVHSLTSIFESIAFVAEYGEPDADRHVKRVATYARFVGEHVLRWSPAACERLALAALVHDVGKVVIPREILRKPGPLMPAERQYVQCHTVYGRDMLVELARRYSGLDGGLFELAQQVALYHHERWDGDGYPEGLCREEIPLAARVVHLVDVIDARLSPRPYKPGQSWHQVKQALVEGMFLDFDGMLVTGLLEVESAFLELVQAQTYRQLVTI

SEQ ID NO: 145 - protein, 214 aa, Artificial
  Alicyclobacillus acidocaldarius mutated SEQ ID NO 137
MIIVHSLTSLFESIAFVAEYGEPDADRHVKRVATYARFVGEHVLRWSPAACEKLALAALVHDVGKVVIPREILRKPGPLMPAERQYVQCHTVYGRDMLVELARRYSGLDGGLFELAQQVALYHHERWDGDGYPEGLCREEIPLAARVVHLVDVIDARLSPRPYKPGQSWHQVKQALVEGMFLDFDGMLVTGLLEVESAFLELVQAQTYRQLVTI

SEQ ID NO: 146 - protein, 214 aa, Artificial
  Alicyclobacillus acidocaldarius mutated SEQ ID NO 137
MIIVHSLTSLFESIAFVAEYGEPDADRHVKRVATYARFVGEHVLRWSPAACERLALAALVHDVGKVVIPREILRKPGPLMPAERQYVQCHTVYGRDMLVELARRYSGLDGGLFELAQQVALYHHERWDGDGYPEGLCREEIPLAARVVHLVDVIDARLSPRPYKPGQSWHQVKQALVEGMFLDFDGMLVTGLLEVESAFLELVQAQTYRQLVTL

SEQ ID NO: 147 - protein, 214 aa, Artificial
  Alicyclobacillus acidocaldarius mutated SEQ ID NO 137
MIIVHSITSLFESIAFVAEYGEPDADRHVKRVATYARFVGEHVLRWSPAACERLALAALVHDVGKVVIPREILRKPGPLMPAERQYVQCHTVYGRDMLVELARRYSGLDGGLFELAQQVALYHHERWDGDGYPEGLCREEIPLAARVVHLVDVIDARLSPRPYKPGQSWHQVKQALVEGMFLDFDGMLVTGLLEVESAFLELVQAQTYRQLVTI

SEQ ID NO: 148 - protein, 214 aa, Artificial
  Alicyclobacillus acidocaldarius mutated SEQ ID NO 137
MIIVHSLTSLFESIAFVAEYGEPDADRHVKRVATYARFVGEHVLRWSPAACERLALAALVHDVGKVVIPREILRKPGPLMPAERQYVQCHTVYGRDMLVELARRYSGLDGGLFELAQQVAIYHHERWDGDGYPEGLCREEIPLAARVVHLVDVIDARLSPRPYKPGQSWHQVKQALVEGMFLDFDGMLVTGLLEVESAFLELVQAQTYRQLVTI

SEQ ID NO: 149 - DNA, 645 bp, Artificial
  Alicyclobacillus acidocaldarius mutated SEQ ID NO 138
atgatcatcgtgcattcgctgacgtcaattttcgaatccatcgcttttgtcgccgaatacggcgagcctgacgcggatcgacacgtgaagcgcgtcgccacctatgcgcgtttcgttggagagcacgtcctgcggtggtcacctgccgcatgtgagcgtctggcgctcgcagcactcgtgcatgatgtggggaaagtggtgattccgcgagaaatcctccgcaagccagggccactgatgccagcggagcggcagtacgtgcagtgtcacacggtgtacggccgtgacatgctcgtggagttggcgcgtcgctatagtgggttagacggtgggttgtttgagctcgcgcagcaggtcgcgctttatcatcacgaacgatgggatggggacgggtatccggaaggcttatgtcgcgaggagattccgcttgctgcgcgggtcgtgcatctcgtggatgtgattgacgcaagacttagtccgcgtccgtacaaaccagggcaatcgtggcaccaggtgaagcaggcgctcgtcgaagggatgttcctggattttgacgggatgctggtgacaggccttttggaggttgaatcggcctttcttgagcttgtccaagcgcaaacgtacaggcagctggtgaccatatga

SEQ ID NO: 150 - DNA, 645 bp, Artificial
  Alicyclobacillus acidocaldarius mutated SEQ ID NO 138
atgatcatcgtgcattcgctgacgtcactcttcgaatccatcgcttttgtcgccgaatacggcgagcctgacgcggatcgacacgtgaagcgcgtcgccacctatgcgcgtttcgttggagagcacgtcctgcggtggtcacctgccgcatgtgagaaactggcgctcgcagcactcgtgcatgatgtggggaaagtggtgattccgcgagaaatcctccgcaagccagggccactgatgccagcggagcggcagtacgtgcagtgtcacacggtgtacggccgtgacatgctcgtggagttggcgcgtcgctatagtgggttagacggtgggttgtttgagctcgcgcagcaggtcgcgctttatcatcacgaacgatgggatggggacgggtatccggaaggcttatgtcgcgaggagattccgcttgctgcgcgggtcgtgcatctcgtggatgtgattgacgcaagacttagtccgcgtccgtacaaaccagggcaatcgtggcaccaggtgaagcaggcgctcgtcgaagggatgttcctggattttgacgggatgctggtgacaggccttttggaggttgaatcggcctttcttgagcttgtccaagcgcaaacgtacaggcagctggtgaccatatga

SEQ ID NO: 151 - DNA, 645 bp, Artificial
  Alicyclobacillus acidocaldarius mutated SEQ ID NO 138
atgatcatcgtgcattcgctgacgtcactcttcgaatccatcgcttttgtcgccgaatacggcgagcctgacgcggatcgacacgtgaagcgcgtcgccacctatgcgcgtttcgttggagagcacgtcctgcggtggtcacctgccgcatgtgagcgtctggcgctcgcagcactcgtgcatgatgtggggaaagtggtgattccgcgagaaatcctccgcaagccagggccactgatgccagcggagcggcagtacgtgcagtgtcacacggtgtacggccgtgacatgctcgtggagttggcgcgtcgctatagtgggttagacggtgggttgtttgagctcgcgcagcaggtcgcgctttatcatcacgaacgatgggatggggacgggtatccggaaggcttatgtcgcgaggagattccgcttgctgcgcgggtcgtgcatctcgtggatgtgattgacgcaagacttagtccgcgtccgtacaaaccagggcaatcgtggcaccaggtgaagcaggcgctcgtcgaagggatgttcctggattttgacgggatgctggtgacaggccttttggaggttgaatcggcctttcttgagcttgtccaagcgcaaacgtacaggcagctggtgaccttatga

SEQ ID NO: 152 - DNA, 645 bp, Artificial
  Alicyclobacillus acidocaldarius mutated SEQ ID NO 138
atgatcatcgtgcattcgattacgtcactcttcgaatccatcgcttttgtcgccgaatacggcgagcctgacgcggatcgacacgtgaagcgcgtcgccacctatgcgcgtttcgttggagagcacgtcctgcggtggtcacctgccgcatgtgagcgtctggcgctcgcagcactcgtgcatgatgtggggaaagtggtgattccgcgagaaatcctccgcaagccagggccactgatgccagcggagcggcagtacgtgcagtgtcacacggtgtacggccgtgacatgctcgtggagttggcgcgtcgctatagtgggttagacggtgggttgtttgagctcgcgcagcaggtcgcgctttatcatcacgaacgatgggatggggacgggtatccggaaggcttatgtcgcgaggagattccgcttgctgcgcgggtcgtgcatctcgtggatgtgattgacgcaagacttagtccgcgtccgtacaaaccagggcaatcgtggcaccaggtgaagcaggcgctcgtcgaagggatgttcctggattttgacgggatgctggtgacaggccttttggaggttgaatcggcctttcttgagcttgtccaagcgcaaacgtacaggcagctggtgaccatatga

SEQ ID NO: 153 - DNA, 645 bp, Artificial
  Alicyclobacillus acidocaldarius mutated SEQ ID NO 138
atgatcatcgtgcattcgctgacgtcactcttcgaatccatcgcttttgtcgccgaatacggcgagcctgacgcggatcgacacgtgaagcgcgtcgccacctatgcgcgtttcgttggagagcacgtcctgcggtggtcacctgccgcatgtgagcgtctggcgctcgcagcactcgtgcatgatgtggggaaagtggtgattccgcgagaaatcctccgcaagccagggccactgatgccagcggagcggcagtacgtgcagtgtcacacggtgtacggccgtgacatgctcgtggagttggcgcgtcgctatagtgggttagacggtgggttgtttgagctcgcgcagcaggtcgcgatttatcatcacgaacgatgggatggggacgggtatccggaaggcttatgtcgcgaggagattccgcttgctgcgcgggtcgtgcatctcgtggatgtgattgacgcaagacttagtccgcgtccgtacaaaccagggcaatcgtggcaccaggtgaagcaggcgctcgtcgaagggatgttcctggattttgacgggatgctggtgacaggccttttggaggttgaatcggcctttcttgagcttgtccaagcgcaaacgtacaggcagctggtgaccatatga

SEQ ID NO: 154 - protein, 89 aa, Alicyclobacillus acidocaldarius
MSVFGVSRMMGGYGFGMMGLYWFLSVLMLLAAIVLVIWAILRMKPFGSLAQHEPYDRAVETLRERYARGEISREEYLERLEDLQDHRRS

SEQ ID NO: 155 - DNA, 270 bp, Alicyclobacillus acidocaldarius
atgtcggtctttggggtgtcgcgtatgatgggcggctatggttttggcatgatgggcctttactggtttctctccgtcctcatgctcttagcggcaattgtccttgtgatttgggcgattctccgtatgaagccgttcggctctctcgcccaacacgaaccgtatgaccgcgcggttgagactctgcgtgaacgatacgcacgtggcgagatcagtcgggaagaatacctcgaacggttggaagacctacaagaccaccggcgttcgtaa

SEQ ID NO: 156 - protein, 96 aa, Rubrobacter xylanophilus
GHGGMMGGWQGPGGMMGSGPGAWAFLWMLVPVLFWTGLLVLLVWAVLRLVPPSGGNGGREAPEEKAEEILRRRFARGEIDAEEYEERRRLLEEHHQ

SEQ ID NO: 157 - protein, 76 aa, Bacillus coagulans
MYGGYGMMGVFSLIGMIAQLVIFVLVIFLIVAGIKKVSEFRPHQREDKSLDILRERYAKGEITEEEFKKMKKDLMD

SEQ ID NO: 158 - protein, 88 aa, Thermoplasma volcanium
IGIYGVGYRGPYFGMMGLPYYGMYFFMPIMAAISILVIILFIYLIAGAFHDGSIMSDENSRATEILKERYAKGEISEEEYRKKLDELK

SEQ ID NO: 159 - protein, 88 aa, Thermoplasma volcanium; identical to SEQ ID NO: 158

SEQ ID NO: 160 - protein, 94 aa, Arthrobacter aurescens
GTPWMMNDYGMGGMGLAWIFWLLLIAGVILLAVVLVKAFTRNAGGNAPTDGQGPPRPGAGPARAREILEERYARGEISTEEYQERRRTLEEDSR

SEQ ID NO: 161 - protein, 89 aa, Artificial
  Alicyclobacillus acidocaldarius mutated SEQ ID NO 154
MSVFGVSRMMGGYGFGMMGLYWFLSVLMLLAAIVLVIWAILRMKPFGSLAQHEPYDRAVETLRERYARGEISREEYIERLEDLQDHRRS

SEQ ID NO: 162 - protein, 89 aa, Artificial
  Alicyclobacillus acidocaldarius mutated SEQ ID NO 154
MSVFGVSRMMGGYGFGMMGLYWFLSVLMLLAAIVLVIWAILRMKPFGSLAQHEPYDRAVETLRERYARGEISKEEYLERLEDLQDHRRS

SEQ ID NO: 163 - protein, 89 aa, Artificial
  Alicyclobacillus acidocaldarius mutated SEQ ID NO 154
MSVFGVSRMMGGYGFGMMGLYWFLSVLMLLAAIVLVIWAILRMKPFGSLANHEPYDRAVETLRERYARGEISREEYLERLEDLQDHRRS

SEQ ID NO: 164 - protein, 89 aa, Artificial
  Alicyclobacillus acidocaldarius mutated SEQ ID NO 154
MSVFGVSRMMGGYGFGMMGLYWFLSVLMLLAAIVLVIWAILRMKPFGSLAQHEPYDRAVETLRERYARGEISREEYLERLEDLQDHKRS

SEQ ID NO: 165 - protein, 89 aa, Artificial
  Alicyclobacillus acidocaldarius mutated SEQ ID NO 154
MSVFGVSRMMGGYGFGMMGLYWFLSVLMLLAAIVLVIWAIIRMKPFGSLAQHEPYDRAVETLRERYARGEISREEYLERLEDLQDHRRS

SEQ ID NO: 166 - DNA, 270 bp, Artificial
  Alicyclobacillus acidocaldarius mutated SEQ ID NO 155
atgtcggtctttggggtgtcgcgtatgatgggcggctatggttttggcatgatgggcctttactggtttctctccgtcctcatgctcttagcggcaattgtccttgtgatttgggcgattctccgtatgaagccgttcggctctctcgcccaacacgaaccgtatgaccgcgcggttgagactctgcgtgaacgatacgcacgtggcgagatcagtcgggaagaatacattgaacggttggaagacctacaagaccaccggcgttcgtaa

SEQ ID NO: 167 - DNA, 270 bp, Artificial
  Alicyclobacillus acidocaldarius mutated SEQ ID NO 155
atgtcggtctttggggtgtcgcgtatgatgggcggctatggttttggcatgatgggcctttactggtttctctccgtcctcatgctcttagcggcaattgtccttgtgatttgggcgattctccgtatgaagccgttcggctctctcgcccaacacgaaccgtatgaccgcgcggttgagactctgcgtgaacgatacgcacgtggcgagatcagtaaagaagaatacctcgaacggttggaagacctacaagaccaccggcgttcgtaa

SEQ ID NO: 168 - DNA, 270 bp, Artificial
  Alicyclobacillus acidocaldarius mutated SEQ ID NO 155
atgtcggtctttggggtgtcgcgtatgatgggcggctatggttttggcatgatgggcctttactggtttctctccgtcctcatgctcttagcggcaattgtccttgtgatttgggcgattctccgtatgaagccgttcggctctctcgccaatcacgaaccgtatgaccgcgcggttgagactctgcgtgaacgatacgcacgtggcgagatcagtcgggaagaatacctcgaacggttggaagacctacaagaccaccggcgttcgtaa

SEQ ID NO: 169 - DNA, 270 bp, Artificial
  Alicyclobacillus acidocaldarius mutated SEQ ID NO 155
atgtcggtctttggggtgtcgcgtatgatgggcggctatggttttggcatgatgggcctttactggtttctctccgtcctcatgctcttagcggcaattgtccttgtgatttgggcgattctccgtatgaagccgttcggctctctcgcccaacacgaaccgtatgaccgcgcggttgagactctgcgtgaacgatacgcacgtggcgagatcagtcgggaagaatacctcgaacggttggaagacctacaagaccacaaacgttcgtaa

SEQ ID NO: 170 - DNA, 270 bp, Artificial
  Alicyclobacillus acidocaldarius mutated SEQ ID NO 155
atgtcggtctttggggtgtcgcgtatgatgggcggctatggttttggcatgatgggcctttactggtttctctccgtcctcatgctcttagcggcaattgtccttgtgatttgggcgattattcgtatgaagccgttcggctctctcgcccaacacgaaccgtatgaccgcgcggttgagactctgcgtgaacgatacgcacgtggcgagatcagtcgggaagaatacctcgaacggttggaagacctacaagaccaccggcgttcgtaa

SEQ ID NO: 171 - protein, 173 aa, Alicyclobacillus acidocaldarius
MRGIWHFIHHWYLKIPYSPAEAHLFRHVWHMIPFWMPGFIALSIVPAGYILMILLSVLFSGFEWFKYEKALEVIKERGRKYSYYGLWLAYAIWAPLPWPRAATFGWTVVGWLTIRHFWKKRRRRIAWMSTLDKADLALMPGWAEWLERQQRIEAVLDRTLPWRRAKAKKASSK

SEQ ID NO: 172 - DNA, 522 bp, Alicyclobacillus acidocaldarius
atgagaggcatatggcacttcatccatcattggtatctcaagatcccatacagcccggcggaagcacatctgttccgtcatgtgtggcacatgatcccgttttggatgccgggcttcatcgcgttgagcattgtgccggccggttatatcctcatgattttgctcagcgtgctcttctcggggtttgagtggttcaagtacgagaaagcacttgaggtcatcaaggagcgcggtcggaagtattcgtactacggcctatggctggcctacgcaatatgggctccgcttccgtggccacgggcggcgacgttcggctggacggtagtcggatggctcacgattcgccacttctggaagaagcgccgtcgtcggatcgcgtggatgtcgacgctcgacaaagcggacctggcgctcatgcctgggtgggcggagtggttagaacggcaacagcggattgaagcggtgttggataggacgctgccgtggcgacgggcaaaggcgaaaaaagcatcaagtaaatga

SEQ ID NO: 173 - protein, 118 aa, Coprinopsis cinerea
HFVHHRSPREDAVPLIFAHGWPGNFTERPGFSIARIARVYHKLMVTLGYKHYVAQGGDWGSFILRSVAIQYPEAVVGLHINFPAAPIPSPLKNPITLFWLAIGWLTPEEKKRINRIKW

SEQ ID NO: 174 - protein, 172 aa, Roseovarius  217
HLAHHREEYLTDPYDDPEANYLDPTVWARLPLWVRAVLRINNTLAGRMLIGPMVAQAIFLRADWQAIKQGNRAVLHAWLWHIPAVALVLIWLSFASMPVWAYLLAVWLGLAVLKIRTFLEHRAHERASGRTVVIEDRGPLAWIFLNNNLHVVHHMHPEVPWYRLPALYAARR

SEQ ID NO: 175 - protein, 124 aa, Marinomonas  MED121
IWSMVPFLYVIMILVSIIQPSFFLFVLINVMFGWMGITWYMRTLTYKEKAREYVQAARAQGAGLWRIILKHILPNTMVMIVTLAPFGVVANISALTALDYLGLGLMPPTPSWGDLLQQGKSNMD

SEQ ID NO: 176 - protein, 99 aa, Synechococcus elongatus
FWGPQTRAENVGLTLFWAGWWPLILLAFPFVGRLWCAYCPFMIYGELVQWVSLKLWPRSLLPWPRAAAERWGGWFLFGLFALILLWEELWHLEDVAWLS

SEQ ID NO: 177 - protein, 47 aa, Burkholderia phymatum
AARFGFTFEGIFRQAVTYKGRNRDTAWFSIVDSEWPALRAGFAEWLD

SEQ ID NO: 178 - protein, 173 aa, Artificial
  Alicyclobacillus acidocaldarius mutated SEQ ID NO 171
MRGIWHFIHHWYLKIPYSPAEAHLFRHVWHMIPFWMPGFIALSIVPAGYILMILLSVLFSGFEWFKYEKALDVIKERGRKYSYYGLWLAYAIWAPLPWPRAATFGWTVVGWLTIRHFWKKRRRRIAWMSTLDKADLALMPGWAEWLERQQRIEAVLDRTLPWRRAKAKKASSK

SEQ ID NO: 179 - protein, 173 aa, Artificial
  Alicyclobacillus acidocaldarius mutated SEQ ID NO 171
MRGIWHFIHHWYLKIPYSPADAHLFRHVWHMIPFWMPGFIALSIVPAGYILMILLSVLFSGFEWFKYEKALEVIKERGRKYSYYGLWLAYAIWAPLPWPRAATFGWTVVGWLTIRHFWKKRRRRIAWMSTLDKADLALMPGWAEWLERQQRIEAVLDRTLPWRRAKAKKASSK

SEQ ID NO: 180 - protein, 173 aa, Artificial
  Alicyclobacillus acidocaldarius mutated SEQ ID NO 171
MRGIWHFIHHWYLKIPYSPAEAHLFRHVWHMIPFWMPGFIALSIVPAGYILMILLSVLFSGFEWFKYERALEVIKERGRKYSYYGLWLAYAIWAPLPWPRAATFGWTVVGWLTIRHFWKKRRRRIAWMSTLDKADLALMPGWAEWLERQQRIEAVLDRTLPWRRAKAKKASSK

SEQ ID NO: 181 - protein, 173 aa, Artificial
  Alicyclobacillus acidocaldarius mutated SEQ ID NO 171
MRGIWHFIHHWYLKIPYSPAEAHLFRHVWHMIPFWMPGFIALSIVPAGYILMILLSVLFSGFEWFKYEKALEVIKERGRKYSYYGLWLAYAIWAPLPWPRAATFGWTVVGWLTIRHFWKKRRRRIAWMSTLDKADLALMPGWAEWLERQQRIEAVIDRTLPWRRAKAKKASSK

SEQ ID NO: 182 - protein, 173 aa, Artificial
  Alicyclobacillus acidocaldarius mutated SEQ ID NO 171
MRGIWHFIHHWYLKIPYSPAEAHLFRHVWHMIPFWMPGFIALSIVPAGYILMILLSVLFSGFEWFRYEKALEVIKERGRKYSYYGLWLAYAIWAPLPWPRAATFGWTVVGWLTIRHFWKKRRRRIAWMSTLDKADLALMPGWAEWLERQQRIEAVLDRTLPWRRAKAKKASSK

SEQ ID NO: 183 - DNA, 522 bp, Artificial
  Alicyclobacillus acidocaldarius mutated SEQ ID NO 172
atgagaggcatatggcacttcatccatcattggtatctcaagatcccatacagcccggcggaagcacatctgttccgtcatgtgtggcacatgatcccgttttggatgccgggcttcatcgcgttgagcattgtgccggccggttatatcctcatgattttgctcagcgtgctcttctcggggtttgagtggttcaagtacgagaaagcacttgatgtcatcaaggagcgcggtcggaagtattcgtactacggcctatggctggcctacgcaatatgggctccgcttccgtggccacgggcggcgacgttcggctggacggtagtcggatggctcacgattcgccacttctggaagaagcgccgtcgtcggatcgcgtggatgtcgacgctcgacaaagcggacctggcgctcatgcctgggtgggcggagtggttagaacggcaacagcggattgaagcggtgttggataggacgctgccgtggcgacgggcaaaggcgaaaaaagcatcaagtaaatga

SEQ ID NO: 184 - DNA, 522 bp, Artificial
  Alicyclobacillus acidocaldarius mutated SEQ ID NO 172
atgagaggcatatggcacttcatccatcattggtatctcaagatcccatacagcccggcggatgcacatctgttccgtcatgtgtggcacatgatcccgttttggatgccgggcttcatcgcgttgagcattgtgccggccggttatatcctcatgattttgctcagcgtgctcttctcggggtttgagtggttcaagtacgagaaagcacttgaggtcatcaaggagcgcggtcggaagtattcgtactacggcctatggctggcctacgcaatatgggctccgcttccgtggccacgggcggcgacgttcggctggacggtagtcggatggctcacgattcgccacttctggaagaagcgccgtcgtcggatcgcgtggatgtcgacgctcgacaaagcggacctggcgctcatgcctgggtgggcggagtggttagaacggcaacagcggattgaagcggtgttggataggacgctgccgtggcgacgggcaaaggcgaaaaaagcatcaagtaaatga

SEQ ID NO: 185 - DNA, 522 bp, Artificial
  Alicyclobacillus acidocaldarius mutated SEQ ID NO 172
atgagaggcatatggcacttcatccatcattggtatctcaagatcccatacagcccggcggaagcacatctgttccgtcatgtgtggcacatgatcccgttttggatgccgggcttcatcgcgttgagcattgtgccggccggttatatcctcatgattttgctcagcgtgctcttctcggggtttgagtggttcaagtacgagcgtgcacttgaggtcatcaaggagcgcggtcggaagtattcgtactacggcctatggctggcctacgcaatatgggctccgcttccgtggccacgggcggcgacgttcggctggacggtagtcggatggctcacgattcgccacttctggaagaagcgccgtcgtcggatcgcgtggatgtcgacgctcgacaaagcggacctggcgctcatgcctgggtgggcggagtggttagaacggcaacagcggattgaagcggtgttggataggacgctgccgtggcgacgggcaaaggcgaaaaaagcatcaagtaaatga

SEQ ID NO: 186 - DNA, 522 bp, Artificial
  Alicyclobacillus acidocaldarius mutated SEQ ID NO 172
atgagaggcatatggcacttcatccatcattggtatctcaagatcccatacagcccggcggaagcacatctgttccgtcatgtgtggcacatgatcccgttttggatgccgggcttcatcgcgttgagcattgtgccggccggttatatcctcatgattttgctcagcgtgctcttctcggggtttgagtggttcaagtacgagaaagcacttgaggtcatcaaggagcgcggtcggaagtattcgtactacggcctatggctggcctacgcaatatgggctccgcttccgtggccacgggcggcgacgttcggctggacggtagtcggatggctcacgattcgccacttctggaagaagcgccgtcgtcggatcgcgtggatgtcgacgctcgacaaagcggacctggcgctcatgcctgggtgggcggagtggttagaacggcaacagcggattgaagcggtgattgataggacgctgccgtggcgacgggcaaaggcgaaaaaagcatcaagtaaatga

SEQ ID NO: 187 - DNA, 522 bp, Artificial
  Alicyclobacillus acidocaldarius mutated SEQ ID NO 172
atgagaggcatatggcacttcatccatcattggtatctcaagatcccatacagcccggcggaagcacatctgttccgtcatgtgtggcacatgatcccgttttggatgccgggcttcatcgcgttgagcattgtgccggccggttatatcctcatgattttgctcagcgtgctcttctcggggtttgagtggttccgttacgagaaagcacttgaggtcatcaaggagcgcggtcggaagtattcgtactacggcctatggctggcctacgcaatatgggctccgcttccgtggccacgggcggcgacgttcggctggacggtagtcggatggctcacgattcgccacttctggaagaagcgccgtcgtcggatcgcgtggatgtcgacgctcgacaaagcggacctggcgctcatgcctgggtgggcggagtggttagaacggcaacagcggattgaagcggtgttggataggacgctgccgtggcgacgggcaaaggcgaaaaaagcatcaagtaaatga

SEQ ID NO: 188 - protein, 284 aa, Alicyclobacillus acidocaldarius
MRIARSGNDIVAKHLTNALPGEVLSVIGIHDAHVVRALPTELPTVEVRQEFTDIMLELADGRLLHLEFQTTREPNLYRFGTYDWAMAERYKRPIRTVILYTRDVTEAPSELDAGSMRYAVENVYLGHMDGDGALETVKRHLAAHEWTEEDRVRLAFAFHMRFERRTREEAFGEIVEVVQRVPDVHEQNYLAALILGFSGRVMADEQKEQLRRVLEMTDLLRELEREFEEKGIQKGLQQGLQQGELQKAREIAHRLLRKGASVQEVVEITGLSSKDVEEIRQNLH

SEQ ID NO: 189 - DNA, 855 bp, Alicyclobacillus acidocaldarius
atgagaatcgcgagaagcgggaacgatattgttgccaagcacttgacgaacgccttgccgggcgaggtgttgtcggtcatcggcattcacgatgcgcacgtagtacgggccttgccgactgagttgccaacggtcgaagttcggcaggagttcacggacatcatgctggagttggccgatggacgattgctgcatctcgagttccagaccacacgcgagccgaacctgtaccgattcggcacgtacgattgggcgatggcggagcgctacaagcgtccgatccgcacggtgatattgtacacgcgcgacgtgaccgaggcgccgtcggagctcgacgccgggagcatgcggtacgcggtcgagaacgtgtacctgggccacatggacggtgacggtgcgctggagaccgtgaagcgtcacctggccgcgcatgagtggacggaggaagaccgggtgcgccttgcgttcgcgttccacatgcgttttgagcgccgaacgcgggaagaagcgtttggggagattgtcgaggttgtacagcgcgtgccggatgtgcacgaacagaactacctggcggcgctgatattaggcttcagcgggcgtgtgatggcggatgagcaaaaggagcagctaaggagggtgctagagatgacggatttgctgagggagttggagcgagagtttgaggagaaggggattcagaaggggctgcaacaagggttgcaacaaggtgagctacaaaaagcccgggaaattgcacatcgtctccttcgtaaaggagcttctgtgcaagaagtcgtggagattacgggtttgtcgtcgaaggacgtggaggaaatccgtcagaacctgcactga

SEQ ID NO: 190 - protein, 270 aa, Desulfitobacterium hafniense
ISYHNNDILMKVLAEQFKNKTLDVFGIKTAKIKDLIPSVHPAVEANETRNDIIFLLEDDTLLHLEFQTTAGEQDLKRFLYYDARLVRRQERKVHTIVIYSGRIEQARERLECGSILYQVENIYMKHYNGDQEYNRLKHKIDNHQLLSETDTLKLIFLPLMKSEQKEEELAIQAAELAKAAPDEKTKLFAIAALIVITDKIMSESNKRKLLEVLKMTQIEQWIREEGRQEGELKGRRDEKRETAQTMLNLGMSPELIAKATKLPLEEILEM

SEQ ID NO: 191 - protein, 239 aa, Petrotoga mobilis
IISVKPIDIPVINVSNQNPDFVFELEDNSLLHLEFQTTWKKADLLRFAQYDIALYQKERRRINTVVMYSGKYESAESELDMGSNKYKVQQIFMIKYDGIKRYEEIKEKIEKEEELTDKDLMDLVFLPLMRNEKSEEEVTKDVFELAIKIPDEDKKEAVIGSLLGFSDNYVRDEYINELKEVIRMTKIGTSLFEEGVEEGEKELTIKILNKRFGRRLTEEIKDRIREADKKTIDYIGDNL

SEQ ID NO: 192 - protein, 284 aa, Methanospirillum hungatei
KISKKNYDLVFKEAFSIFDNRSLAFLGIDLPPIISFLVTEIPEVETTDDMMDLNFRLEDGSILHLEEEMNLSKRDLIRFAHYDLRLFRYYDAPVHTVVLTPADSSSGTKVLDIGSLQYNVLQIVLSDRDGDALLSQMRAALEKGEPVNELELIFLPLMKSKLTKIELLRRTIDLEKELPEKDLRNKVRELTLILADKIVDQKILDELWEELRMFKVVKYAEEKGMEKGLEKGLEKGIKKGMEKGKKQERETVAKNMLSLGIEDELIIKATGLDQSIIDKLKKSL

SEQ ID NO: 193 - protein, 272 aa, Clostridium tetani
DTKIIAPANTELKTIDIKTNFTDYTFYTENDDYLHFEFQTTNKEEDINRFLFYDASLFYKYGKKVNTLVVYSSDIKKSKTKVDAGSLKYEIKAFYMSSLNGDEEYNNLKTKIDKGEDLTKEEILSLTFIPLMDSKEDKSTRTIKSIELAEKMEENNTKLQCITLLYAFLEKFGDAKSKKKFKEVFSMTEIGRMIVEESIEKGRAEGIKKGIEEGIKKGRTEGKTEGKSEILIKQLIKKFKKVPEEYIQKIKTLSIDTIDIIALEIFDMEDIK

SEQ ID NO: 194 - protein, 280 aa, Geobacillus kaustophilus
ISHHAKDILFKSLSALYQNQALDVYGLHGLPRIKALLPNEFPSVRADERRADTVFLLEDDSILLLEYESNERFLDNHLKYLDYACRILHTYYQQEKRIRPIRIVVIYTSDVTTARERLDAGDVFLSSKAVLLGEFNGDAIFHAIEEKVHNGEPLTPEETMKLILVPLMHTRFDRQTMIEKTIELAKAIGDEPKQLHIIAGVLTATDKFIDRSYAEKVKEWIKMNKVFRLLVEELEQEKEEMLKKVMQEKEQAVQRAIQEKEQAVQRVIQEKEQAVQRAIQ

SEQ ID NO: 195 - protein, 284 aa, Artificial
  Alicyclobacillus acidocaldarius mutated SEQ ID NO 188
MRIARSGNDIVAKHLTNALPGEVLSVIGIHDAHVVRALPTELPTVEVRQEFTDIMLELADGRLLHLEFQTTREPNLYRFGTYDWAMAERYKRPIRTVILYTRDVTEAPSELDAGSMRYAVENVYLGHMDGDGALETVKRHLAAHEWTEEDRVRLAFAFHMRFERRTREEAFGEIVEVVQRVPDVHEQNYLAALILGFSGRVMADEQKEQLRRVLEMTDLIRELEREFEEKGIQKGLQQGLQQGELQKAREIAHRLLRKGASVQEVVEITGLSSKDVEEIRQNLH

SEQ ID NO: 196 - protein, 284 aa, Artificial
  Alicyclobacillus acidocaldarius mutated SEQ ID NO 188
MRIARSGNDIVAKHLTNALPGEVLSVIGIHDAHVVRALPTELPTVEVRQEFTDIMLELADGRLLHLEFQTTREPNLYRFGTYDWAMAERYKRPIRTVILYTRDVTEAPSELDAGSMRYAVENVYLGHMDGDGALETVKRHLAAHEWTEEDRVRLAFAFHMRFERRTREEAFGEIVEVVQRVPDVHEQNYLAALILGFSGRVMADEQKEQLRRVLEMTDLLRELEREFEEKGIQKGLQQGLQQGELQKAREIAHRLLRKGASVQDVVEITGLSSKDVEEIRQNLH

SEQ ID NO: 197 - protein, 284 aa, Artificial
  Alicyclobacillus acidocaldarius mutated SEQ ID NO 188
MRIARSGNDIVAKHLTNALPGEVLSVIGIHDAHVVRALPTELPTVEVRQEFTDIMLELADGRLLHLEFQTTREPNLYRFGTYDWAMAERYKRPIRTVILYTRDVTEAPSELDAGSMRYAVEQVYLGHMDGDGALETVKRHLAAHEWTEEDRVRLAFAFHMRFERRTREEAFGEIVEVVQRVPDVHEQNYLAALILGFSGRVMADEQKEQLRRVLEMTDLLRELEREFEEKGIQKGLQQGLQQGELQKAREIAHRLLRKGASVQEVVEITGLSSKDVEEIRQNLH

SEQ ID NO: 198 - protein, 284 aa, Artificial
  Alicyclobacillus acidocaldarius mutated SEQ ID NO 188
MRIARSGNDIVAKHLTNALPGEVLSVIGIHDAHVVRALPTELPTVEVRQEFTDIMLELADGRLLHLEFQTTREPNLYRFGTYDWAMAERYKRPIRTVILYTRDVTEAPSELDAGSMRYAVENVYLGHMDGDGALETVKRHLAAHEWTEEDRVRLAFAFHMRFERRTREEAFGEIVEVVQRVPDVHEQNYLAALILGFSGRVMADEQKEQLRRVLEMTDLLRELEREFEEKGIQKGLQQGLQQGELQKAREIAHRILRKGASVQEVVEITGLSSKDVEEIRQNLH

SEQ ID NO: 199 - protein, 284 aa, Artificial
  Alicyclobacillus acidocaldarius mutated SEQ ID NO 188
MRIARSGNDIVAKHLTNALPGEVLSVIGIHDAHVVRALPTELPTVEVRQEFTDIMLELADGRLLHLEFQTTREPNLYRFGTYDWAMAERYKRPIRTVILYTRDVTEAPSELDAGSMRYAVENVYLGHMDGDGALETVKRHLAAHEWTEEDRVRLAFAFHMRFERRTREEAFGEIVEVVQRVPDVHEQNYLAALILGFSGRVMAEEQKEQLRRVLEMTDLLRELEREFEEKGIQKGLQQGLQQGELQKAREIAHRLLRKGASVQEVVEITGLSSKDVEEIRQNLH

SEQ ID NO: 200 - DNA, 855 bp, Artificial
  Alicyclobacillus acidocaldarius mutated SEQ ID NO 189
atgagaatcgcgagaagcgggaacgatattgttgccaagcacttgacgaacgccttgccgggcgaggtgttgtcggtcatcggcattcacgatgcgcacgtagtacgggccttgccgactgagttgccaacggtcgaagttcggcaggagttcacggacatcatgctggagttggccgatggacgattgctgcatctcgagttccagaccacacgcgagccgaacctgtaccgattcggcacgtacgattgggcgatggcggagcgctacaagcgtccgatccgcacggtgatattgtacacgcgcgacgtgaccgaggcgccgtcggagctcgacgccgggagcatgcggtacgcggtcgagaacgtgtacctgggccacatggacggtgacggtgcgctggagaccgtgaagcgtcacctggccgcgcatgagtggacggaggaagaccgggtgcgccttgcgttcgcgttccacatgcgttttgagcgccgaacgcgggaagaagcgtttggggagattgtcgaggttgtacagcgcgtgccggatgtgcacgaacagaactacctggcggcgctgatattaggcttcagcgggcgtgtgatggcggatgagcaaaaggagcagctaaggagggtgctagagatgacggatttgattagggagttggagcgagagtttgaggagaaggggattcagaaggggctgcaacaagggttgcaacaaggtgagctacaaaaagcccgggaaattgcacatcgtctccttcgtaaaggagcttctgtgcaagaagtcgtggagattacgggtttgtcgtcgaaggacgtggaggaaatccgtcagaacctgcactga

SEQ ID NO: 201 - DNA, 855 bp, Artificial
  Alicyclobacillus acidocaldarius mutated SEQ ID NO 189
atgagaatcgcgagaagcgggaacgatattgttgccaagcacttgacgaacgccttgccgggcgaggtgttgtcggtcatcggcattcacgatgcgcacgtagtacgggccttgccgactgagttgccaacggtcgaagttcggcaggagttcacggacatcatgctggagttggccgatggacgattgctgcatctcgagttccagaccacacgcgagccgaacctgtaccgattcggcacgtacgattgggcgatggcggagcgctacaagcgtccgatccgcacggtgatattgtacacgcgcgacgtgaccgaggcgccgtcggagctcgacgccgggagcatgcggtacgcggtcgagaacgtgtacctgggccacatggacggtgacggtgcgctggagaccgtgaagcgtcacctggccgcgcatgagtggacggaggaagaccgggtgcgccttgcgttcgcgttccacatgcgttttgagcgccgaacgcgggaagaagcgtttggggagattgtcgaggttgtacagcgcgtgccggatgtgcacgaacagaactacctggcggcgctgatattaggcttcagcgggcgtgtgatggcggatgagcaaaaggagcagctaaggagggtgctagagatgacggatttgctgagggagttggagcgagagtttgaggagaaggggattcagaaggggctgcaacaagggttgcaacaaggtgagctacaaaaagcccgggaaattgcacatcgtctccttcgtaaaggagcttctgtgcaagatgtcgtggagattacgggtttgtcgtcgaaggacgtggaggaaatccgtcagaacctgcactga

SEQ ID NO: 202 - DNA, 855 bp, Artificial
  Alicyclobacillus acidocaldarius mutated SEQ ID NO 189
atgagaatcgcgagaagcgggaacgatattgttgccaagcacttgacgaacgccttgccgggcgaggtgttgtcggtcatcggcattcacgatgcgcacgtagtacgggccttgccgactgagttgccaacggtcgaagttcggcaggagttcacggacatcatgctggagttggccgatggacgattgctgcatctcgagttccagaccacacgcgagccgaacctgtaccgattcggcacgtacgattgggcgatggcggagcgctacaagcgtccgatccgcacggtgatattgtacacgcgcgacgtgaccgaggcgccgtcggagctcgacgccgggagcatgcggtacgcggtcgagcaagtgtacctgggccacatggacggtgacggtgcgctggagaccgtgaagcgtcacctggccgcgcatgagtggacggaggaagaccgggtgcgccttgcgttcgcgttccacatgcgttttgagcgccgaacgcgggaagaagcgtttggggagattgtcgaggttgtacagcgcgtgccggatgtgcacgaacagaactacctggcggcgctgatattaggcttcagcgggcgtgtgatggcggatgagcaaaaggagcagctaaggagggtgctagagatgacggatttgctgagggagttggagcgagagtttgaggagaaggggattcagaaggggctgcaacaagggttgcaacaaggtgagctacaaaaagcccgggaaattgcacatcgtctccttcgtaaaggagcttctgtgcaagaagtcgtggagattacgggtttgtcgtcgaaggacgtggaggaaatccgtcagaacctgcactga

SEQ ID NO: 203 - DNA, 855 bp, Artificial
  Alicyclobacillus acidocaldarius mutated SEQ ID NO 189
atgagaatcgcgagaagcgggaacgatattgttgccaagcacttgacgaacgccttgccgggcgaggtgttgtcggtcatcggcattcacgatgcgcacgtagtacgggccttgccgactgagttgccaacggtcgaagttcggcaggagttcacggacatcatgctggagttggccgatggacgattgctgcatctcgagttccagaccacacgcgagccgaacctgtaccgattcggcacgtacgattgggcgatggcggagcgctacaagcgtccgatccgcacggtgatattgtacacgcgcgacgtgaccgaggcgccgtcggagctcgacgccgggagcatgcggtacgcggtcgagaacgtgtacctgggccacatggacggtgacggtgcgctggagaccgtgaagcgtcacctggccgcgcatgagtggacggaggaagaccgggtgcgccttgcgttcgcgttccacatgcgttttgagcgccgaacgcgggaagaagcgtttggggagattgtcgaggttgtacagcgcgtgccggatgtgcacgaacagaactacctggcggcgctgatattaggcttcagcgggcgtgtgatggcggatgagcaaaaggagcagctaaggagggtgctagagatgacggatttgctgagggagttggagcgagagtttgaggagaaggggattcagaaggggctgcaacaagggttgcaacaaggtgagctacaaaaagcccgggaaattgcacatcgtattcttcgtaaaggagcttctgtgcaagaagtcgtggagattacgggtttgtcgtcgaaggacgtggaggaaatccgtcagaacctgcactga

SEQ ID NO: 204 - DNA, 855 bp, Artificial
  Alicyclobacillus acidocaldarius mutated SEQ ID NO 189
atgagaatcgcgagaagcgggaacgatattgttgccaagcacttgacgaacgccttgccgggcgaggtgttgtcggtcatcggcattcacgatgcgcacgtagtacgggccttgccgactgagttgccaacggtcgaagttcggcaggagttcacggacatcatgctggagttggccgatggacgattgctgcatctcgagttccagaccacacgcgagccgaacctgtaccgattcggcacgtacgattgggcgatggcggagcgctacaagcgtccgatccgcacggtgatattgtacacgcgcgacgtgaccgaggcgccgtcggagctcgacgccgggagcatgcggtacgcggtcgagaacgtgtacctgggccacatggacggtgacggtgcgctggagaccgtgaagcgtcacctggccgcgcatgagtggacggaggaagaccgggtgcgccttgcgttcgcgttccacatgcgttttgagcgccgaacgcgggaagaagcgtttggggagattgtcgaggttgtacagcgcgtgccggatgtgcacgaacagaactacctggcggcgctgatattaggcttcagcgggcgtgtgatggcggaagagcaaaaggagcagctaaggagggtgctagagatgacggatttgctgagggagttggagcgagagtttgaggagaaggggattcagaaggggctgcaacaagggttgcaacaaggtgagctacaaaaagcccgggaaattgcacatcgtctccttcgtaaaggagcttctgtgcaagaagtcgtggagattacgggtttgtcgtcgaaggacgtggaggaaatccgtcagaacctgcactga

SEQ ID NO: 205 - protein, 183 aa, Alicyclobacillus acidocaldarius
MLGYEVIHMHPGVFFMHLRHMLPWWSPAIIAWYGTLFMWAREYPQRYYEDIPASDGSVEVFSRWFGMFFWALVMFYAMWFALPYPGVEILVDLCCIPVMLIVFGMLAIGWVVHLIDEFGSYQADEHLEKGLTCAEWEQFKRRREFRDFQLRVNAMYEAIEPERRKQRFIVFEGKRGKKRGDRA

SEQ ID NO: 206 - DNA, 552 bp, Alicyclobacillus acidocaldarius
atgctgggatacgaggtgatccacatgcatccaggcgtgtttttcatgcatctacgacacatgttgccttggtggtcgccagcaatcatcgcatggtacgggacgcttttcatgtgggcaagagaatatcctcagaggtattacgaagacattccagcaagtgatggatccgttgaagtgtttagtcgctggtttggaatgtttttctgggcactcgtgatgttttatgcgatgtggtttgcgctaccgtatccaggagtcgaaatccttgtggacttatgttgcattccagtcatgctcattgtctttggcatgttggcgattggatgggtggtccatctcatcgatgagttcggatcgtatcaagcagacgaacatctggaaaagggactcacttgtgcagaatgggagcagtttaaacggcggcgcgagttcagggactttcagttaagagtgaacgcgatgtatgaggcaatcgaaccagaaaggagaaaacagcggtttatcgtattcgagggcaagcggggaaagaaacgaggtgaccgtgcatga

SEQ ID NO: 207 - protein, 70 aa, Trichomonas vaginalis
YYNHYYEEYIEDHKSGFEVNFRWQFGSWGKFSSYPPLFALVGAGITILIDMCVLSDLRILFTIANFAYIL

SEQ ID NO: 208 - protein, 56 aa, Methanosarcina barkeri
SFWIGMVFFLLMFVAYYASGYGLSEIMIYPSIFSFGLVAFGMLGMGPVTIAVDSYG

SEQ ID NO: 209 - protein, 124 aa, Photobacterium profundum
VVDMHGNEVMLPMIQVLDMWYPNNLSFLGKLTHWGHQVVKFLTEDPREANTEGGVFPAIFGTVFMVLLMSIIVTPLGVMAAIYLHEYAGKNGFTKLIRVAVINLAGVPSIVYGVFGLGFFVYMV

SEQ ID NO: 210 - protein, 47 aa, Strongylocentrotus purpuratus
GNYQRDSSVTQMQTCLEWESLERRREKSRLVMLYKIYKGKVGLKQED

SEQ ID NO: 211 - protein, 78 aa, Bacillus coagulans
EFGQFDEWKDLTQLDWMLLDFETHRTFFQFTKALNAFYQNTRSLWRLDHDPEGFEWIDPNNRRQSIIIFMRRGKRKGD

SEQ ID NO: 212 - protein, 183 aa, Artificial
  Alicyclobacillus acidocaldarius mutated SEQ ID NO 205
MLGYEVIHMHPGVFFMHLRHMLPWWSPAIIAWYGTLFMWAREYPQRYYEDIPASDGSVEVFSRWFGMFFWALVMFYAMWFALPYPGVEILVDLCCIPVMLIVFGMLAIGWVVHLIDEFGSYQADEHLEKGLTCAEWEQFKRRREFRDFQLRVNAMYEAIEPERRKNRFIVFEGKRGKKRGDRA

SEQ ID NO: 213 - protein, 183 aa, Artificial
  Alicyclobacillus acidocaldarius mutated SEQ ID NO 205
MLGYEVIHMHPGVFFMHLRHMLPWWSPALIAWYGTLFMWAREYPQRYYEDIPASDGSVEVFSRWFGMFFWALVMFYAMWFALPYPGVEILVDLCCIPVMLIVFGMLAIGWVVHLIDEFGSYQADEHLEKGLTCAEWEQFKRRREFRDFQLRVNAMYEAIEPERRKQRFIVFEGKRGKKRGDRA

SEQ ID NO: 214 - protein, 183 aa, Artificial
  Alicyclobacillus acidocaldarius mutated SEQ ID NO 205
MLGYEVIHMHPGVFFMHLRHMLPWWSPAIIAWYGTLFMWAREYPQRYYEDIPASDGSVEVFSRWFGMFFWALVMFYAMWFALPYPGVEILVDLCCIPVMLLVFGMLAIGWVVHLIDEFGSYQADEHLEKGLTCAEWEQFKRRREFRDFQLRVNAMYEAIEPERRKQRFIVFEGKRGKKRGDRA

SEQ ID NO: 215 - protein, 183 aa, Artificial
  Alicyclobacillus acidocaldarius mutated SEQ ID NO 205
MLGYEVIHMHPGVFFMHLRHMLPWWSPAIIAWYGTLFMWAREYPQRYYEDIPASDGSVEVFSRWFGMFFWALVMFYAMWFALPYPGVEILVDLCCIPVMLIVFGMLAIGWVIHLIDEFGSYQADEHLEKGLTCAEWEQFKRRREFRDFQLRVNAMYEAIEPERRKQRFIVFEGKRGKKRGDRA

SEQ ID NO: 216 - protein, 183 aa, Artificial
  Alicyclobacillus acidocaldarius mutated SEQ ID NO 205
MLGYEVIHMHPGVFFMHLRHMLPWWSPAIIAWYGTLFMWAREYPQRYYEDIPASDGSVEVFSRWFGMFFWALVMFYAMWFALPYPGVEILVDLCCIPVMLIVFGMLAIGWVVHLIDEFGSYQADEHLEKGLTCAEWEQFKRRREFRDFQLRVNAMYEAIEPERRKQRFIVFEGKRGRKRGDRA

SEQ ID NO: 217 - DNA, 552 bp, Artificial
  Alicyclobacillus acidocaldarius mutated SEQ ID NO 206
atgctgggatacgaggtgatccacatgcatccaggcgtgtttttcatgcatctacgacacatgttgccttggtggtcgccagcaatcatcgcatggtacgggacgcttttcatgtgggcaagagaatatcctcagaggtattacgaagacattccagcaagtgatggatccgttgaagtgtttagtcgctggtttggaatgtttttctgggcactcgtgatgttttatgcgatgtggtttgcgctaccgtatccaggagtcgaaatccttgtggacttatgttgcattccagtcatgctcattgtctttggcatgttggcgattggatgggtggtccatctcatcgatgagttcggatcgtatcaagcagacgaacatctggaaaagggactcacttgtgcagaatgggagcagtttaaacggcggcgcgagttcagggactttcagttaagagtgaacgcgatgtatgaggcaatcgaaccagaaaggagaaaaaatcggtttatcgtattcgagggcaagcggggaaagaaacgaggtgaccgtgcatga

SEQ ID NO: 218 - DNA, 552 bp, Artificial
  Alicyclobacillus acidocaldarius mutated SEQ ID NO 206
atgctgggatacgaggtgatccacatgcatccaggcgtgtttttcatgcatctacgacacatgttgccttggtggtcgccagcattaatcgcatggtacgggacgcttttcatgtgggcaagagaatatcctcagaggtattacgaagacattccagcaagtgatggatccgttgaagtgtttagtcgctggtttggaatgtttttctgggcactcgtgatgttttatgcgatgtggtttgcgctaccgtatccaggagtcgaaatccttgtggacttatgttgcattccagtcatgctcattgtctttggcatgttggcgattggatgggtggtccatctcatcgatgagttcggatcgtatcaagcagacgaacatctggaaaagggactcacttgtgcagaatgggagcagtttaaacggcggcgcgagttcagggactttcagttaagagtgaacgcgatgtatgaggcaatcgaaccagaaaggagaaaacagcggtttatcgtattcgagggcaagcggggaaagaaacgaggtgaccgtgcatga

SEQ ID NO: 219 - DNA, 552 bp, Artificial
  Alicyclobacillus acidocaldarius mutated SEQ ID NO 206
atgctgggatacgaggtgatccacatgcatccaggcgtgtttttcatgcatctacgacacatgttgccttggtggtcgccagcaatcatcgcatggtacgggacgcttttcatgtgggcaagagaatatcctcagaggtattacgaagacattccagcaagtgatggatccgttgaagtgtttagtcgctggtttggaatgtttttctgggcactcgtgatgttttatgcgatgtggtttgcgctaccgtatccaggagtcgaaatccttgtggacttatgttgcattccagtcatgctcttagtctttggcatgttggcgattggatgggtggtccatctcatcgatgagttcggatcgtatcaagcagacgaacatctggaaaagggactcacttgtgcagaatgggagcagtttaaacggcggcgcgagttcagggactttcagttaagagtgaacgcgatgtatgaggcaatcgaaccagaaaggagaaaacagcggtttatcgtattcgagggcaagcggggaaagaaacgaggtgaccgtgcatga

SEQ ID NO: 220 - DNA, 552 bp, Artificial
  Alicyclobacillus acidocaldarius mutated SEQ ID NO 206
atgctgggatacgaggtgatccacatgcatccaggcgtgtttttcatgcatctacgacacatgttgccttggtggtcgccagcaatcatcgcatggtacgggacgcttttcatgtgggcaagagaatatcctcagaggtattacgaagacattccagcaagtgatggatccgttgaagtgtttagtcgctggtttggaatgtttttctgggcactcgtgatgttttatgcgatgtggtttgcgctaccgtatccaggagtcgaaatccttgtggacttatgttgcattccagtcatgctcattgtctttggcatgttggcgattggatgggtgattcatctcatcgatgagttcggatcgtatcaagcagacgaacatctggaaaagggactcacttgtgcagaatgggagcagtttaaacggcggcgcgagttcagggactttcagttaagagtgaacgcgatgtatgaggcaatcgaaccagaaaggagaaaacagcggtttatcgtattcgagggcaagcggggaaagaaacgaggtgaccgtgcatga

SEQ ID NO: 221 - DNA, 552 bp, Artificial
  Alicyclobacillus acidocaldarius mutated SEQ ID NO 206
atgctgggatacgaggtgatccacatgcatccaggcgtgtttttcatgcatctacgacacatgttgccttggtggtcgccagcaatcatcgcatggtacgggacgcttttcatgtgggcaagagaatatcctcagaggtattacgaagacattccagcaagtgatggatccgttgaagtgtttagtcgctggtttggaatgtttttctgggcactcgtgatgttttatgcgatgtggtttgcgctaccgtatccaggagtcgaaatccttgtggacttatgttgcattccagtcatgctcattgtctttggcatgttggcgattggatgggtggtccatctcatcgatgagttcggatcgtatcaagcagacgaacatctggaaaagggactcacttgtgcagaatgggagcagtttaaacggcggcgcgagttcagggactttcagttaagagtgaacgcgatgtatgaggcaatcgaaccagaaaggagaaaacagcggtttatcgtattcgagggcaagcggggacgtaaacgaggtgaccgtgcatga

SEQ ID NO: 222 - protein, 661 aa, Alicyclobacillus acidocaldarius
MTLFARKKKKEKKRKRWSWLRAHLRRQKEKRVLAQDPSVIGEHAPTLHDLMTLADGIEMRASEIYVSPSGYTKTYYVTGLPSTVHFGYFQRFFRVGADVHISLHVEPADSAVAMAKRTKLMTKIEAEILAEQKAGTNKQIAFLQQEYQLLEKEREELRLGRERIFYATIILAVSSPNRQEFEAACERIEREGFEGFLLREAFKEHDLGFRSVAPIGENALRHPIEMTASALANSFPFTNARFSHEYGVPIGVDWSSGHLNRYDAWHPKLVNANGVIIGKAGAGKSFLVKGLVARSAAMGIRHVIVDYEGEYTPMVQALGGVVIRLDEHSPYKFNPFELEEEEEKQADGTIRRFVDVKEKISDMERLIVSMAHLHAGHDLLDSYTRNAINDMLQELYERDFGFTSDPESLYERHETWQRDAKGDRLVRRVKRPQPRFSDFYVKLEERAASDSRLEELAMRLRRFREGGTEGMFDCYSNVELQDVPVVSFDLSHLPEKSMARLLGMQVVLEWIMEKFIKKNVHLKKRVVIDEAQKMLEHLYHAIFMEDVFRRIRKRSGSAVAASQDFRKFAESEQGRAILQNSDTKILLRQDKLDKEAVIENFGLEEHEFEELIAFRDGQARWWVGGEVFYNQLIPFADEFELFTTRFVQSDAELAMQRRWLA

SEQ ID NO: 223 - DNA, 1986 bp, Alicyclobacillus acidocaldarius
gtgaccttgttcgcacgcaagaagaagaaggaaaagaagcgtaagcgctggtcttggctgcgagcacatttgcgacgccaaaaggagaaacgcgttctcgcgcaagatccgagcgtcattggggagcacgcaccaacactccacgatctcatgacgctcgctgacgggatcgagatgcgcgcgagtgagatttacgtgtcgccaagcggatacacgaagacatactacgtgacggggttgccttccaccgtccatttcgggtactttcagcgcttcttccgcgttggagcggacgtgcacatttccttgcacgttgaacctgcggattccgcagtggctatggccaagcggacgaagctcatgaccaaaatcgaggccgaaatccttgcagagcaaaaggcgggcaccaataagcagattgcgttcctgcaacaggagtatcaattgctcgaaaaagagcgcgaagaactgcggcttggccgcgagcgcatcttttatgccaccatcatcttggcagtcagttcgccgaatcgacaggagttcgaggccgcctgtgagcggattgagcgtgaaggcttcgaggggttcttgctgcgtgaggccttcaaagaacatgacctcggctttcgctcagtcgccccgattggcgaaaacgcccttcgtcatcccatcgagatgaccgcaagtgccttggcaaacagctttccgttcaccaatgcacgcttctcacatgagtacggcgtaccgattggcgtcgactggtcaagcggtcacttgaatcgctacgatgcctggcacccgaagcttgtcaacgccaatggggtgatcatcggcaaggcgggcgcgggcaagagcttcttggtgaaaggtctcgtggcccgctctgcggccatgggcattcgtcatgtgattgtcgattacgagggcgagtacacgcccatggtgcaggccttgggtggcgtcgtcattcgcttggatgagcattcgccctacaagttcaatccgttcgagctcgaagaggaagaagaaaagcaggcggacgggacaatccggcgctttgtggacgtgaaagagaagatcagcgacatggagcgcctgattgtcagcatggcgcatctgcatgccggccacgatctcctcgactcgtacacgcgaaacgcgattaacgacatgctccaggagctgtacgagcgggatttcgggttcacgtccgacccggagagtttgtatgagcggcatgagacgtggcagcgggacgcaaagggagacaggcttgtccggcgtgtcaaacggcctcagccgcgattctcggacttctacgtcaagcttgaagagcgggcggcgagtgattcccgcttggaagagttggcgatgcgcctgcgccggtttcgcgaaggcggaacggagggcatgttcgactgctactcgaatgtcgaactgcaagatgtgccggtcgtgagcttcgatctctcgcatctgccggagaagtccatggcccgcctcctcggcatgcaagtcgtgctcgagtggatcatggaaaaattcatcaagaagaacgtccatctgaagaagcgcgtggttattgacgaagcgcaaaagatgctcgagcatctctatcacgcgatcttcatggaggacgtcttccggcgtatccgcaagcgttcgggttccgcggtggctgccagccaggacttccgcaagttcgcggagagcgagcagggccgggcgatcctgcaaaactctgacacgaagattctgctccgtcaggacaagctcgacaaggaagcggtcatcgagaacttcggccttgaagagcacgagttcgaagagctcatcgcattccgcgatgggcaagcccgttggtgggtcggtggcgaggtgttctacaaccagctcattccgttcgcggatgaattcgagcttttcacgacgcggtttgtgcagtcggatgcggaactcgccatgcagcggaggtggctcgcgtga

SEQ ID NO: 224 - protein, 584 aa, Thermoanaerobacter tengcongensis
KKKKQKTEKQKENNFHDPFNHVSDIKQIIASDGIYVDRNYMQINDKYVRIYYFTDYPASVNIGWLEDLKLFSNANISIHVYPETNANAVKRLTTKITQLQSQLMLDEEEGNIAELGILQRASESLEALRENIQMNRDKLFYVTIVIAVYGDSLAELEHNSKTLEEVLASKSIKARSAIFRQEQGFKSLVPTAENYLADSSRNFNVGAAISLFPFASPEYSHRQGIPVGINLFTGSPVIFDPFIGPPVLPNANIAVFAQAGAGKSFMMKLLALRSALLGVRTVFIDPEGEYKPVVDRVGGVHIKLEPNCKHIINPFDIEVDVDDEGIEFIDLLQKANEIKGLVSMIIEKISKTPLTAYELSLIEETILEEYRARGITRNPESLYEQSTQEIDGKYYIGTRQKQMPTLSSFTKRLSEKPGGEKLAQILKPYLKGGTMGLFDGQSNVDLKDALLISFDVSGIMDEFLKTYALYVVTNWVWEKFVKKNIKQKKFVIVDEAWMFMKYEHTANFLENLARRARKRNTSLTIASQSFMEFANSQQGRAVLTNAATVFLLRQSPTDIDAVQEVFHLSKGEREFLLSSGIGEA

SEQ ID NO: 225 - protein, 635 aa, Clostridium difficile
KKKKEKSTAKIIDFNKDDILNETNLLDKGIPSLKELISPSSFEVDADYIKIGKKYVRSFIMQGFPAQVYVGWLDSIFNYEGETDTTIHIDPTDDKIALEEYTRKITQFEAQLMSEQEKGNIRNITRLRDKIQELYMERSKLERNTDKLFQVQIACNLYSDSLDELNKETQKIDNKLRGRKMYMMPTYLRQDDTYKTVSPYGKSYVEDMFRNFNSGALTSCFPFYNSDIRHEKGVFCGINLSTCSPILIDFYDRSKLKNSNITVIGQPGTGKTFFVSLLTMRSALRGIRTVIIDPESEYGRLTEALGGSRIYLATDSKECINPFDIEEEDELDENFLPTGIKLVDVKGKIADLLNLIAVMAGGLSGAQTSTVAQLLQELYESFGITKNPKSLYVTEPYFDKNTKEFIHEGRKKTMPIFSDFYNSLSEYAEKNSDIEVMDLVRVLKMFKKGGVYDLFDCYTSSNISNFKNSPIVTFDVSKLEENILRPIGMYVALSWTWEKFGKKDPYINKRIVCDEAWMLVSKNMAGSEYSAKFLETASRRIRKRMGGLLVASQKFTEFVESTQGQAVLTSAETKIFLGQDTTDIDSIQNMFKLSEGEKLFLLRADKGEMLVRIQGESTVVKVLAFDFEKKLIEKR

SEQ ID NO: 226 - protein, 586 aa, Thermoanaerobacter  X514
LKLKKNKEEAVKEEPELFEKVPTVVEVISSDGYLIEKDYIRVGKKFYRLYVLTDFPQAVYVGWLEDIKLLGNVDVSVHLTPVDARDAVNQLTRKITQYQSQYMLDDQRGNIYELGILRKAVEDLERLRESIQMNRDKLYYVTAVVSVSADSVEELERSSKILEEVLAGKSIRARRMFLRQSEAFKSFVPILENHCEDLSRNFNSGAAASLFPFASPEFSHKKGIPLGINLFTGSPVIFDNFIGPPFMTNYNLGIFATSGAGKSFLIKLLSMRGALLGIKTVFVDPDGEYSRMVQKMGGSVVKISTETENIINPFDVEEEEDENEIRYVDIVQKIAEIKALVGMIVEGVMKDKISAEELAAVEEAVRDEYEARGINKSPESLYEKNIADSEEFYFKKKKEMPTLSSFVERLKKNPRGERIAAVMKPFLKGGTLGIFDGQTNVSLEDSYLVNFDVSEIRDRFLRTYAMYVITNWIWEKFVKKDVKQKKRVVVDEAWMFMKYKDTAYFLENLSRRARKRNTSLTVASQSFIEFSNSQEGKAVLTNSAAVFLMKQAATDIDSVQEVFHLSQGERDFLTSCGVGEALFLVG

SEQ ID NO: 227 - protein, 586 aa, Thermoanaerobacter pseudethanolicus
LKLKKNKEEAVKEEPELFEKVPTVVEVISPDGYLIEKDYIRVGKKFYRLYVLTDFPQAVYVGWLEDIKLLGNVDVSVHLTPVDARDAVNQLTRKITQYQSQYMLDDQRGNIYELGILRKAVEDLERLRESIQMNRDKLYYVTAVVSVSADSVEELERSSKILEEVLAGKSIRARRMFLRQSEAFKSFVPILENHCEDLSRNFNSGAAASLFPFASPEFSHKKGIPLGINLFTGSPVIFDNFIGPPFMTNYNLGIFATSGAGKSFLIKLLSMRGALLGIKTVFVDPDGEYNRMVQKMGGSVVKISTETENIINPFDVEEEEDENEIRYVDIVQKIAEIKALVGMIVEGVMKDKISAEELAAVEEAVRDEYEARGINKSPESLYEKNIADSEEFYFKKKKEMPTLSSFVERLKKNPRGERIAAVMKPFLKGGTLGIFDGQTNVSLEDSYLVNFDVSEIRDRFLRTYAMYVITNWIWEKFVKKDVKQKKRVVVDEAWMFMKYKDTAYFLENLSRRARKRNTSLTVASQSFIEFSNSQEGKAVLTNSAAVFLMKQAATDIDSVQEVFHLSQGERDFLTSCGVGEALFLVG

SEQ ID NO: 228 - protein, 588 aa, Caldicellulosiruptor saccharolyticus
EFAPDIYELILPDTFHEEADYIYLGAENYCRVYVLDIDYPSEMYVGFFDSLLDKGEIAISVFIEPRDTGQAIRDITRRINEMKSNAMLQRGEPDYKLLAQIEWYDALRASLQRGIEKILMAQVFIVVYSKSLEQLRENCIRITKFAESLGLNMRCLSFEQAKGYISCLPLGARNLKYIEKFRLMTTSATACLFPVGNTDITYEEGFYIGYNAITNSPVFYNQFDRSLPNPHMAIFGTTGAGKSTTMKTMLGRMAAYGYNICVLDPEREYEKIINKLGGKYIRIRPGEKLGINPFDVEIEEEEGKRFIDLNSKVADIRFILNIISEYYVGRRLDGVQMAIIERIVRKLYYDKGITSDPESLYTSARTDEKGRLIVGKIKKELPTLSELREELFKESETQALAKAMEVFVGEGSLSLFDCQTTIDADDKIIAFDLKEFERDNFLKFFASVNILSWIWNKFSNAKLKGQKKVVIFDEAWMFTRYQASAEYLEFISRKGRKYKISLMIASQTLLEFLQNDTGRAIINMCASKILMRQESDMAAQIAEFFRLSERTVEIITSAAQGQGIIINPREKIFIQVTPFDFEWEYVTT

SEQ ID NO: 229 - protein, 661 aa, Artificial
  Alicyclobacillus acidocaldarius mutated SEQ ID NO 222
MTLFARKKKKEKKRKRWSWLRAHLRRQKEKRVLAQDPSVIGEHAPTLHDLMTLADGIEMRASEIYVSPSGYTKTYYVTGLPSTVHFGYFQRFFRVGADVHISLHVEPADSAVAMAKRTKLMTKIEAEILAEQKAGTNKQIAFLQQEYQLLEKEREELRLGRERIFYATIILAVSSPNRQEFEAACERIEREGFEGFILREAFKEHDLGFRSVAPIGENALRHPIEMTASALANSFPFTNARFSHEYGVPIGVDWSSGHLNRYDAWHPKLVNANGVIIGKAGAGKSFLVKGLVARSAAMGIRHVIVDYEGEYTPMVQALGGVVIRLDEHSPYKFNPFELEEEEEKQADGTIRRFVDVKEKISDMERLIVSMAHLHAGHDLLDSYTRNAINDMLQELYERDFGFTSDPESLYERHETWQRDAKGDRLVRRVKRPQPRFSDFYVKLEERAASDSRLEELAMRLRRFREGGTEGMFDCYSNVELQDVPVVSFDLSHLPEKSMARLLGMQVVLEWIMEKFIKKNVHLKKRVVIDEAQKMLEHLYHAIFMEDVFRRIRKRSGSAVAASQDFRKFAESEQGRAILQNSDTKILLRQDKLDKEAVIENFGLEEHEFEELIAFRDGQARWWVGGEVFYNQLIPFADEFELFTTRFVQSDAELAMQRRWLA

SEQ ID NO: 230 - protein, 661 aa, Artificial
  Alicyclobacillus acidocaldarius mutated SEQ ID NO 222
MTLFARKKKKEKKRKRWSWLRAHLRRQKEKRVLAQDPSVIGEHAPTLHDLMTLADGIEMRASEIYVSPSGYTKTYYVTGLPSTVHFGYFQRFFRVGADVHISLHVEPADSAVAMAKRTKLMTKIEAEILAEQKAGTNKQIAFLQQEYQLLEKEREELRLGRERIFYATIILAVSSPNRQEFEAACERIEREGFEGFLLREAFKEHDLGFRSVAPIGENALRHPIEMTASALANSFPFTNARFSHEYGVPIGVDWSSGHLNRYDAWHPKLVNANGVIIGKAGAGKSFLVKGLVARSAAMGIRHVIVDYEGEYTPMVQALGGVVIRLDEHSPYKFNPFELEEEEEKQADGTIRRFVDVKEKISDMERLIVSMAHLHAGHDLLDSYTRNAINDMLQELYERDFGFTSDPESLYERHETWQKDAKGDRLVRRVKRPQPRFSDFYVKLEERAASDSRLEELAMRLRRFREGGTEGMFDCYSNVELQDVPVVSFDLSHLPEKSMARLLGMQVVLEWIMEKFIKKNVHLKKRVVIDEAQKMLEHLYHAIFMEDVFRRIRKRSGSAVAASQDFRKFAESEQGRAILQNSDTKILLRQDKLDKEAVIENFGLEEHEFEELIAFRDGQARWWVGGEVFYNQLIPFADEFELFTTRFVQSDAELAMQRRWLA

SEQ ID NO: 231 - protein, 661 aa, Artificial
  Alicyclobacillus acidocaldarius mutated SEQ ID NO 222
MTLFARKKKKEKKRKRWSWLRAHLRRQKEKRVLAQDPSVIGEHAPTLHDLMTLADGIEMRASEIYVSPSGYTKTYYVTGLPSTVHFGYFQRFFRVGADVHISLHVEPADSAVAMAKRTKLMTKIEAEILAEQKAGTNKQIAFLQQEYQLLEKERDELRLGRERIFYATIILAVSSPNRQEFEAACERIEREGFEGFLLREAFKEHDLGFRSVAPIGENALRHPIEMTASALANSFPFTNARFSHEYGVPIGVDWSSGHLNRYDAWHPKLVNANGVIIGKAGAGKSFLVKGLVARSAAMGIRHVIVDYEGEYTPMVQALGGVVIRLDEHSPYKFNPFELEEEEEKQADGTIRRFVDVKEKISDMERLIVSMAHLHAGHDLLDSYTRNAINDMLQELYERDFGFTSDPESLYERHETWQRDAKGDRLVRRVKRPQPRFSDFYVKLEERAASDSRLEELAMRLRRFREGGTEGMFDCYSNVELQDVPVVSFDLSHLPEKSMARLLGMQVVLEWIMEKFIKKNVHLKKRVVIDEAQKMLEHLYHAIFMEDVFRRIRKRSGSAVAASQDFRKFAESEQGRAILQNSDTKILLRQDKLDKEAVIENFGLEEHEFEELIAFRDGQARWWVGGEVFYNQLIPFADEFELFTTRFVQSDAELAMQRRWLA

SEQ ID NO: 232 - protein, 661 aa, Artificial
  Alicyclobacillus acidocaldarius mutated SEQ ID NO 222
MTLFARKKKKEKKRKRWSWLRAHLRRQKEKRVLAQDPSVIGEHAPTLHDLMTLADGIEMRASEIYVSPSGYTKTYYVTGLPSTVHFGYFQRFFRVGADVHISLHVEPADSAVAMAKRTKLMTKIEAEILAEQKAGTNKQIAFLQQEYQLLEKEREELRLGRERIFYATIILAVSSPNRQEFEAACERIEREGFEGFLLREAFKEHDLGFRSVAPIGENALRHPIEMTASALANSFPFTNARFSHEYGVPIGVDWSSGHLNRYDAWHPKLVNANGVIIGKAGAGKSFLVKGLVARSAAMGIRHVIVDYEGEYTPMVQALGGVVIRLDEHSPYKFNPFELEEEEEKQADGTIRRFVDVKEKISDMERLIVSMAHLHAGHDLLDSYTRQAINDMLQELYERDFGFTSDPESLYERHETWQRDAKGDRLVRRVKRPQPRFSDFYVKLEERAASDSRLEELAMRLRRFREGGTEGMFDCYSNVELQDVPVVSFDLSHLPEKSMARLLGMQVVLEWIMEKFIKKNVHLKKRVVIDEAQKMLEHLYHAIFMEDVFRRIRKRSGSAVAASQDFRKFAESEQGRAILQNSDTKILLRQDKLDKEAVIENFGLEEHEFEELIAFRDGQARWWVGGEVFYNQLIPFADEFELFTTRFVQSDAELAMQRRWLA

SEQ ID NO: 233 - protein, 661 aa, Artificial
  Alicyclobacillus acidocaldarius mutated SEQ ID NO 222
MTLFARKKKKEKKRKRWSWLRAHLRRQKEKRVLAQDPSVIGEHAPTLHDLMTLADGIEMRASEIYVSPSGYTKTYYVTGLPSTVHFGYFQRFFRVGADVHISLHVEPADSAVAMAKRTKLMTKIEAEILAEQKAGTNKQIAFLQQEYQLLEKEREELRLGRERIFYATIILAVSSPNRQEFEAACERIEREGFEGFLLREAFKEHDLGFRSVAPIGENALRHPIEMTASALANSFPFTNARFSHEYGVPIGVDWSSGHLNRYDAWHPKLVNANGVIIGKAGAGKSFLVKGLVARSAAMGIRHVIVDYEGEYTPMVQALGGVVIRLDEHSPYKFNPFELEEEEEKQADGTIRRFVDVKEKISDMERLIVSMAHLHAGHDLLDSYTRNAINDMLQELYERDFGFTSDPESLYERHETWQRDAKGDRLVRRVKRPQPKFSDFYVKLEERAASDSRLEELAMRLRRFREGGTEGMFDCYSNVELQDVPVVSFDLSHLPEKSMARLLGMQVVLEWIMEKFIKKNVHLKKRVVIDEAQKMLEHLYHAIFMEDVFRRIRKRSGSAVAASQDFRKFAESEQGRAILQNSDTKILLRQDKLDKEAVIENFGLEEHEFEELIAFRDGQARWWVGGEVFYNQLIPFADEFELFTTRFVQSDAELAMQRRWLA

SEQ ID NO: 234 - DNA, 1986 bp, Artificial
  Alicyclobacillus acidocaldarius mutated SEQ ID NO 223
gtgaccttgttcgcacgcaagaagaagaaggaaaagaagcgtaagcgctggtcttggctgcgagcacatttgcgacgccaaaaggagaaacgcgttctcgcgcaagatccgagcgtcattggggagcacgcaccaacactccacgatctcatgacgctcgctgacgggatcgagatgcgcgcgagtgagatttacgtgtcgccaagcggatacacgaagacatactacgtgacggggttgccttccaccgtccatttcgggtactttcagcgcttcttccgcgttggagcggacgtgcacatttccttgcacgttgaacctgcggattccgcagtggctatggccaagcggacgaagctcatgaccaaaatcgaggccgaaatccttgcagagcaaaaggcgggcaccaataagcagattgcgttcctgcaacaggagtatcaattgctcgaaaaagagcgcgaagaactgcggcttggccgcgagcgcatcttttatgccaccatcatcttggcagtcagttcgccgaatcgacaggagttcgaggccgcctgtgagcggattgagcgtgaaggcttcgaggggttcattctgcgtgaggccttcaaagaacatgacctcggctttcgctcagtcgccccgattggcgaaaacgcccttcgtcatcccatcgagatgaccgcaagtgccttggcaaacagctttccgttcaccaatgcacgcttctcacatgagtacggcgtaccgattggcgtcgactggtcaagcggtcacttgaatcgctacgatgcctggcacccgaagcttgtcaacgccaatggggtgatcatcggcaaggcgggcgcgggcaagagcttcttggtgaaaggtctcgtggcccgctctgcggccatgggcattcgtcatgtgattgtcgattacgagggcgagtacacgcccatggtgcaggccttgggtggcgtcgtcattcgcttggatgagcattcgccctacaagttcaatccgttcgagctcgaagaggaagaagaaaagcaggcggacgggacaatccggcgctttgtggacgtgaaagagaagatcagcgacatggagcgcctgattgtcagcatggcgcatctgcatgccggccacgatctcctcgactcgtacacgcgaaacgcgattaacgacatgctccaggagctgtacgagcgggatttcgggttcacgtccgacccggagagtttgtatgagcggcatgagacgtggcagcgggacgcaaagggagacaggcttgtccggcgtgtcaaacggcctcagccgcgattctcggacttctacgtcaagcttgaagagcgggcggcgagtgattcccgcttggaagagttggcgatgcgcctgcgccggtttcgcgaaggcggaacggagggcatgttcgactgctactcgaatgtcgaactgcaagatgtgccggtcgtgagcttcgatctctcgcatctgccggagaagtccatggcccgcctcctcggcatgcaagtcgtgctcgagtggatcatggaaaaattcatcaagaagaacgtccatctgaagaagcgcgtggttattgacgaagcgcaaaagatgctcgagcatctctatcacgcgatcttcatggaggacgtcttccggcgtatccgcaagcgttcgggttccgcggtggctgccagccaggacttccgcaagttcgcggagagcgagcagggccgggcgatcctgcaaaactctgacacgaagattctgctccgtcaggacaagctcgacaaggaagcggtcatcgagaacttcggccttgaagagcacgagttcgaagagctcatcgcattccgcgatgggcaagcccgttggtgggtcggtggcgaggtgttctacaaccagctcattccgttcgcggatgaattcgagcttttcacgacgcggtttgtgcagtcggatgcggaactcgccatgcagcggaggtggctcgcgtga

SEQ ID NO: 235 - DNA, 1986 bp, Artificial
  Alicyclobacillus acidocaldarius mutated SEQ ID NO 223
gtgaccttgttcgcacgcaagaagaagaaggaaaagaagcgtaagcgctggtcttggctgcgagcacatttgcgacgccaaaaggagaaacgcgttctcgcgcaagatccgagcgtcattggggagcacgcaccaacactccacgatctcatgacgctcgctgacgggatcgagatgcgcgcgagtgagatttacgtgtcgccaagcggatacacgaagacatactacgtgacggggttgccttccaccgtccatttcgggtactttcagcgcttcttccgcgttggagcggacgtgcacatttccttgcacgttgaacctgcggattccgcagtggctatggccaagcggacgaagctcatgaccaaaatcgaggccgaaatccttgcagagcaaaaggcgggcaccaataagcagattgcgttcctgcaacaggagtatcaattgctcgaaaaagagcgcgaagaactgcggcttggccgcgagcgcatcttttatgccaccatcatcttggcagtcagttcgccgaatcgacaggagttcgaggccgcctgtgagcggattgagcgtgaaggcttcgaggggttcttgctgcgtgaggccttcaaagaacatgacctcggctttcgctcagtcgccccgattggcgaaaacgcccttcgtcatcccatcgagatgaccgcaagtgccttggcaaacagctttccgttcaccaatgcacgcttctcacatgagtacggcgtaccgattggcgtcgactggtcaagcggtcacttgaatcgctacgatgcctggcacccgaagcttgtcaacgccaatggggtgatcatcggcaaggcgggcgcgggcaagagcttcttggtgaaaggtctcgtggcccgctctgcggccatgggcattcgtcatgtgattgtcgattacgagggcgagtacacgcccatggtgcaggccttgggtggcgtcgtcattcgcttggatgagcattcgccctacaagttcaatccgttcgagctcgaagaggaagaagaaaagcaggcggacgggacaatccggcgctttgtggacgtgaaagagaagatcagcgacatggagcgcctgattgtcagcatggcgcatctgcatgccggccacgatctcctcgactcgtacacgcgaaacgcgattaacgacatgctccaggagctgtacgagcgggatttcgggttcacgtccgacccggagagtttgtatgagcggcatgagacgtggcagaaagacgcaaagggagacaggcttgtccggcgtgtcaaacggcctcagccgcgattctcggacttctacgtcaagcttgaagagcgggcggcgagtgattcccgcttggaagagttggcgatgcgcctgcgccggtttcgcgaaggcggaacggagggcatgttcgactgctactcgaatgtcgaactgcaagatgtgccggtcgtgagcttcgatctctcgcatctgccggagaagtccatggcccgcctcctcggcatgcaagtcgtgctcgagtggatcatggaaaaattcatcaagaagaacgtccatctgaagaagcgcgtggttattgacgaagcgcaaaagatgctcgagcatctctatcacgcgatcttcatggaggacgtcttccggcgtatccgcaagcgttcgggttccgcggtggctgccagccaggacttccgcaagttcgcggagagcgagcagggccgggcgatcctgcaaaactctgacacgaagattctgctccgtcaggacaagctcgacaaggaagcggtcatcgagaacttcggccttgaagagcacgagttcgaagagctcatcgcattccgcgatgggcaagcccgttggtgggtcggtggcgaggtgttctacaaccagctcattccgttcgcggatgaattcgagcttttcacgacgcggtttgtgcagtcggatgcggaactcgccatgcagcggaggtggctcgcgtga

SEQ ID NO: 236 - DNA, 1986 bp, Artificial
  Alicyclobacillus acidocaldarius mutated SEQ ID NO 223
gtgaccttgttcgcacgcaagaagaagaaggaaaagaagcgtaagcgctggtcttggctgcgagcacatttgcgacgccaaaaggagaaacgcgttctcgcgcaagatccgagcgtcattggggagcacgcaccaacactccacgatctcatgacgctcgctgacgggatcgagatgcgcgcgagtgagatttacgtgtcgccaagcggatacacgaagacatactacgtgacggggttgccttccaccgtccatttcgggtactttcagcgcttcttccgcgttggagcggacgtgcacatttccttgcacgttgaacctgcggattccgcagtggctatggccaagcggacgaagctcatgaccaaaatcgaggccgaaatccttgcagagcaaaaggcgggcaccaataagcagattgcgttcctgcaacaggagtatcaattgctcgaaaaagagcgcgatgaactgcggcttggccgcgagcgcatcttttatgccaccatcatcttggcagtcagttcgccgaatcgacaggagttcgaggccgcctgtgagcggattgagcgtgaaggcttcgaggggttcttgctgcgtgaggccttcaaagaacatgacctcggctttcgctcagtcgccccgattggcgaaaacgcccttcgtcatcccatcgagatgaccgcaagtgccttggcaaacagctttccgttcaccaatgcacgcttctcacatgagtacggcgtaccgattggcgtcgactggtcaagcggtcacttgaatcgctacgatgcctggcacccgaagcttgtcaacgccaatggggtgatcatcggcaaggcgggcgcgggcaagagcttcttggtgaaaggtctcgtggcccgctctgcggccatgggcattcgtcatgtgattgtcgattacgagggcgagtacacgcccatggtgcaggccttgggtggcgtcgtcattcgcttggatgagcattcgccctacaagttcaatccgttcgagctcgaagaggaagaagaaaagcaggcggacgggacaatccggcgctttgtggacgtgaaagagaagatcagcgacatggagcgcctgattgtcagcatggcgcatctgcatgccggccacgatctcctcgactcgtacacgcgaaacgcgattaacgacatgctccaggagctgtacgagcgggatttcgggttcacgtccgacccggagagtttgtatgagcggcatgagacgtggcagcgggacgcaaagggagacaggcttgtccggcgtgtcaaacggcctcagccgcgattctcggacttctacgtcaagcttgaagagcgggcggcgagtgattcccgcttggaagagttggcgatgcgcctgcgccggtttcgcgaaggcggaacggagggcatgttcgactgctactcgaatgtcgaactgcaagatgtgccggtcgtgagcttcgatctctcgcatctgccggagaagtccatggcccgcctcctcggcatgcaagtcgtgctcgagtggatcatggaaaaattcatcaagaagaacgtccatctgaagaagcgcgtggttattgacgaagcgcaaaagatgctcgagcatctctatcacgcgatcttcatggaggacgtcttccggcgtatccgcaagcgttcgggttccgcggtggctgccagccaggacttccgcaagttcgcggagagcgagcagggccgggcgatcctgcaaaactctgacacgaagattctgctccgtcaggacaagctcgacaaggaagcggtcatcgagaacttcggccttgaagagcacgagttcgaagagctcatcgcattccgcgatgggcaagcccgttggtgggtcggtggcgaggtgttctacaaccagctcattccgttcgcggatgaattcgagcttttcacgacgcggtttgtgcagtcggatgcggaactcgccatgcagcggaggtggctcgcgtga

SEQ ID NO: 237 - DNA, 1986 bp, Artificial
  Alicyclobacillus acidocaldarius mutated SEQ ID NO 223
gtgaccttgttcgcacgcaagaagaagaaggaaaagaagcgtaagcgctggtcttggctgcgagcacatttgcgacgccaaaaggagaaacgcgttctcgcgcaagatccgagcgtcattggggagcacgcaccaacactccacgatctcatgacgctcgctgacgggatcgagatgcgcgcgagtgagatttacgtgtcgccaagcggatacacgaagacatactacgtgacggggttgccttccaccgtccatttcgggtactttcagcgcttcttccgcgttggagcggacgtgcacatttccttgcacgttgaacctgcggattccgcagtggctatggccaagcggacgaagctcatgaccaaaatcgaggccgaaatccttgcagagcaaaaggcgggcaccaataagcagattgcgttcctgcaacaggagtatcaattgctcgaaaaagagcgcgaagaactgcggcttggccgcgagcgcatcttttatgccaccatcatcttggcagtcagttcgccgaatcgacaggagttcgaggccgcctgtgagcggattgagcgtgaaggcttcgaggggttcttgctgcgtgaggccttcaaagaacatgacctcggctttcgctcagtcgccccgattggcgaaaacgcccttcgtcatcccatcgagatgaccgcaagtgccttggcaaacagctttccgttcaccaatgcacgcttctcacatgagtacggcgtaccgattggcgtcgactggtcaagcggtcacttgaatcgctacgatgcctggcacccgaagcttgtcaacgccaatggggtgatcatcggcaaggcgggcgcgggcaagagcttcttggtgaaaggtctcgtggcccgctctgcggccatgggcattcgtcatgtgattgtcgattacgagggcgagtacacgcccatggtgcaggccttgggtggcgtcgtcattcgcttggatgagcattcgccctacaagttcaatccgttcgagctcgaagaggaagaagaaaagcaggcggacgggacaatccggcgctttgtggacgtgaaagagaagatcagcgacatggagcgcctgattgtcagcatggcgcatctgcatgccggccacgatctcctcgactcgtacacgcgacaagcgattaacgacatgctccaggagctgtacgagcgggatttcgggttcacgtccgacccggagagtttgtatgagcggcatgagacgtggcagcgggacgcaaagggagacaggcttgtccggcgtgtcaaacggcctcagccgcgattctcggacttctacgtcaagcttgaagagcgggcggcgagtgattcccgcttggaagagttggcgatgcgcctgcgccggtttcgcgaaggcggaacggagggcatgttcgactgctactcgaatgtcgaactgcaagatgtgccggtcgtgagcttcgatctctcgcatctgccggagaagtccatggcccgcctcctcggcatgcaagtcgtgctcgagtggatcatggaaaaattcatcaagaagaacgtccatctgaagaagcgcgtggttattgacgaagcgcaaaagatgctcgagcatctctatcacgcgatcttcatggaggacgtcttccggcgtatccgcaagcgttcgggttccgcggtggctgccagccaggacttccgcaagttcgcggagagcgagcagggccgggcgatcctgcaaaactctgacacgaagattctgctccgtcaggacaagctcgacaaggaagcggtcatcgagaacttcggccttgaagagcacgagttcgaagagctcatcgcattccgcgatgggcaagcccgttggtgggtcggtggcgaggtgttctacaaccagctcattccgttcgcggatgaattcgagcttttcacgacgcggtttgtgcagtcggatgcggaactcgccatgcagcggaggtggctcgcgtga

SEQ ID NO: 238 - DNA, 1986 bp, Artificial
  Alicyclobacillus acidocaldarius mutated SEQ ID NO 223
gtgaccttgttcgcacgcaagaagaagaaggaaaagaagcgtaagcgctggtcttggctgcgagcacatttgcgacgccaaaaggagaaacgcgttctcgcgcaagatccgagcgtcattggggagcacgcaccaacactccacgatctcatgacgctcgctgacgggatcgagatgcgcgcgagtgagatttacgtgtcgccaagcggatacacgaagacatactacgtgacggggttgccttccaccgtccatttcgggtactttcagcgcttcttccgcgttggagcggacgtgcacatttccttgcacgttgaacctgcggattccgcagtggctatggccaagcggacgaagctcatgaccaaaatcgaggccgaaatccttgcagagcaaaaggcgggcaccaataagcagattgcgttcctgcaacaggagtatcaattgctcgaaaaagagcgcgaagaactgcggcttggccgcgagcgcatcttttatgccaccatcatcttggcagtcagttcgccgaatcgacaggagttcgaggccgcctgtgagcggattgagcgtgaaggcttcgaggggttcttgctgcgtgaggccttcaaagaacatgacctcggctttcgctcagtcgccccgattggcgaaaacgcccttcgtcatcccatcgagatgaccgcaagtgccttggcaaacagctttccgttcaccaatgcacgcttctcacatgagtacggcgtaccgattggcgtcgactggtcaagcggtcacttgaatcgctacgatgcctggcacccgaagcttgtcaacgccaatggggtgatcatcggcaaggcgggcgcgggcaagagcttcttggtgaaaggtctcgtggcccgctctgcggccatgggcattcgtcatgtgattgtcgattacgagggcgagtacacgcccatggtgcaggccttgggtggcgtcgtcattcgcttggatgagcattcgccctacaagttcaatccgttcgagctcgaagaggaagaagaaaagcaggcggacgggacaatccggcgctttgtggacgtgaaagagaagatcagcgacatggagcgcctgattgtcagcatggcgcatctgcatgccggccacgatctcctcgactcgtacacgcgaaacgcgattaacgacatgctccaggagctgtacgagcgggatttcgggttcacgtccgacccggagagtttgtatgagcggcatgagacgtggcagcgggacgcaaagggagacaggcttgtccggcgtgtcaaacggcctcagccgaaattctcggacttctacgtcaagcttgaagagcgggcggcgagtgattcccgcttggaagagttggcgatgcgcctgcgccggtttcgcgaaggcggaacggagggcatgttcgactgctactcgaatgtcgaactgcaagatgtgccggtcgtgagcttcgatctctcgcatctgccggagaagtccatggcccgcctcctcggcatgcaagtcgtgctcgagtggatcatggaaaaattcatcaagaagaacgtccatctgaagaagcgcgtggttattgacgaagcgcaaaagatgctcgagcatctctatcacgcgatcttcatggaggacgtcttccggcgtatccgcaagcgttcgggttccgcggtggctgccagccaggacttccgcaagttcgcggagagcgagcagggccgggcgatcctgcaaaactctgacacgaagattctgctccgtcaggacaagctcgacaaggaagcggtcatcgagaacttcggccttgaagagcacgagttcgaagagctcatcgcattccgcgatgggcaagcccgttggtgggtcggtggcgaggtgttctacaaccagctcattccgttcgcggatgaattcgagcttttcacgacgcggtttgtgcagtcggatgcggaactcgccatgcagcggaggtggctcgcgtga

SEQ ID NO: 239 - protein, 260 aa, Alicyclobacillus acidocaldarius
MGSAVKFIVLGAALAVMLVILILRDQRKQQGQGRRSKRKVTPSLQEFLPIEGFHESGAVIVNGRFRRLIRVGDLNLYAMSMDEIVAVRERFKAMLMRLDNPFQISVQARRANYTDFVAYAESTIDESVKVYDNPAFTAYAEDLKTYLREEAMKPRTDRENLIVIGVLPKVGGEDEKLQLERLAREQSFVESGLSAMGLPYEVLEPVQVVEAVQNFWNRERAVSQRYRDAVRRRTHAPRVDGLDVEVSDLVRTQEEEGKEA

SEQ ID NO: 240 - DNA, 783 bp, Alicyclobacillus acidocaldarius
gtggggagcgcggtgaagttcatcgtactgggcgcagcccttgcggtcatgttggtcatcctcatcctgcgggatcagcgtaagcagcaaggacaaggacggcgaagcaaacgaaaggtcacaccgtcgcttcaggagttcttgcccatcgagggatttcatgagtcgggtgcggtcatcgtgaatggacgttttcggcggctgattcgcgtgggagatctcaacctgtacgccatgtcgatggacgaaatcgtggcggtgcgcgaacggtttaaggcgatgctcatgcgtctcgacaatccgttccagatttccgtccaggcacggcgcgcaaattacacggatttcgtcgcgtacgccgaatcgacgattgatgagtccgtcaaggtctacgacaatccggccttcacggcgtacgcggaggacttgaagacgtatctgcgggaggaagccatgaagcctcgcacggaccgtgagaatctcatcgtgatcggcgtgttgccgaaagtcggtggggaggacgaaaaactgcaactcgagcgcttggcacgggaacagtccttcgtcgagtctggactgtctgcgatgggattgccgtatgaggtgcttgagccggtgcaagtggtcgaggcggtacagaacttctggaaccgggagcgggccgtaagtcagcgttatcgcgatgcggtgagacgccggacacacgcgccgcgggtggacggcctcgacgtggaggtgagtgaccttgttcgcacgcaagaagaagaaggaaaagaagcgtaa

SEQ ID NO: 241 - protein, 207 aa, Streptococcus agalactiae
LNLLMKPKTSSKQKKEKTKKREVLPTTLNTLAYQGLFPNGLMQVSPDYFSQSYLLGDVNYQTVGLEEKEAIVEKYSNLINSLDDKTNFQLTIFNKKVNLEQFRKSVLYPLQEDGFDSYREELNRMMDSNLEAGENNFSAVKLISFGKSDQAPKLAYRSLSQIGEYFKSGLSEIEASFTLLTGEERVNNLADMLRGENHLPFTYKDLV

SEQ ID NO: 242 - protein, 139 aa, Coccidioides immitis
QVRRAVVTAFMKHAQRQLEEGVSAGEAIKQLLTKYKEMLARIVFDRETDEKPDQVDLLLLFQQDLVERSKGGTILLFVAKELYDLEIVEDEAFEQWWDNERSTATEALKKVRQQTQPFIDWMMTEESDEEESDEESGEE

SEQ ID NO: 243 - protein, 189 aa, Streptococcus pneumoniae
KEEVLPSTANTLSYQALYQNGLMQVKEDYFSQSYLLGDVNYQTVGLEDKGAIIEKYSDLIKSLDDQTNFQLTIFNKRLNLEKFRHSVLYEEKEDGYDSYRKELNRMMNQNLDSGENNFSAVKLISFGRKDSNPKQAYRSLSQIGEYFKSGFSEIDARFESLAGEERVNLLADMLRGEHHLPFSYRDLTR

SEQ ID NO: 244 - protein, 189 aa, Streptococcus suis
KAQKQEIKPSTVNTLAYQGLFQNGLMQVSPSYFSQTYLLGDVNYQTVGLDDKGAIVEKYSDLINSLDDKTNFQLTIFNQKVNLEKFRKSILYPLQEDGFDAYRDELNRMMDANLEAGENNFSAVKFLSFGKSDQTPKLAFRSLSQIGEYFKSGFSEIDVSLGLLGGEERVNVLADMLRGENHLPFSYKD

SEQ ID NO: 245 - protein, 189 aa, Streptococcus dysgalactiae
KTQKQEISPSTVNTLAYQGLFQNGLMQVSPSYFSQTYLLGDVNYQTVGLDDKGAIVEKYSDLINSLDDKTNFQLTIFNQKVNLEKFRKSILYPLQEDGFDTYRDELNRMMDANLEAGENNFSAVKFLSFGKSDQTPKLAFRSLSQIGEYFKSGFSEIDVSLGLLGGEERVNVLADMLRGENHLPFSYKD

SEQ ID NO: 246 - protein, 260 aa, Artificial
  Alicyclobacillus acidocaldarius mutated SEQ ID NO 239
MGSAVKFIVLGAALAVMLVILILRDQRKQQGQGRRSKRKVTPSLQEFLPIEGFHESGAVIVNGRFRRLIRVGDLNLYAMSMDEIVAVRERFKAMLMRLDNPFQISVQARRANYTEFVAYAESTIDESVKVYDNPAFTAYAEDLKTYLREEAMKPRTDRENLIVIGVLPKVGGEDEKLQLERLAREQSFVESGLSAMGLPYEVLEPVQVVEAVQNFWNRERAVSQRYRDAVRRRTHAPRVDGLDVEVSDLVRTQEEEGKEA

SEQ ID NO: 247 - protein, 260 aa, Artificial
  Alicyclobacillus acidocaldarius mutated SEQ ID NO 239
MGSAVKFIVLGAALAVMLVILILRDQRKQQGQGRRSKRKVTPSLQEFLPIEGFHESGAVIVNGRFRRLIRVGDLNLYAMSMDEIVAVRERFKAMLMRLDNPFQISVQARRANYTDFVAYAESTIDESVKVYDNPAFTAYAEDLKTYLREEAMKPRTDRENLIVIGVLPKVGGEDEKLQLERLAREQSFVESGLSAMGLPYEVLEPVQVVEAVQNFWNRERAVSQRYRDAVRRRTHAPRVEGLDVEVSDLVRTQEEEGKEA

SEQ ID NO: 248 - protein, 260 aa, Artificial
  Alicyclobacillus acidocaldarius mutated SEQ ID NO 239
MGSAVKFIVLGAALAVMLVILILRDQRKQQGQGRRSKRKVTPSLQEFLPIEGFHESGAVIVNGRFRRLIRVGDLNLYAMSMDEIVAVRERFKAMLMRLDNPFQISVQARRANYTDFVAYAESTIDESVKVYDNPAFTAYAEDLKTYLREEAMKPRTDRENLIVIGVLPKVGGEDEKLQLERLAREQSFVESGLSAMGLPYEVLEPVQVVEAVQNFWNRERAVSQKYRDAVRRRTHAPRVDGLDVEVSDLVRTQEEEGKEA

SEQ ID NO: 249 - protein, 260 aa, Artificial
  Alicyclobacillus acidocaldarius mutated SEQ ID NO 239
MGSAVKFIVLGAALAVMLVILILRDQRKQQGQGRRSRRKVTPSLQEFLPIEGFHESGAVIVNGRFRRLIRVGDLNLYAMSMDEIVAVRERFKAMLMRLDNPFQISVQARRANYTDFVAYAESTIDESVKVYDNPAFTAYAEDLKTYLREEAMKPRTDRENLIVIGVLPKVGGEDEKLQLERLAREQSFVESGLSAMGLPYEVLEPVQVVEAVQNFWNRERAVSQRYRDAVRRRTHAPRVDGLDVEVSDLVRTQEEEGKEA

SEQ ID NO: 250 - protein, 260 aa, Artificial
  Alicyclobacillus acidocaldarius mutated SEQ ID NO 239
MGSAVKFIVLGAALAVMLVILILRDQRKQQGQGRRSKRKVTPSLQEFLPIEGFHESGAVIVNGRFRRLIRVGDLNLYAMSMDEIVAVRERFKAMLMRLDNPFQLSVQARRANYTDFVAYAESTIDESVKVYDNPAFTAYAEDLKTYLREEAMKPRTDRENLIVIGVLPKVGGEDEKLQLERLAREQSFVESGLSAMGLPYEVLEPVQVVEAVQNFWNRERAVSQRYRDAVRRRTHAPRVDGLDVEVSDLVRTQEEEGKEA

SEQ ID NO: 251 - DNA, 783 bp, Artificial
  Alicyclobacillus acidocaldarius mutated SEQ ID NO 240
gtggggagcgcggtgaagttcatcgtactgggcgcagcccttgcggtcatgttggtcatcctcatcctgcgggatcagcgtaagcagcaaggacaaggacggcgaagcaaacgaaaggtcacaccgtcgcttcaggagttcttgcccatcgagggatttcatgagtcgggtgcggtcatcgtgaatggacgttttcggcggctgattcgcgtgggagatctcaacctgtacgccatgtcgatggacgaaatcgtggcggtgcgcgaacggtttaaggcgatgctcatgcgtctcgacaatccgttccagatttccgtccaggcacggcgcgcaaattacacggaattcgtcgcgtacgccgaatcgacgattgatgagtccgtcaaggtctacgacaatccggccttcacggcgtacgcggaggacttgaagacgtatctgcgggaggaagccatgaagcctcgcacggaccgtgagaatctcatcgtgatcggcgtgttgccgaaagtcggtggggaggacgaaaaactgcaactcgagcgcttggcacgggaacagtccttcgtcgagtctggactgtctgcgatgggattgccgtatgaggtgcttgagccggtgcaagtggtcgaggcggtacagaacttctggaaccgggagcgggccgtaagtcagcgttatcgcgatgcggtgagacgccggacacacgcgccgcgggtggacggcctcgacgtggaggtgagtgaccttgttcgcacgcaagaagaagaaggaaaagaagcgtaa

SEQ ID NO: 252 - DNA, 783 bp, Artificial
  Alicyclobacillus acidocaldarius mutated SEQ ID NO 240
gtggggagcgcggtgaagttcatcgtactgggcgcagcccttgcggtcatgttggtcatcctcatcctgcgggatcagcgtaagcagcaaggacaaggacggcgaagcaaacgaaaggtcacaccgtcgcttcaggagttcttgcccatcgagggatttcatgagtcgggtgcggtcatcgtgaatggacgttttcggcggctgattcgcgtgggagatctcaacctgtacgccatgtcgatggacgaaatcgtggcggtgcgcgaacggtttaaggcgatgctcatgcgtctcgacaatccgttccagatttccgtccaggcacggcgcgcaaattacacggatttcgtcgcgtacgccgaatcgacgattgatgagtccgtcaaggtctacgacaatccggccttcacggcgtacgcggaggacttgaagacgtatctgcgggaggaagccatgaagcctcgcacggaccgtgagaatctcatcgtgatcggcgtgttgccgaaagtcggtggggaggacgaaaaactgcaactcgagcgcttggcacgggaacagtccttcgtcgagtctggactgtctgcgatgggattgccgtatgaggtgcttgagccggtgcaagtggtcgaggcggtacagaacttctggaaccgggagcgggccgtaagtcagcgttatcgcgatgcggtgagacgccggacacacgcgccgcgggtggaaggcctcgacgtggaggtgagtgaccttgttcgcacgcaagaagaagaaggaaaagaagcgtaa

SEQ ID NO: 253 - DNA, 783 bp, Artificial
  Alicyclobacillus acidocaldarius mutated SEQ ID NO 240
gtggggagcgcggtgaagttcatcgtactgggcgcagcccttgcggtcatgttggtcatcctcatcctgcgggatcagcgtaagcagcaaggacaaggacggcgaagcaaacgaaaggtcacaccgtcgcttcaggagttcttgcccatcgagggatttcatgagtcgggtgcggtcatcgtgaatggacgttttcggcggctgattcgcgtgggagatctcaacctgtacgccatgtcgatggacgaaatcgtggcggtgcgcgaacggtttaaggcgatgctcatgcgtctcgacaatccgttccagatttccgtccaggcacggcgcgcaaattacacggatttcgtcgcgtacgccgaatcgacgattgatgagtccgtcaaggtctacgacaatccggccttcacggcgtacgcggaggacttgaagacgtatctgcgggaggaagccatgaagcctcgcacggaccgtgagaatctcatcgtgatcggcgtgttgccgaaagtcggtggggaggacgaaaaactgcaactcgagcgcttggcacgggaacagtccttcgtcgagtctggactgtctgcgatgggattgccgtatgaggtgcttgagccggtgcaagtggtcgaggcggtacagaacttctggaaccgggagcgggccgtaagtcagaaatatcgcgatgcggtgagacgccggacacacgcgccgcgggtggacggcctcgacgtggaggtgagtgaccttgttcgcacgcaagaagaagaaggaaaagaagcgtaa

SEQ ID NO: 254 - DNA, 783 bp, Artificial
  Alicyclobacillus acidocaldarius mutated SEQ ID NO 240
gtggggagcgcggtgaagttcatcgtactgggcgcagcccttgcggtcatgttggtcatcctcatcctgcgggatcagcgtaagcagcaaggacaaggacggcgaagccgtcgaaaggtcacaccgtcgcttcaggagttcttgcccatcgagggatttcatgagtcgggtgcggtcatcgtgaatggacgttttcggcggctgattcgcgtgggagatctcaacctgtacgccatgtcgatggacgaaatcgtggcggtgcgcgaacggtttaaggcgatgctcatgcgtctcgacaatccgttccagatttccgtccaggcacggcgcgcaaattacacggatttcgtcgcgtacgccgaatcgacgattgatgagtccgtcaaggtctacgacaatccggccttcacggcgtacgcggaggacttgaagacgtatctgcgggaggaagccatgaagcctcgcacggaccgtgagaatctcatcgtgatcggcgtgttgccgaaagtcggtggggaggacgaaaaactgcaactcgagcgcttggcacgggaacagtccttcgtcgagtctggactgtctgcgatgggattgccgtatgaggtgcttgagccggtgcaagtggtcgaggcggtacagaacttctggaaccgggagcgggccgtaagtcagcgttatcgcgatgcggtgagacgccggacacacgcgccgcgggtggacggcctcgacgtggaggtgagtgaccttgttcgcacgcaagaagaagaaggaaaagaagcgtaa

SEQ ID NO: 255 - DNA, 783 bp, Artificial
  Alicyclobacillus acidocaldarius mutated SEQ ID NO 240
gtggggagcgcggtgaagttcatcgtactgggcgcagcccttgcggtcatgttggtcatcctcatcctgcgggatcagcgtaagcagcaaggacaaggacggcgaagcaaacgaaaggtcacaccgtcgcttcaggagttcttgcccatcgagggatttcatgagtcgggtgcggtcatcgtgaatggacgttttcggcggctgattcgcgtgggagatctcaacctgtacgccatgtcgatggacgaaatcgtggcggtgcgcgaacggtttaaggcgatgctcatgcgtctcgacaatccgttccagttatccgtccaggcacggcgcgcaaattacacggatttcgtcgcgtacgccgaatcgacgattgatgagtccgtcaaggtctacgacaatccggccttcacggcgtacgcggaggacttgaagacgtatctgcgggaggaagccatgaagcctcgcacggaccgtgagaatctcatcgtgatcggcgtgttgccgaaagtcggtggggaggacgaaaaactgcaactcgagcgcttggcacgggaacagtccttcgtcgagtctggactgtctgcgatgggattgccgtatgaggtgcttgagccggtgcaagtggtcgaggcggtacagaacttctggaaccgggagcgggccgtaagtcagcgttatcgcgatgcggtgagacgccggacacacgcgccgcgggtggacggcctcgacgtggaggtgagtgaccttgttcgcacgcaagaagaagaaggaaaagaagcgtaa

SEQ ID NO: 256 - protein, 116 aa, Alicyclobacillus acidocaldarius
MLEVHSPIPMTEGETLVFGIRTKHIAHFSIGVCLTAPMAALAWFLLPLLHEPKLLVLFLWGGAGVVFAKVPVANRPLAEWLWLSFRYARRPKLILYDREFRIRVHRKRAAERWGAR

SEQ ID NO: 257 - DNA, 351 bp, Alicyclobacillus acidocaldarius
atgctggaggttcattcgccgattcccatgaccgaaggagaaacgctcgtctttggtattcgcaccaagcacatcgcgcacttttccatcggggtctgtctcacggccccgatggctgcgcttgcgtggtttctcctgccgcttctccatgagcccaaacttcttgtgctcttcttgtggggaggggcaggcgttgtcttcgcgaaggtgccggtcgccaatcggccccttgccgagtggctgtggctctcgttccgttacgccagacggcccaagctcattctctatgaccgtgagttccggattcgcgtccatcgcaagcgcgcggcggaaaggtggggagcgcggtga

SEQ ID NO: 258 - protein, 71 aa, Bradyrhizobium ORS278
LPIVEGVTTVFGVRTPRNEYFTAVICWVAIGLLWFLVNRTRRGKAVMAASMNPRGVTLLGIELSSIYLTVW

SEQ ID NO: 259 - protein, 71 aa, Bradyrhizobium  BTAi1
LPIVEGVTTVFGVRTPRNEYFTAVICWVAIGLLWFLVNRTRRGKSVMAASMNPRGVTLLGIELSSIYLTVW

SEQ ID NO: 260 - protein, 85 aa, Carboxydothermus hydrogenoformans
VLPFYVSIPVLESLRLLFGGIGALAGFLFPVISGGLISAPVSVPLWHTPLLPVLFLINSFGVAFAAIPALFAPGSEILAFIFNLA

SEQ ID NO: 261 - protein, 57 aa, Citrobacter koseri
ILIGVLAGYALSFAMGVVDTAPIAEAHWFALPTFYTPRFEWFAILTILPAALVVIAE

SEQ ID NO: 262 - protein, 94 aa, Anaeromyxobacter dehalogenans
APILFSGGRPLAADLSDAVGRFGLAPLVAAAGAAALRARWRAAPERRPEVLLLATWGGLAFALALARNRFDVYAAAPLAVWCWLGLRHVQASRL

SEQ ID NO: 263 - protein, 116 aa, Artificial
  Alicyclobacillus acidocaldarius mutated SEQ ID NO 256
MLEVHSPIPMTEGETLVFGIRTKHIAHFSIGVCLTAPMAALAWFLLPLLHEPKLLVLFLWGGAGVVFAKVPVANRPLAEWLWLSFRYARRPKLILYDREFRIRVHRKRAAEKWGAR

SEQ ID NO: 264 - protein, 116 aa, Artificial
  Alicyclobacillus acidocaldarius mutated SEQ ID NO 256
MLEVHSPIPMTEGETLVFGIRTKHIAHFSIGVCLTAPMAALAWFLLPLLHEPKLLVLFLWGGAGVVFAKVPVAQRPLAEWLWLSFRYARRPKLILYDREFRIRVHRKRAAERWGAR

SEQ ID NO: 265 - protein, 116 aa, Artificial
  Alicyclobacillus acidocaldarius mutated SEQ ID NO 256
MLEVHSPIPMTEGETLVFGIRTKHIAHFSIGVCLTAPMAALAWFLLPLLHEPKLLVLFLWGGAGVVFAKVPVANRPLAEWLWLSFRYARRPKLILYDREFKIRVHRKRAAERWGAR

SEQ ID NO: 266 - protein, 116 aa, Artificial
  Alicyclobacillus acidocaldarius mutated SEQ ID NO 256
MLEVHSPIPMTEGETIVFGIRTKHIAHFSIGVCLTAPMAALAWFLLPLLHEPKLLVLFLWGGAGVVFAKVPVANRPLAEWLWLSFRYARRPKLILYDREFRIRVHRKRAAERWGAR

SEQ ID NO: 267 - protein, 116 aa, Artificial
  Alicyclobacillus acidocaldarius mutated SEQ ID NO 256
MLEVHSPIPMTEGETLVFGIRTKHIAHFSIGVCITAPMAALAWFLLPLLHEPKLLVLFLWGGAGVVFAKVPVANRPLAEWLWLSFRYARRPKLILYDREFRIRVHRKRAAERWGAR

SEQ ID NO: 268 - DNA, 351 bp, Artificial
  Alicyclobacillus acidocaldarius mutated SEQ ID NO 257
atgctggaggttcattcgccgattcccatgaccgaaggagaaacgctcgtctttggtattcgcaccaagcacatcgcgcacttttccatcggggtctgtctcacggccccgatggctgcgcttgcgtggtttctcctgccgcttctccatgagcccaaacttcttgtgctcttcttgtggggaggggcaggcgttgtcttcgcgaaggtgccggtcgccaatcggccccttgccgagtggctgtggctctcgttccgttacgccagacggcccaagctcattctctatgaccgtgagttccggattcgcgtccatcgcaagcgcgcggcggaaaaatggggagcgcggtga

SEQ ID NO: 269 - DNA, 351 bp, Artificial
  Alicyclobacillus acidocaldarius mutated SEQ ID NO 257
atgctggaggttcattcgccgattcccatgaccgaaggagaaacgctcgtctttggtattcgcaccaagcacatcgcgcacttttccatcggggtctgtctcacggccccgatggctgcgcttgcgtggtttctcctgccgcttctccatgagcccaaacttcttgtgctcttcttgtggggaggggcaggcgttgtcttcgcgaaggtgccggtcgcccaacggccccttgccgagtggctgtggctctcgttccgttacgccagacggcccaagctcattctctatgaccgtgagttccggattcgcgtccatcgcaagcgcgcggcggaaaggtggggagcgcggtga

SEQ ID NO: 270 - DNA, 351 bp, Artificial
  Alicyclobacillus acidocaldarius mutated SEQ ID NO 257
atgctggaggttcattcgccgattcccatgaccgaaggagaaacgctcgtctttggtattcgcaccaagcacatcgcgcacttttccatcggggtctgtctcacggccccgatggctgcgcttgcgtggtttctcctgccgcttctccatgagcccaaacttcttgtgctcttcttgtggggaggggcaggcgttgtcttcgcgaaggtgccggtcgccaatcggccccttgccgagtggctgtggctctcgttccgttacgccagacggcccaagctcattctctatgaccgtgagttcaaaattcgcgtccatcgcaagcgcgcggcggaaaggtggggagcgcggtga

SEQ ID NO: 271 - DNA, 351 bp, Artificial
  Alicyclobacillus acidocaldarius mutated SEQ ID NO 257
atgctggaggttcattcgccgattcccatgaccgaaggagaaacgattgtctttggtattcgcaccaagcacatcgcgcacttttccatcggggtctgtctcacggccccgatggctgcgcttgcgtggtttctcctgccgcttctccatgagcccaaacttcttgtgctcttcttgtggggaggggcaggcgttgtcttcgcgaaggtgccggtcgccaatcggccccttgccgagtggctgtggctctcgttccgttacgccagacggcccaagctcattctctatgaccgtgagttccggattcgcgtccatcgcaagcgcgcggcggaaaggtggggagcgcggtga

SEQ ID NO: 272 - DNA, 351 bp, Artificial
  Alicyclobacillus acidocaldarius mutated SEQ ID NO 257
atgctggaggttcattcgccgattcccatgaccgaaggagaaacgctcgtctttggtattcgcaccaagcacatcgcgcacttttccatcggggtctgtattacggccccgatggctgcgcttgcgtggtttctcctgccgcttctccatgagcccaaacttcttgtgctcttcttgtggggaggggcaggcgttgtcttcgcgaaggtgccggtcgccaatcggccccttgccgagtggctgtggctctcgttccgttacgccagacggcccaagctcattctctatgaccgtgagttccggattcgcgtccatcgcaagcgcgcggcggaaaggtggggagcgcggtga

SEQ ID NO: 273 - protein, 124 aa, Alicyclobacillus acidocaldarius
MSMKRWITQVGKSLYAGSVVLASTAMSAEASTSGITNPLSSSSSSVSSVLNQALGWLDDAIFAVAGALFLFHLYKAIIGLMAGSHHAQRREEAKSHLVWVAISGVMLGGGAILAGALYNLGKSF

SEQ ID NO: 274 - DNA, 375 bp, Alicyclobacillus acidocaldarius
atgtccatgaagcgatggatcactcaggtggggaaaagcttgtatgcgggaagcgtcgtcttggcttcgacggccatgtcagcggaagcaagcacgagtgggatcacaaatcccctctccagcagttcgtcgagcgtgagttctgtactcaatcaggcgctcggttggctggacgatgcgattttcgcggtggccggcgcgctgtttctgttccatctctacaaggccatcattggcctgatggccggttcccaccacgcgcagcggcgagaagaggcgaaaagccacctcgtgtgggtggccatatccggcgtcatgctcgggggcggggcgatcttggctggcgcgctctacaacctcggcaagagtttttaa

SEQ ID NO: 275 - protein, 117 aa, Frankia  EAN1pec
QLGSSLLLNTIVLVLVTATAGAASTPLAVARRALARPSLIALVLALALRPVGFPAWLDEALASIGATLTPLALFSVGLQLRLPAVRRWRRELALGLVVKLAVAPVVVLGCYALAGAL

SEQ ID NO: 276 - protein, 78 aa, Halobacterium  NRC-1
ATIGGIATTLGFSSQTMAAILGGVFGLQSAWLTYGIFAAIGAVFLVDVWLGLRSGIRNAARATMLLIGVAMAVLVVVG

SEQ ID NO: 277 - protein, 83 aa, Paenibacillus  JDR-2
LSGFLADVSYSLSFVLNGVTSGVFALFFLFYLQRVGTGSGDHSAELMRKKQAAGGASLWLLVTDVRLYLFMALGGMLINLGNS

SEQ ID NO: 278 - protein, 91 aa, Mycobacterium tuberculosis
GKLETIGSAMVAQNAAAAAPTTTGVIPAAADEISVLQAPLFTAYGTLYQQVSAEAAAVYDLFVKTLGVSAGTYAATEAANSSAAALPLSGI

SEQ ID NO: 279 - protein, 71 aa, Nematostella vectensis
VGVLLGTALNLTDWIFAVSGGMFLFVSLAETMPELFASAAHQREESRGKVLLAQNAGLLAGFGTMLTLAAF

SEQ ID NO: 280 - protein, 124 aa, Artificial
  Alicyclobacillus acidocaldarius mutated SEQ ID NO 273
MSMKRWITQVGKSLYAGSVVLASTAMSAEASTSGITNPLSSSSSSVSSVLNQALGWLDDAIFAVAGALFLFHLYKAIIGLMAGSHHAQRREEAKSHLVWVAISGVMIGGGAILAGALYNLGKSF

SEQ ID NO: 281 - protein, 124 aa, Artificial
  Alicyclobacillus acidocaldarius mutated SEQ ID NO 273
MSMKRWITQVGKSLYAGSVVLASTAMSAEASTSGITNPLSSSSSSVSSVLNQALGWLDDAIFAVAGALFLFHLYKAIIGLMAGSHHAQRKEEAKSHLVWVAISGVMLGGGAILAGALYNLGKSF

SEQ ID NO: 282 - protein, 124 aa, Artificial
  Alicyclobacillus acidocaldarius mutated SEQ ID NO 273
MSMKRWITNVGKSLYAGSVVLASTAMSAEASTSGITNPLSSSSSSVSSVLNQALGWLDDAIFAVAGALFLFHLYKAIIGLMAGSHHAQRREEAKSHLVWVAISGVMLGGGAILAGALYNLGKSF

SEQ ID NO: 283 - protein, 124 aa, Artificial
  Alicyclobacillus acidocaldarius mutated SEQ ID NO 273
MSMKRWITQVGKSLYAGSVVLASTAMSAEASTSGITNPLSSSSSSVSSVLNQALGWLDDAIFAVAGALFLFHLYKAIIGLMAGSHHAQRREEAKSHLVWIAISGVMLGGGAILAGALYNLGKSF

SEQ ID NO: 284 - protein, 124 aa, Artificial
  Alicyclobacillus acidocaldarius mutated SEQ ID NO 273
MSMKRWITQVGRSLYAGSVVLASTAMSAEASTSGITNPLSSSSSSVSSVLNQALGWLDDAIFAVAGALFLFHLYKAIIGLMAGSHHAQRREEAKSHLVWVAISGVMLGGGAILAGALYNLGKSF

SEQ ID NO: 285 - DNA, 375 bp, Artificial
  Alicyclobacillus acidocaldarius mutated SEQ ID NO 274
atgtccatgaagcgatggatcactcaggtggggaaaagcttgtatgcgggaagcgtcgtcttggcttcgacggccatgtcagcggaagcaagcacgagtgggatcacaaatcccctctccagcagttcgtcgagcgtgagttctgtactcaatcaggcgctcggttggctggacgatgcgattttcgcggtggccggcgcgctgtttctgttccatctctacaaggccatcattggcctgatggccggttcccaccacgcgcagcggcgagaagaggcgaaaagccacctcgtgtgggtggccatatccggcgtcatgattgggggcggggcgatcttggctggcgcgctctacaacctcggcaagagtttttaa

SEQ ID NO: 286 - DNA, 375 bp, Artificial
  Alicyclobacillus acidocaldarius mutated SEQ ID NO 274
atgtccatgaagcgatggatcactcaggtggggaaaagcttgtatgcgggaagcgtcgtcttggcttcgacggccatgtcagcggaagcaagcacgagtgggatcacaaatcccctctccagcagttcgtcgagcgtgagttctgtactcaatcaggcgctcggttggctggacgatgcgattttcgcggtggccggcgcgctgtttctgttccatctctacaaggccatcattggcctgatggccggttcccaccacgcgcagcggaaagaagaggcgaaaagccacctcgtgtgggtggccatatccggcgtcatgctcgggggcggggcgatcttggctggcgcgctctacaacctcggcaagagtttttaa

SEQ ID NO: 287 - DNA, 375 bp, Artificial
  Alicyclobacillus acidocaldarius mutated SEQ ID NO 274
atgtccatgaagcgatggatcactaatgtggggaaaagcttgtatgcgggaagcgtcgtcttggcttcgacggccatgtcagcggaagcaagcacgagtgggatcacaaatcccctctccagcagttcgtcgagcgtgagttctgtactcaatcaggcgctcggttggctggacgatgcgattttcgcggtggccggcgcgctgtttctgttccatctctacaaggccatcattggcctgatggccggttcccaccacgcgcagcggcgagaagaggcgaaaagccacctcgtgtgggtggccatatccggcgtcatgctcgggggcggggcgatcttggctggcgcgctctacaacctcggcaagagtttttaa

SEQ ID NO: 288 - DNA, 375 bp, Artificial
  Alicyclobacillus acidocaldarius mutated SEQ ID NO 274
atgtccatgaagcgatggatcactcaggtggggaaaagcttgtatgcgggaagcgtcgtcttggcttcgacggccatgtcagcggaagcaagcacgagtgggatcacaaatcccctctccagcagttcgtcgagcgtgagttctgtactcaatcaggcgctcggttggctggacgatgcgattttcgcggtggccggcgcgctgtttctgttccatctctacaaggccatcattggcctgatggccggttcccaccacgcgcagcggcgagaagaggcgaaaagccacctcgtgtggattgccatatccggcgtcatgctcgggggcggggcgatcttggctggcgcgctctacaacctcggcaagagtttttaa

SEQ ID NO: 289 - DNA, 375 bp, Artificial
  Alicyclobacillus acidocaldarius mutated SEQ ID NO 274
atgtccatgaagcgatggatcactcaggtggggcgtagcttgtatgcgggaagcgtcgtcttggcttcgacggccatgtcagcggaagcaagcacgagtgggatcacaaatcccctctccagcagttcgtcgagcgtgagttctgtactcaatcaggcgctcggttggctggacgatgcgattttcgcggtggccggcgcgctgtttctgttccatctctacaaggccatcattggcctgatggccggttcccaccacgcgcagcggcgagaagaggcgaaaagccacctcgtgtgggtggccatatccggcgtcatgctcgggggcggggcgatcttggctggcgcgctctacaacctcggcaagagtttttaa

SEQ ID NO: 290 - protein, 148 aa, Alicyclobacillus acidocaldarius
MRQSSNAPDSVRGESWPKVGAICSFPSCTLVPSRPVQARGGEGMAGSTASNVTQTITQLGFAPVNPWALLNRVTSGFGHLIEVVFAWVYFLSEIGVLAGALVWLVGSIGSHARIKRTGAHITLYAIVGFLAAVILPGVILAIDSTFQR

SEQ ID NO: 291 - DNA, 447 bp, Alicyclobacillus acidocaldarius
atgcgccaaagctcaaacgcgcctgactctgttcgtggcgaaagttggcctaaagttggcgcaatttgttctttcccttcctgtacgctcgtgccatcaagaccagtccaagcaaggggaggtgagggcatggcggggagcacggcgtcaaatgtgacgcaaaccatcacgcaacttggctttgcgccggtgaatccgtgggcgcttctgaatcgggtgacaagcgggtttggacatctcatcgaggtcgtcttcgcttgggtctacttcttgtcggaaatcggggtgctggcgggcgcgctcgtgtggctggtgggttccatcgggagtcacgcgcgaatcaagcgtacgggcgcgcacatcacgttgtacgccatcgtgggctttctcgcggctgtgattctgccgggcgtcattctggccattgattcgacctttcagcgatag

SEQ ID NO: 292 - protein, 78 aa, Bacillus cereus
AVLVLFFGGFGTAIDVDGADQIIILGWGAVFSSILGIIGSVVVKSKSGIGGAFMLIAAIIGFLCIFAIYILPGALLAI

SEQ ID NO: 293 - protein, 157 aa, Burkholderia thailandensis
RGALAARIGAAFDLPTLGRTLVVCAPAIALYGATGDARWLLASIATIAIAIAVERVGIAPLGALAQGAAIIAGFLSLSCALNAWPAFVAGCAALAAAAVALSRFGARLRSLGNFVFIPSLYLTCEAAAAHLSAPRLVPYLCAAMLPPIALSCIATLR

SEQ ID NO: 294 - protein, 157 aa, Burkholderia thailandensis
RGALAARIGAAFDLPTLGRTLVVCAPTIALYGATGDARWLLASIATIAIAIAVERVGIAPLGALAQGAAIIAGFLSLSCALNAWPAFVAGCAALAAAAVALSRFGARLRSLGNFVFIPSLYLTCEAAAAHLSAPRLVPYLCAAMLPPIALSCIATLR

SEQ ID NO: 295 - protein, 88 aa, Bifidobacterium longum
VSVLGFVPHMFANPWGSLMAVLVALFLSVPAAFIYRKIRTRKGAAIGILVGAVLAIVVALVSNLIVTPIYAHMTYQAVAAMILPILLP

SEQ ID NO: 296 - protein, 81 aa, Mus musculus
SLPSTWRIPSTCSEHSEGSDCSTNSNVTMSLLKLLDCFFRPFLPREGLKKIPSEKLSHIPELIEPWFIFSLVWSVGATGDH

SEQ ID NO: 297 - protein, 148 aa, Artificial
  Alicyclobacillus acidocaldarius mutated SEQ ID NO 290
MRQSSNAPDSVRGESWPKVGAICSFPSCTLVPSRPVQARGGEGMAGSTASNVTQTITQLGFAPVNPWALLNRVTSGFGHLIEVVFAWVYFLSEIGVIAGALVWLVGSIGSHARIKRTGAHITLYAIVGFLAAVILPGVILAIDSTFQR

SEQ ID NO: 298 - protein, 148 aa, Artificial
  Alicyclobacillus acidocaldarius mutated SEQ ID NO 290
MRQSSNAPDSVRGESWPKIGAICSFPSCTLVPSRPVQARGGEGMAGSTASNVTQTITQLGFAPVNPWALLNRVTSGFGHLIEVVFAWVYFLSEIGVLAGALVWLVGSIGSHARIKRTGAHITLYAIVGFLAAVILPGVILAIDSTFQR

SEQ ID NO: 299 - protein, 148 aa, Artificial
  Alicyclobacillus acidocaldarius mutated SEQ ID NO 290
MRQSSNAPDSVRGESWPKVGAICSFPSCTLVPSRPVQARGGEGMAGSTASNVTQTITQLGFAPVNPWALLNRVTSGFGHLIEVVFAWVYFLSEIGVLAGALVWLVGSIGSHARIKRTGAHITIYAIVGFLAAVILPGVILAIDSTFQR

SEQ ID NO: 300 - protein, 148 aa, Artificial
  Alicyclobacillus acidocaldarius mutated SEQ ID NO 290
MRQSSNAPDSVRGESWPKVGAICSFPSCTLVPSRPVQARGGEGMAGSTASNVTQTITQLGFAPVNPWALLNRVTSGFGHIIEVVFAWVYFLSEIGVLAGALVWLVGSIGSHARIKRTGAHITLYAIVGFLAAVILPGVILAIDSTFQR

SEQ ID NO: 301 - protein, 148 aa, Artificial
  Alicyclobacillus acidocaldarius mutated SEQ ID NO 290
MRQSSNAPDSVRGESWPKVGAICSFPSCTLVPSRPVQARGGEGMAGSTASNVTNTITQLGFAPVNPWALLNRVTSGFGHLIEVVFAWVYFLSEIGVLAGALVWLVGSIGSHARIKRTGAHITLYAIVGFLAAVILPGVILAIDSTFQR

SEQ ID NO: 302 - DNA, 447 bp, Artificial
  Alicyclobacillus acidocaldarius mutated SEQ ID NO 291
atgcgccaaagctcaaacgcgcctgactctgttcgtggcgaaagttggcctaaagttggcgcaatttgttctttcccttcctgtacgctcgtgccatcaagaccagtccaagcaaggggaggtgagggcatggcggggagcacggcgtcaaatgtgacgcaaaccatcacgcaacttggctttgcgccggtgaatccgtgggcgcttctgaatcgggtgacaagcgggtttggacatctcatcgaggtcgtcttcgcttgggtctacttcttgtcggaaatcggggtgattgcgggcgcgctcgtgtggctggtgggttccatcgggagtcacgcgcgaatcaagcgtacgggcgcgcacatcacgttgtacgccatcgtgggctttctcgcggctgtgattctgccgggcgtcattctggccattgattcgacctttcagcgatag

SEQ ID NO: 303 - DNA, 447 bp, Artificial
  Alicyclobacillus acidocaldarius mutated SEQ ID NO 291
atgcgccaaagctcaaacgcgcctgactctgttcgtggcgaaagttggcctaaaattggcgcaatttgttctttcccttcctgtacgctcgtgccatcaagaccagtccaagcaaggggaggtgagggcatggcggggagcacggcgtcaaatgtgacgcaaaccatcacgcaacttggctttgcgccggtgaatccgtgggcgcttctgaatcgggtgacaagcgggtttggacatctcatcgaggtcgtcttcgcttgggtctacttcttgtcggaaatcggggtgctggcgggcgcgctcgtgtggctggtgggttccatcgggagtcacgcgcgaatcaagcgtacgggcgcgcacatcacgttgtacgccatcgtgggctttctcgcggctgtgattctgccgggcgtcattctggccattgattcgacctttcagcgatag

SEQ ID NO: 304 - DNA, 447 bp, Artificial
  Alicyclobacillus acidocaldarius mutated SEQ ID NO 291
atgcgccaaagctcaaacgcgcctgactctgttcgtggcgaaagttggcctaaagttggcgcaatttgttctttcccttcctgtacgctcgtgccatcaagaccagtccaagcaaggggaggtgagggcatggcggggagcacggcgtcaaatgtgacgcaaaccatcacgcaacttggctttgcgccggtgaatccgtgggcgcttctgaatcgggtgacaagcgggtttggacatctcatcgaggtcgtcttcgcttgggtctacttcttgtcggaaatcggggtgctggcgggcgcgctcgtgtggctggtgggttccatcgggagtcacgcgcgaatcaagcgtacgggcgcgcacatcacgatttacgccatcgtgggctttctcgcggctgtgattctgccgggcgtcattctggccattgattcgacctttcagcgatag

SEQ ID NO: 305 - DNA, 447 bp, Artificial
  Alicyclobacillus acidocaldarius mutated SEQ ID NO 291
atgcgccaaagctcaaacgcgcctgactctgttcgtggcgaaagttggcctaaagttggcgcaatttgttctttcccttcctgtacgctcgtgccatcaagaccagtccaagcaaggggaggtgagggcatggcggggagcacggcgtcaaatgtgacgcaaaccatcacgcaacttggctttgcgccggtgaatccgtgggcgcttctgaatcgggtgacaagcgggtttggacatattatcgaggtcgtcttcgcttgggtctacttcttgtcggaaatcggggtgctggcgggcgcgctcgtgtggctggtgggttccatcgggagtcacgcgcgaatcaagcgtacgggcgcgcacatcacgttgtacgccatcgtgggctttctcgcggctgtgattctgccgggcgtcattctggccattgattcgacctttcagcgatag

SEQ ID NO: 306 - DNA, 447 bp, Artificial
  Alicyclobacillus acidocaldarius mutated SEQ ID NO 291
atgcgccaaagctcaaacgcgcctgactctgttcgtggcgaaagttggcctaaagttggcgcaatttgttctttcccttcctgtacgctcgtgccatcaagaccagtccaagcaaggggaggtgagggcatggcggggagcacggcgtcaaatgtgacgaataccatcacgcaacttggctttgcgccggtgaatccgtgggcgcttctgaatcgggtgacaagcgggtttggacatctcatcgaggtcgtcttcgcttgggtctacttcttgtcggaaatcggggtgctggcgggcgcgctcgtgtggctggtgggttccatcgggagtcacgcgcgaatcaagcgtacgggcgcgcacatcacgttgtacgccatcgtgggctttctcgcggctgtgattctgccgggcgtcattctggccattgattcgacctttcagcgatag

SEQ ID NO: 307 - protein, 203 aa, Alicyclobacillus acidocaldarius
MERVEYVDRVKHVWSEYRTNDEELAFALGIDEEAESVDVSTKDGITNVTVFTTEAVYHFGTFRADYVGHASRALVQLLQHFRVNLPIDFIVAHQTFHVYLKGGKVVAGEKEYPIAERSEGYELVEPVEWMIASSVLDVVLRLAEEYEVTPEQIVESAVGTFYALLSVAEENDVEPETVISMLTELMHRHAEHTNEHELSTLNR

SEQ ID NO: 308 - DNA, 612 bp, Alicyclobacillus acidocaldarius
atggagcgagttgaatacgtggaccgcgtgaagcacgtgtggagtgagtaccgtacgaacgacgaggaactggccttcgcgcttggaatcgatgaggaagcggaatctgtggacgtttcaacgaaggacggcatcacgaacgtcacggtgttcacaactgaggccgtctatcactttggcacgttccgggccgattatgtgggccatgcgtcgcgagcgttggtccagctattgcagcacttccgtgtgaacttgcccatagatttcatcgtggcgcaccagacctttcacgtgtacttgaaaggcggcaaagtcgtcgcaggcgagaaggaatatccgatcgccgaacgtagcgagggatatgaactcgtcgagcctgtcgagtggatgatagcctcaagcgtgctcgatgtcgtgttgcgcttggcggaagagtacgaagtgacacccgaacagatcgtggagagcgcggtaggtacgttctatgcgctcctcagtgtcgcggaagaaaatgatgtggagccagaaacggtgatttcaatgttgacggagctaatgcataggcacgcagaacacacaaacgaacatgaactaagtacgttgaacaggtaa

SEQ ID NO: 309 - protein, 102 aa, Yarrowia lipolytica
NLTANVEIDGKQYNTFTEPPKALAGERAKVKFPIKDMTEFLHGGEENVTMIERLMTELERDPVLNVSGDYDMPKEQLRETAVARIAALSGHWKKDTEKEALL

SEQ ID NO: 310 - protein, 68 aa, Treponema pallidum
DLIVRLAKLKHVNPQVLQVMSDSLHKKFAALHLSQRRDLDGHAVLAAILKKMERATEHSILHALAEKN

SEQ ID NO: 311 - protein, 60 aa, Flavobacterium  MED217
IGEDILPENVDFEVIDGFTKVTDKDAAIYTRRLAKEEGFFLGNSAGAAIKGLLQLKQHFK

SEQ ID NO: 312 - protein, 99 aa, Pyrococcus abyssi
ARKILEVLIDSDVNVYINDVVASEVIFIYLKLTTGKSYLTLKKNPVIVRSVDKTSVYELLGMFKFLETNEFVFSIAKRLIDKYGLLPNDALILATAIFY

SEQ ID NO: 313 - protein, 71 aa, Syntrophomonas wolfei
LSPNRWQHSLQVAETALQMAGQYELELEQVYLTALLHDYAKGLSGQELLRLAEENNLIEDEVDREVPDLLH

SEQ ID NO: 314 - protein, 203 aa, Artificial
  Alicyclobacillus acidocaldarius mutated SEQ ID NO 307
MERVEYVDRVKHVWSEYRTNDEELAFALGIEEEAESVDVSTKDGITNVTVFTTEAVYHFGTFRADYVGHASRALVQLLQHFRVNLPIDFIVAHQTFHVYLKGGKVVAGEKEYPIAERSEGYELVEPVEWMIASSVLDVVLRLAEEYEVTPEQIVESAVGTFYALLSVAEENDVEPETVISMLTELMHRHAEHTNEHELSTLNR

SEQ ID NO: 315 - protein, 203 aa, Artificial
  Alicyclobacillus acidocaldarius mutated SEQ ID NO 307
MERVEYVDRVKHVWSEYRTNDEELAFALGIDEEAESVDVSTKDGITNVTVFTTEAVYHFGTFRADYVGHASRALVQLLQHFRVNLPIDFIVAHQTFHVYLKGGKVVAGEKEYPIADRSEGYELVEPVEWMIASSVLDVVLRLAEEYEVTPEQIVESAVGTFYALLSVAEENDVEPETVISMLTELMHRHAEHTNEHELSTLNR

SEQ ID NO: 316 - protein, 203 aa, Artificial
  Alicyclobacillus acidocaldarius mutated SEQ ID NO 307
MERVEYVDRVKHVWSEYRTNDEELAFALGIDEEAESVDVSTKDGITNVTVFTTEAVYHFGTFRAEYVGHASRALVQLLQHFRVNLPIDFIVAHQTFHVYLKGGKVVAGEKEYPIAERSEGYELVEPVEWMIASSVLDVVLRLAEEYEVTPEQIVESAVGTFYALLSVAEENDVEPETVISMLTELMHRHAEHTNEHELSTLNR

SEQ ID NO: 317 - protein, 203 aa, Artificial
  Alicyclobacillus acidocaldarius mutated SEQ ID NO 307
MERVEYVDRVKHVWSEYRTNDEELAFALGLDEEAESVDVSTKDGITNVTVFTTEAVYHFGTFRADYVGHASRALVQLLQHFRVNLPIDFIVAHQTFHVYLKGGKVVAGEKEYPIAERSEGYELVEPVEWMIASSVLDVVLRLAEEYEVTPEQIVESAVGTFYALLSVAEENDVEPETVISMLTELMHRHAEHTNEHELSTLNR

SEQ ID NO: 318 - protein, 203 aa, Artificial
  Alicyclobacillus acidocaldarius mutated SEQ ID NO 307
MERVEYVDRVKHVWSEYRTNDEELAFALGIDEEAESVDVSTKDGITNVTVFTTEAVYHFGTFRADYVGHASRALVQLLQHFRVNLPIDFIVAHQTFHVYLKGGKVVAGEKEYPIAERSEGYELVEPVEWMIASSVLDVVLRLAEEYEVTPEQIVESAVGTFYALLSVAEENDVEPETVLSMLTELMHRHAEHTNEHELSTLNR

SEQ ID NO: 319 - DNA, 612 bp, Artificial
  Alicyclobacillus acidocaldarius mutated SEQ ID NO 308
atggagcgagttgaatacgtggaccgcgtgaagcacgtgtggagtgagtaccgtacgaacgacgaggaactggccttcgcgcttggaatcgaagaggaagcggaatctgtggacgtttcaacgaaggacggcatcacgaacgtcacggtgttcacaactgaggccgtctatcactttggcacgttccgggccgattatgtgggccatgcgtcgcgagcgttggtccagctattgcagcacttccgtgtgaacttgcccatagatttcatcgtggcgcaccagacctttcacgtgtacttgaaaggcggcaaagtcgtcgcaggcgagaaggaatatccgatcgccgaacgtagcgagggatatgaactcgtcgagcctgtcgagtggatgatagcctcaagcgtgctcgatgtcgtgttgcgcttggcggaagagtacgaagtgacacccgaacagatcgtggagagcgcggtaggtacgttctatgcgctcctcagtgtcgcggaagaaaatgatgtggagccagaaacggtgatttcaatgttgacggagctaatgcataggcacgcagaacacacaaacgaacatgaactaagtacgttgaacaggtaa

SEQ ID NO: 320 - DNA, 612 bp, Artificial
  Alicyclobacillus acidocaldarius mutated SEQ ID NO 308
atggagcgagttgaatacgtggaccgcgtgaagcacgtgtggagtgagtaccgtacgaacgacgaggaactggccttcgcgcttggaatcgatgaggaagcggaatctgtggacgtttcaacgaaggacggcatcacgaacgtcacggtgttcacaactgaggccgtctatcactttggcacgttccgggccgattatgtgggccatgcgtcgcgagcgttggtccagctattgcagcacttccgtgtgaacttgcccatagatttcatcgtggcgcaccagacctttcacgtgtacttgaaaggcggcaaagtcgtcgcaggcgagaaggaatatccgatcgccgatcgtagcgagggatatgaactcgtcgagcctgtcgagtggatgatagcctcaagcgtgctcgatgtcgtgttgcgcttggcggaagagtacgaagtgacacccgaacagatcgtggagagcgcggtaggtacgttctatgcgctcctcagtgtcgcggaagaaaatgatgtggagccagaaacggtgatttcaatgttgacggagctaatgcataggcacgcagaacacacaaacgaacatgaactaagtacgttgaacaggtaa

SEQ ID NO: 321 - DNA, 612 bp, Artificial
  Alicyclobacillus acidocaldarius mutated SEQ ID NO 308
atggagcgagttgaatacgtggaccgcgtgaagcacgtgtggagtgagtaccgtacgaacgacgaggaactggccttcgcgcttggaatcgatgaggaagcggaatctgtggacgtttcaacgaaggacggcatcacgaacgtcacggtgttcacaactgaggccgtctatcactttggcacgttccgggccgaatatgtgggccatgcgtcgcgagcgttggtccagctattgcagcacttccgtgtgaacttgcccatagatttcatcgtggcgcaccagacctttcacgtgtacttgaaaggcggcaaagtcgtcgcaggcgagaaggaatatccgatcgccgaacgtagcgagggatatgaactcgtcgagcctgtcgagtggatgatagcctcaagcgtgctcgatgtcgtgttgcgcttggcggaagagtacgaagtgacacccgaacagatcgtggagagcgcggtaggtacgttctatgcgctcctcagtgtcgcggaagaaaatgatgtggagccagaaacggtgatttcaatgttgacggagctaatgcataggcacgcagaacacacaaacgaacatgaactaagtacgttgaacaggtaa

SEQ ID NO: 322 - DNA, 612 bp, Artificial
  Alicyclobacillus acidocaldarius mutated SEQ ID NO 308
atggagcgagttgaatacgtggaccgcgtgaagcacgtgtggagtgagtaccgtacgaacgacgaggaactggccttcgcgcttggattagatgaggaagcggaatctgtggacgtttcaacgaaggacggcatcacgaacgtcacggtgttcacaactgaggccgtctatcactttggcacgttccgggccgattatgtgggccatgcgtcgcgagcgttggtccagctattgcagcacttccgtgtgaacttgcccatagatttcatcgtggcgcaccagacctttcacgtgtacttgaaaggcggcaaagtcgtcgcaggcgagaaggaatatccgatcgccgaacgtagcgagggatatgaactcgtcgagcctgtcgagtggatgatagcctcaagcgtgctcgatgtcgtgttgcgcttggcggaagagtacgaagtgacacccgaacagatcgtggagagcgcggtaggtacgttctatgcgctcctcagtgtcgcggaagaaaatgatgtggagccagaaacggtgatttcaatgttgacggagctaatgcataggcacgcagaacacacaaacgaacatgaactaagtacgttgaacaggtaa

SEQ ID NO: 323 - DNA, 612 bp, Artificial
  Alicyclobacillus acidocaldarius mutated SEQ ID NO 308
atggagcgagttgaatacgtggaccgcgtgaagcacgtgtggagtgagtaccgtacgaacgacgaggaactggccttcgcgcttggaatcgatgaggaagcggaatctgtggacgtttcaacgaaggacggcatcacgaacgtcacggtgttcacaactgaggccgtctatcactttggcacgttccgggccgattatgtgggccatgcgtcgcgagcgttggtccagctattgcagcacttccgtgtgaacttgcccatagatttcatcgtggcgcaccagacctttcacgtgtacttgaaaggcggcaaagtcgtcgcaggcgagaaggaatatccgatcgccgaacgtagcgagggatatgaactcgtcgagcctgtcgagtggatgatagcctcaagcgtgctcgatgtcgtgttgcgcttggcggaagagtacgaagtgacacccgaacagatcgtggagagcgcggtaggtacgttctatgcgctcctcagtgtcgcggaagaaaatgatgtggagccagaaacggtgttatcaatgttgacggagctaatgcataggcacgcagaacacacaaacgaacatgaactaagtacgttgaacaggtaa

SEQ ID NO: 324 - protein, 260 aa, Alicyclobacillus acidocaldarius
MERVGCTISVGLQKGGVGKSTTTALTSYILAEQGHRVLAVDFDSQGNLTQLLTQRSPYDFVHRTSLEACKERDPRPYIHAISDNLHLLPAEDFLSQFDKWIYTEVHVSQQMVILKNTLDVVKSDYDYILIDLPPNLGGLTLNGVCASDYCVVVCQSEPFAYDALDRYMEIIQAAQQRVNPNLRIAGILISLLDARTAIGNYITERIREEYQDFVFDTVIRRKSRIIEFSVEGIKIQTKADREAIAMYESFVEELKARVSR

SEQ ID NO: 325 - DNA, 783 bp, Alicyclobacillus acidocaldarius
gtggaacgtgtggggtgtacgattagtgtagggctccaaaaaggtggtgtaggtaaatctacgaccaccgcactcacttcatatattctcgcagaacaaggccatcgggttctcgcagtcgactttgactctcaaggcaacctcacgcaacttttgacgcaacgaagcccgtacgatttcgtacatcgcacaagtttagaagcatgcaaagaacgcgacccgcggccctatatccacgccatctcagacaatctgcatttactcccggcagaggactttttgtctcaattcgacaaatggatttacacggaagttcacgtatctcagcaaatggtgattctgaaaaacacgctcgacgttgtaaagagcgattacgactatattctcatcgacctccctcccaacctcggaggactcaccctgaacggcgtatgtgcatctgactactgtgtcgtcgtgtgccaatccgaaccttttgcgtacgatgctctcgaccgatacatggagattattcaggctgcacaacaacgtgtaaatcccaaccttcgaattgccggcatcttaatctcgttgctcgatgctcgaacagcgattggcaactacatcaccgaacgcatccgcgaagagtaccaggacttcgtcttcgacacagtgattcgacgcaaatctcgaatcatcgaattctcggtggaagggataaagattcaaaccaaggccgaccgagaagctatcgccatgtatgaatcgttcgtggaggagttgaaagcccgtgtcagccgctga

SEQ ID NO: 326 - protein, 255 aa, Natranaerobius thermophilus
MGTTISFGIQKGGVGKTTTTAITSYILSKEHKTLAVDFDSQGNLTRFLTQQNIYNFTEKTVLEAVKAKDPRPYIYKISDNLHILPAEDFLATFSRFLYQEYQGNKALLLKETLDVVREQYNYITIDLPPHLGDQTINGLSASDYAVVLLQSEPFALDALDRYLEVLMGVQKKANSNMKLIGILSTMLDSRAAIDSEIINKARKDYEDVVFETIIRRRNRIKEFSLFGIEERTKVDREALKYYKNFTKELISRVQK

SEQ ID NO: 327 - protein, 259 aa, Geobacillus kaustophilus
TITMGIQKGGCGKSTTTGVLAYLLSRDGYRVLAVDMDSQGNLTELLSRKPSNEFTEKSVLEAMQERDPEPYIVKVNDRLDLLPANNFLATFPRWIYTGETYLGKYIRYKGKPTLILDDTLDKIRHRYDFIVIDTPPSLSEQTTNALCASQYVIMMFECSNWCYSAVPNFMESVEGARVHGRHNTRLLGILRTMNDVRRNDAKAFNEMIEEDYPNEVFKTIITRKAPIGRLSLYGFEENNELNQALEQYENFYKEMMERV

SEQ ID NO: 328 - protein, 249 aa, Lactobacillus salivarius
MGTVIAIANQKGGVGKTTTSVNLGACLARAGQKVLLIDTDAQGNATSGIGVRKHNIENDVYDVIVSELPIREAIMPTYIDNLDVVPATIQLAGAEIELTAQMAREKKLYDAVQDVKEEYDFILIDCPPSLGLLTINAFTASDSILIPVQSEYYALEGLSQLMNTIQLVQKHFNPDLQIEGVLMTMLDARTNLGNQVVEEVKKFFKEKVYKTVIPRNVRLSEAPSHGMSIIDYDPRSRGAEEYEALAKEV

SEQ ID NO: 329 - protein, 221 aa, Leptospira borgpetersenii
MGKIVSISNQKGGVGKTTTSINLAANLASIGKKVLIIDMDPQGNSGSGLGIEINTLVKTSYELLLGESSTNECIQRTNVSNLHIIPSNINLSGAEADLLVEDQREYRLKNAVSELRSEYDYILIDCPPSLGILTINALCAADSVMITLQTEYFALEGLTQLMKIISLVQNQLNPSLELEGVLLTMFDKRTNLANQVAEDVKSYFKDKVYTTIIPRNVKLSE

SEQ ID NO: 330 - protein, 222 aa, Leptospira interrogans
QMGKIVSISNQKGGVGKTTTSINLAANLASIEKKVLIIDMDPQGNSGSGLGLEIHKTNKTSYELLLGEASVNECIQRTNVSNLHIIPSNINLSGAEADLLAEDQREYRLKNAISDLRTEYDYILIDCPPSLGILTINALCAADSVMITLQTEYFALEGLTQLMKIISLVQNQLNPSLELEGVLLTMFDKRTNLANQVAEDVKSYFKDKVYTTIIPRNVKLSE

SEQ ID NO: 331 - protein, 260 aa, Artificial
  Alicyclobacillus acidocaldarius mutated SEQ ID NO 324
MERVGCTISVGLQKGGVGKSTTTALTSYILAEQGHRVLAVDFDSQGNLTQLLTQRSPYDFVHRTSLEACKERDPRPYIHAISDNLHLLPAEDFLSQFDKWIYTEVHVSQQMVILKNTLDVVKSDYDYILIDLPPNLGGLTLNGVCASDYCVVVCQSEPFAYDALDRYMEIIQAAQQRVNPNLRIAGILISLLDARTAIGNYITERIREEYQDFVFDTVIRRKSRIIEFSVEGIKLQTKADREAIAMYESFVEELKARVSR

SEQ ID NO: 332 - protein, 260 aa, Artificial
  Alicyclobacillus acidocaldarius mutated SEQ ID NO 324
MERVGCTISVGLQKGGVGKSTTTALTSYILAEQGHRVLAVDFDSQGNLTQLLTQRSPYDFVHRTSLEACKERDPRPYIHAISDNLHLLPAEDFLSQFDKWIYTEVHVSQQMVILKNTLDVVKSEYDYILIDLPPNLGGLTLNGVCASDYCVVVCQSEPFAYDALDRYMEIIQAAQQRVNPNLRIAGILISLLDARTAIGNYITERIREEYQDFVFDTVIRRKSRIIEFSVEGIKIQTKADREAIAMYESFVEELKARVSR

SEQ ID NO: 333 - protein, 260 aa, Artificial
  Alicyclobacillus acidocaldarius mutated SEQ ID NO 324
MERVGCTISVGLQKGGVGKSTTTALTSYILAEQGHRVLAVDFDSQGNLTQLLTQRSPYDFVHRTSLEACKERDPRPYIHAISDNLHLLPAEDFLSQFDKWIYTEVHVSQQMVILKNTLDVVKSDYDYILIDLPPNLGGLTLNGVCASDYCVVVCQSEPFAYDALDRYMEIIQAAQQRVNPNLRIAGILISLIDARTAIGNYITERIREEYQDFVFDTVIRRKSRIIEFSVEGIKIQTKADREAIAMYESFVEELKARVSR

SEQ ID NO: 334 - protein, 260 aa, Artificial
  Alicyclobacillus acidocaldarius mutated SEQ ID NO 324
MERVGCTISVGLQKGGVGKSTTTALTSYILAEQGHRVLAVDFDSQGNLTQLLTQRSPYDFVHRTSLEACKEKDPRPYIHAISDNLHLLPAEDFLSQFDKWIYTEVHVSQQMVILKNTLDVVKSDYDYILIDLPPNLGGLTLNGVCASDYCVVVCQSEPFAYDALDRYMEIIQAAQQRVNPNLRIAGILISLLDARTAIGNYITERIREEYQDFVFDTVIRRKSRIIEFSVEGIKIQTKADREAIAMYESFVEELKARVSR

SEQ ID NO: 335 - protein, 260 aa, Artificial
  Alicyclobacillus acidocaldarius mutated SEQ ID NO 324
MERVGCTISVGLQKGGVGKSTTTALTSYILAENGHRVLAVDFDSQGNLTQLLTQRSPYDFVHRTSLEACKERDPRPYIHAISDNLHLLPAEDFLSQFDKWIYTEVHVSQQMVILKNTLDVVKSDYDYILIDLPPNLGGLTLNGVCASDYCVVVCQSEPFAYDALDRYMEIIQAAQQRVNPNLRIAGILISLLDARTAIGNYITERIREEYQDFVFDTVIRRKSRIIEFSVEGIKIQTKADREAIAMYESFVEELKARVSR

SEQ ID NO: 336 - DNA, 783 bp, Artificial
  Alicyclobacillus acidocaldarius mutated SEQ ID NO 325
gtggaacgtgtggggtgtacgattagtgtagggctccaaaaaggtggtgtaggtaaatctacgaccaccgcactcacttcatatattctcgcagaacaaggccatcgggttctcgcagtcgactttgactctcaaggcaacctcacgcaacttttgacgcaacgaagcccgtacgatttcgtacatcgcacaagtttagaagcatgcaaagaacgcgacccgcggccctatatccacgccatctcagacaatctgcatttactcccggcagaggactttttgtctcaattcgacaaatggatttacacggaagttcacgtatctcagcaaatggtgattctgaaaaacacgctcgacgttgtaaagagcgattacgactatattctcatcgacctccctcccaacctcggaggactcaccctgaacggcgtatgtgcatctgactactgtgtcgtcgtgtgccaatccgaaccttttgcgtacgatgctctcgaccgatacatggagattattcaggctgcacaacaacgtgtaaatcccaaccttcgaattgccggcatcttaatctcgttgctcgatgctcgaacagcgattggcaactacatcaccgaacgcatccgcgaagagtaccaggacttcgtcttcgacacagtgattcgacgcaaatctcgaatcatcgaattctcggtggaagggataaagttacaaaccaaggccgaccgagaagctatcgccatgtatgaatcgttcgtggaggagttgaaagcccgtgtcagccgctga

SEQ ID NO: 337 - DNA, 783 bp, Artificial
  Alicyclobacillus acidocaldarius mutated SEQ ID NO 325
gtggaacgtgtggggtgtacgattagtgtagggctccaaaaaggtggtgtaggtaaatctacgaccaccgcactcacttcatatattctcgcagaacaaggccatcgggttctcgcagtcgactttgactctcaaggcaacctcacgcaacttttgacgcaacgaagcccgtacgatttcgtacatcgcacaagtttagaagcatgcaaagaacgcgacccgcggccctatatccacgccatctcagacaatctgcatttactcccggcagaggactttttgtctcaattcgacaaatggatttacacggaagttcacgtatctcagcaaatggtgattctgaaaaacacgctcgacgttgtaaagagcgaatacgactatattctcatcgacctccctcccaacctcggaggactcaccctgaacggcgtatgtgcatctgactactgtgtcgtcgtgtgccaatccgaaccttttgcgtacgatgctctcgaccgatacatggagattattcaggctgcacaacaacgtgtaaatcccaaccttcgaattgccggcatcttaatctcgttgctcgatgctcgaacagcgattggcaactacatcaccgaacgcatccgcgaagagtaccaggacttcgtcttcgacacagtgattcgacgcaaatctcgaatcatcgaattctcggtggaagggataaagattcaaaccaaggccgaccgagaagctatcgccatgtatgaatcgttcgtggaggagttgaaagcccgtgtcagccgctga

SEQ ID NO: 338 - DNA, 783 bp, Artificial
  Alicyclobacillus acidocaldarius mutated SEQ ID NO 325
gtggaacgtgtggggtgtacgattagtgtagggctccaaaaaggtggtgtaggtaaatctacgaccaccgcactcacttcatatattctcgcagaacaaggccatcgggttctcgcagtcgactttgactctcaaggcaacctcacgcaacttttgacgcaacgaagcccgtacgatttcgtacatcgcacaagtttagaagcatgcaaagaacgcgacccgcggccctatatccacgccatctcagacaatctgcatttactcccggcagaggactttttgtctcaattcgacaaatggatttacacggaagttcacgtatctcagcaaatggtgattctgaaaaacacgctcgacgttgtaaagagcgattacgactatattctcatcgacctccctcccaacctcggaggactcaccctgaacggcgtatgtgcatctgactactgtgtcgtcgtgtgccaatccgaaccttttgcgtacgatgctctcgaccgatacatggagattattcaggctgcacaacaacgtgtaaatcccaaccttcgaattgccggcatcttaatctcgttgattgatgctcgaacagcgattggcaactacatcaccgaacgcatccgcgaagagtaccaggacttcgtcttcgacacagtgattcgacgcaaatctcgaatcatcgaattctcggtggaagggataaagattcaaaccaaggccgaccgagaagctatcgccatgtatgaatcgttcgtggaggagttgaaagcccgtgtcagccgctga

SEQ ID NO: 339 - DNA, 783 bp, Artificial
  Alicyclobacillus acidocaldarius mutated SEQ ID NO 325
gtggaacgtgtggggtgtacgattagtgtagggctccaaaaaggtggtgtaggtaaatctacgaccaccgcactcacttcatatattctcgcagaacaaggccatcgggttctcgcagtcgactttgactctcaaggcaacctcacgcaacttttgacgcaacgaagcccgtacgatttcgtacatcgcacaagtttagaagcatgcaaagaaaaagacccgcggccctatatccacgccatctcagacaatctgcatttactcccggcagaggactttttgtctcaattcgacaaatggatttacacggaagttcacgtatctcagcaaatggtgattctgaaaaacacgctcgacgttgtaaagagcgattacgactatattctcatcgacctccctcccaacctcggaggactcaccctgaacggcgtatgtgcatctgactactgtgtcgtcgtgtgccaatccgaaccttttgcgtacgatgctctcgaccgatacatggagattattcaggctgcacaacaacgtgtaaatcccaaccttcgaattgccggcatcttaatctcgttgctcgatgctcgaacagcgattggcaactacatcaccgaacgcatccgcgaagagtaccaggacttcgtcttcgacacagtgattcgacgcaaatctcgaatcatcgaattctcggtggaagggataaagattcaaaccaaggccgaccgagaagctatcgccatgtatgaatcgttcgtggaggagttgaaagcccgtgtcagccgctga

SEQ ID NO: 340 - DNA, 783 bp, Artificial
  Alicyclobacillus acidocaldarius mutated SEQ ID NO 325
gtggaacgtgtggggtgtacgattagtgtagggctccaaaaaggtggtgtaggtaaatctacgaccaccgcactcacttcatatattctcgcagaaaatggccatcgggttctcgcagtcgactttgactctcaaggcaacctcacgcaacttttgacgcaacgaagcccgtacgatttcgtacatcgcacaagtttagaagcatgcaaagaacgcgacccgcggccctatatccacgccatctcagacaatctgcatttactcccggcagaggactttttgtctcaattcgacaaatggatttacacggaagttcacgtatctcagcaaatggtgattctgaaaaacacgctcgacgttgtaaagagcgattacgactatattctcatcgacctccctcccaacctcggaggactcaccctgaacggcgtatgtgcatctgactactgtgtcgtcgtgtgccaatccgaaccttttgcgtacgatgctctcgaccgatacatggagattattcaggctgcacaacaacgtgtaaatcccaaccttcgaattgccggcatcttaatctcgttgctcgatgctcgaacagcgattggcaactacatcaccgaacgcatccgcgaagagtaccaggacttcgtcttcgacacagtgattcgacgcaaatctcgaatcatcgaattctcggtggaagggataaagattcaaaccaaggccgaccgagaagctatcgccatgtatgaatcgttcgtggaggagttgaaagcccgtgtcagccgctga

SEQ ID NO: 341 - protein, 152 aa, Alicyclobacillus acidocaldarius
MSAADKKKRFESLMPSRTETPPHKSEVIDTLMGQTYDADDIGTPKTRMESLHKESVSHTSEVVYPPMSNTTTTDDNGTTDNSFDIAARIRAFEEQRRSRPSYDELYTKHTFLIRKDLMERLERASARHSRGFKTRFINELLEAGLTQLEIED

SEQ ID NO: 342 - DNA, 459 bp, Alicyclobacillus acidocaldarius
gtgtcagccgctgacaaaaagaagcgctttgaaagcctaatgccatctcggacagagaccccaccccacaagtctgaggtcattgacacacttatggggcaaacctatgatgcggacgatataggtacaccaaaaacgcgtatggaatccctacacaaagaaagtgtatctcatacgtcagaggtcgtttatccaccgatgtctaatacaaccaccacggacgacaacggtacaacagacaattcgtttgatatcgccgcgcgaatccgggcgttcgaagaacaacgccgttcacgcccaagttacgacgagttgtataccaagcatacatttctcattcggaaagacctcatggagcgcttggaacgagcttctgcaagacacagcagaggattcaagacgaggtttatcaacgaactgctagaagcaggattgactcagttggagatagaagactag

SEQ ID NO: 343 - protein, 76 aa, Flavobacteriales bacterium
TYDQEGAVYTHVAKDHQKKAMKFIQDQLFTTPTWMLDEDIFNKIESAGSIERVRGMQTRTLNNMLDFGRMQRMLEN

SEQ ID NO: 344 - protein, 172 aa, Eubacterium dolichum
LGSTQKEQKYEMEDYTESVQKQAEAADELAKSLNDAEEAAKNSYADKIGDIGTVEKYLQKLREMSGETGYVDNVNLAKMYVEEINSLLPETVQLTADGRVEWLKNTDAIYQEIAALKEEARVKAYQELYTQAVRDEIKARTDLTMTTEELNKKVQRLNELKADGISEDEIEE

SEQ ID NO: 345 - protein, 76 aa, Marinobacter algicola
PFMEEDTTPDTSSTSDDSSDDDDDDDDSEEETESGPDPEETRLRFELLKEKLDAADASLAKHGRGHKKTQEALNEL

SEQ ID NO: 346 - protein, 90 aa, Paramecium tetraurelia
LGISKTATEEQIKEAYAQKAQKLYPNVTTSVAINDVQAQQGFQDVAEAFAVLSQIQSRNAYDLLNKEQPELLYGEEMERYKQSFQRNDDG

SEQ ID NO: 347 - protein, 74 aa, Apis mellifera
LSQPHTTIPALHPPNVPLVSSSHTTSPAVASLGVTPAAPSNGATTTSYPPSIPMAAYPQTQPSYPPLYTPYTAL

SEQ ID NO: 348 - protein, 152 aa, Artificial
  Alicyclobacillus acidocaldarius mutated SEQ ID NO 341
MSAADKKKRFESLMPSRTETPPHKSEVIDTLMGQTYDADDIGTPKTRMESLHKESVSHTSEVVYPPMSNTTTTDDNGTTDNSFDIAARIRAFEEQRRSRPSYDELYTKHTFLIRKELMERLERASARHSRGFKTRFINELLEAGLTQLEIED

SEQ ID NO: 349 - protein, 152 aa, Artificial
  Alicyclobacillus acidocaldarius mutated SEQ ID NO 341
MSAADKKKRFESLMPSRTETPPHKSEVIDTLMGQTYDADDIGTPKTRMESLHKESVSHTSEVVYPPMSNTTTTDDNGTTDNSFDIAARIRAFEEQRRSRPSYDELYTKHTFLIRKDIMERLERASARHSRGFKTRFINELLEAGLTQLEIED

SEQ ID NO: 350 - protein, 152 aa, Artificial
  Alicyclobacillus acidocaldarius mutated SEQ ID NO 341
MSAADKKKRFESLMPSRTETPPHKSEVIDTLMGQTYDADDIGTPKTRMESLHKESVSHTSEVVYPPMSNTTTTDDNGTTDNSFDIAARIRAFEEQRRSRPSYDELYTKHTFLIRKDLMERLERASARHSRGFKTRFINELLEAGLTQLELED

SEQ ID NO: 351 - protein, 152 aa, Artificial
  Alicyclobacillus acidocaldarius mutated SEQ ID NO 341
MSAADKKKRFESLMPSRTETPPHKSEVIETLMGQTYDADDIGTPKTRMESLHKESVSHTSEVVYPPMSNTTTTDDNGTTDNSFDIAARIRAFEEQRRSRPSYDELYTKHTFLIRKDLMERLERASARHSRGFKTRFINELLEAGLTQLEIED

SEQ ID NO: 352 - protein, 152 aa, Artificial
  Alicyclobacillus acidocaldarius mutated SEQ ID NO 341
MSAADKKKRFESLMPSRTETPPHKSEVIDTLMGQTYDADDIGTPKTRMESLHKESVSHTSEVVYPPMSNTTTTDDNGTTDNSFDIAARIRAFEEQRRSRPSYDELYTKHTFLIRKDLMERLERASARHSRGFKTRFINELLEAGLTQLEIEE

SEQ ID NO: 353 - DNA, 459 bp, Artificial
  Alicyclobacillus acidocaldarius mutated SEQ ID NO 342
gtgtcagccgctgacaaaaagaagcgctttgaaagcctaatgccatctcggacagagaccccaccccacaagtctgaggtcattgacacacttatggggcaaacctatgatgcggacgatataggtacaccaaaaacgcgtatggaatccctacacaaagaaagtgtatctcatacgtcagaggtcgtttatccaccgatgtctaatacaaccaccacggacgacaacggtacaacagacaattcgtttgatatcgccgcgcgaatccgggcgttcgaagaacaacgccgttcacgcccaagttacgacgagttgtataccaagcatacatttctcattcggaaagaactcatggagcgcttggaacgagcttctgcaagacacagcagaggattcaagacgaggtttatcaacgaactgctagaagcaggattgactcagttggagatagaagactag

SEQ ID NO: 354 - DNA, 459 bp, Artificial
  Alicyclobacillus acidocaldarius mutated SEQ ID NO 342
gtgtcagccgctgacaaaaagaagcgctttgaaagcctaatgccatctcggacagagaccccaccccacaagtctgaggtcattgacacacttatggggcaaacctatgatgcggacgatataggtacaccaaaaacgcgtatggaatccctacacaaagaaagtgtatctcatacgtcagaggtcgtttatccaccgatgtctaatacaaccaccacggacgacaacggtacaacagacaattcgtttgatatcgccgcgcgaatccgggcgttcgaagaacaacgccgttcacgcccaagttacgacgagttgtataccaagcatacatttctcattcggaaagacattatggagcgcttggaacgagcttctgcaagacacagcagaggattcaagacgaggtttatcaacgaactgctagaagcaggattgactcagttggagatagaagactag

SEQ ID NO: 355 - DNA, 459 bp, Artificial
  Alicyclobacillus acidocaldarius mutated SEQ ID NO 342
gtgtcagccgctgacaaaaagaagcgctttgaaagcctaatgccatctcggacagagaccccaccccacaagtctgaggtcattgacacacttatggggcaaacctatgatgcggacgatataggtacaccaaaaacgcgtatggaatccctacacaaagaaagtgtatctcatacgtcagaggtcgtttatccaccgatgtctaatacaaccaccacggacgacaacggtacaacagacaattcgtttgatatcgccgcgcgaatccgggcgttcgaagaacaacgccgttcacgcccaagttacgacgagttgtataccaagcatacatttctcattcggaaagacctcatggagcgcttggaacgagcttctgcaagacacagcagaggattcaagacgaggtttatcaacgaactgctagaagcaggattgactcagttggagttagaagactag

SEQ ID NO: 356 - DNA, 459 bp, Artificial
  Alicyclobacillus acidocaldarius mutated SEQ ID NO 342
gtgtcagccgctgacaaaaagaagcgctttgaaagcctaatgccatctcggacagagaccccaccccacaagtctgaggtcattgaaacacttatggggcaaacctatgatgcggacgatataggtacaccaaaaacgcgtatggaatccctacacaaagaaagtgtatctcatacgtcagaggtcgtttatccaccgatgtctaatacaaccaccacggacgacaacggtacaacagacaattcgtttgatatcgccgcgcgaatccgggcgttcgaagaacaacgccgttcacgcccaagttacgacgagttgtataccaagcatacatttctcattcggaaagacctcatggagcgcttggaacgagcttctgcaagacacagcagaggattcaagacgaggtttatcaacgaactgctagaagcaggattgactcagttggagatagaagactag

SEQ ID NO: 357 - DNA, 459 bp, Artificial
  Alicyclobacillus acidocaldarius mutated SEQ ID NO 342
gtgtcagccgctgacaaaaagaagcgctttgaaagcctaatgccatctcggacagagaccccaccccacaagtctgaggtcattgacacacttatggggcaaacctatgatgcggacgatataggtacaccaaaaacgcgtatggaatccctacacaaagaaagtgtatctcatacgtcagaggtcgtttatccaccgatgtctaatacaaccaccacggacgacaacggtacaacagacaattcgtttgatatcgccgcgcgaatccgggcgttcgaagaacaacgccgttcacgcccaagttacgacgagttgtataccaagcatacatttctcattcggaaagacctcatggagcgcttggaacgagcttctgcaagacacagcagaggattcaagacgaggtttatcaacgaactgctagaagcaggattgactcagttggagatagaagaatag

SEQ ID NO: 358 - protein, 254 aa, Alicyclobacillus acidocaldarius
MTSGMRRFTNSSRTAEEVTGMEGHYTYALMGPTSEHTVACDLAPDTFVEVLRGAMEAIGVRLDELVLRIYVQEGAGGWQLVHGRVKDAREAQQTCLLPMPPEPPSGDPEVLDDATYQDIGYAALNLYRVLWQSRQRIKASSLKTKVRVRQSLRALDERMRLVEQAVEGTEWWDLFRLRYQQGKKLVACAMELHMSSRTLNRQISDMAGHVGRMLSTVLKERELAELMQAAKRVPMMPGKATARVIRLEQRELWS

SEQ ID NO: 359 - DNA, 765 bp, Alicyclobacillus acidocaldarius
gtgacgagcggtatgcggcgttttacgaactcttcccggacggctgaggaggtgacagggatggaggggcactacacctacgctctgatggggccgacgagcgaacacacggtggcgtgtgacctggcgcctgatacgttcgtggaggtcctgcgtggcgcgatggaggccatcggggttcgcttggacgagttagtgttgcggatctacgtgcaagagggcgcgggaggctggcagttggtgcacgggcgtgtcaaggacgctcgcgaagcccagcagacgtgcctcttgccaatgccgccggagcctccgtcaggagacccggaagtgctcgatgacgcgacgtatcaggacatcgggtacgcggcgttgaatctttatcgcgtgctgtggcagtctcgccagcgtatcaaagcgtcgagtctgaagacgaaggtgcgagttcggcaatcgttgcgggcgctggacgagcgcatgcgtcttgttgagcaggcggtcgagggtacggagtggtgggacctgttccggttgcggtatcagcagggcaaaaagcttgtagcgtgcgcgatggaactgcacatgtcgtcgcggacgctcaatcgccagatcagcgacatggccggccatgtcgggcggatgttgagcacggtgctcaaggaacgggagttggcggaattgatgcaggcggcgaagcgtgtgccgatgatgccgggcaaggcgacggcgcgcgtgatacgcttggagcaacgagaactatggtcatag

SEQ ID NO: 360 - protein, 70 aa, Bordetella avium
AADLAQDTFVRVLRHRRELPGVREPRAYLVTIAGRLLLNHYRRRSLERAYEEALAVMPLESAPSPEQRLL

SEQ ID NO: 361 - protein, 70 aa, Bordetella avium; identical to SEQ ID NO: 360

SEQ ID NO: 362 - protein, 173 aa, Trypanosoma cruzi
RGANLSNEERTNETIVRQYETALENIIGTLQDRLTILREEYASFLKVSEEETANEKEVLNEHEQDSQRVRQTFRTAALTLQRVFWSTREKEVPEVISELDNAAAAAEKSRAAVKVTLALLDSRLQSFSEQKEWMETHQQSLEDLLVSLRQLNKRAFERQLSLMNERVARPSST

SEQ ID NO: 363 - protein, 173 aa, Sclerotinia sclerotiorum
YIEMSAFGRESHPRVQALRHDRDRSPPDPNATDPEVIEHLKTQLKDADDLMDLIVARYRVLENENGEPNTERVEVAERRLEECMDLVDGPLGQKEAFDNLKALLSESREALKVKMNEWNEKDKERDWAVESLEKLLKESEEREAALAGLLHATQEDMRREGKRAAKVAEIEEK

SEQ ID NO: 364 - protein, 222 aa, Coprinopsis cinerea
THSAFGPTVSFEEAQRIERETAEHLLKSRKLSLIVDLDQTIVHATVDPTVGEWIAEGEAWEARQERRNKVKTTTPDSDDSDSSDDSDDDEDDECNPNWEALKDVKKFTLGPESFNAPSVKGRSKGKHRMVEQEGCMYYIKPRPGWKEFLENAAKKYEMHVYTMGTRAYAQEVCAAIDPDGKLFGSRLLSRDESGSLTQKSLQRLFPCDTSMVVIIDDRADVW

SEQ ID NO: 365 - protein, 254 aa, Artificial
  Alicyclobacillus acidocaldarius mutated SEQ ID NO 358
MTSGMRRFTNSSRTAEEVTGMEGHYTYALMGPTSEHTVACDLAPDTFVEVLRGAMEAIGVRLDELVLRIYVQEGAGGWQLVHGRVKDAREAQQTCLLPMPPEPPSGDPEVLDDATYQDIGYAALNLYRVLWQSRQRIKASSLKTKVRVRQSLRALDERMRLVEQAVEGTEWWDLFRLRYQQGKKLVACAMELHMSSRTLNRQISDMAGHVGRMLSTVLKEKELAELMQAAKRVPMMPGKATARVIRLEQRELWS

SEQ ID NO: 366 - protein, 254 aa, Artificial
  Alicyclobacillus acidocaldarius mutated SEQ ID NO 358
MTSGMRRFTNSSRTAEEVTGMEGHYTYALMGPTSEHTVACDLAPDTFVEVLRGAMEAIGVRLDELVLRIYVQEGAGGWQLVHGRVKDAREAQQTCLLPMPPEPPSGDPEVLDDATYQEIGYAALNLYRVLWQSRQRIKASSLKTKVRVRQSLRALDERMRLVEQAVEGTEWWDLFRLRYQQGKKLVACAMELHMSSRTLNRQISDMAGHVGRMLSTVLKERELAELMQAAKRVPMMPGKATARVIRLEQRELWS

SEQ ID NO: 367 - protein, 254 aa, Artificial
  Alicyclobacillus acidocaldarius mutated SEQ ID NO 358
MTSGMRRFTNSSRTAEEVTGMEGHYTYALMGPTSEHTVACDLAPDTFVEVLRGAMEAIGVRLDELVLRIYVQEGAGGWQLVHGRVKDAREAQQTCLLPMPPEPPSGDPEVLDDATYQDIGYAALNLYRVLWQSRQRIKASSLKTKVRVRQSLRALDERMRLVEQAVEGTEWWDLFRLRYQQGKKLVACAMELHMSSRTLNRQISDMAGHVGRMLSTVLKERELAELMQAAKRVPMMPGKATARVLRLEQRELWS

SEQ ID NO: 368 - protein, 254 aa, Artificial
  Alicyclobacillus acidocaldarius mutated SEQ ID NO 358
MTSGMRRFTQSSRTAEEVTGMEGHYTYALMGPTSEHTVACDLAPDTFVEVLRGAMEAIGVRLDELVLRIYVQEGAGGWQLVHGRVKDAREAQQTCLLPMPPEPPSGDPEVLDDATYQDIGYAALNLYRVLWQSRQRIKASSLKTKVRVRQSLRALDERMRLVEQAVEGTEWWDLFRLRYQQGKKLVACAMELHMSSRTLNRQISDMAGHVGRMLSTVLKERELAELMQAAKRVPMMPGKATARVIRLEQRELWS

SEQ ID NO: 369 - protein, 254 aa, Artificial
  Alicyclobacillus acidocaldarius mutated SEQ ID NO 358
MTSGMRRFTNSSRTAEDVTGMEGHYTYALMGPTSEHTVACDLAPDTFVEVLRGAMEAIGVRLDELVLRIYVQEGAGGWQLVHGRVKDAREAQQTCLLPMPPEPPSGDPEVLDDATYQDIGYAALNLYRVLWQSRQRIKASSLKTKVRVRQSLRALDERMRLVEQAVEGTEWWDLFRLRYQQGKKLVACAMELHMSSRTLNRQISDMAGHVGRMLSTVLKERELAELMQAAKRVPMMPGKATARVIRLEQRELWS

SEQ ID NO: 370 - DNA, 765 bp, Artificial
  Alicyclobacillus acidocaldarius mutated SEQ ID NO 359
gtgacgagcggtatgcggcgttttacgaactcttcccggacggctgaggaggtgacagggatggaggggcactacacctacgctctgatggggccgacgagcgaacacacggtggcgtgtgacctggcgcctgatacgttcgtggaggtcctgcgtggcgcgatggaggccatcggggttcgcttggacgagttagtgttgcggatctacgtgcaagagggcgcgggaggctggcagttggtgcacgggcgtgtcaaggacgctcgcgaagcccagcagacgtgcctcttgccaatgccgccggagcctccgtcaggagacccggaagtgctcgatgacgcgacgtatcaggacatcgggtacgcggcgttgaatctttatcgcgtgctgtggcagtctcgccagcgtatcaaagcgtcgagtctgaagacgaaggtgcgagttcggcaatcgttgcgggcgctggacgagcgcatgcgtcttgttgagcaggcggtcgagggtacggagtggtgggacctgttccggttgcggtatcagcagggcaaaaagcttgtagcgtgcgcgatggaactgcacatgtcgtcgcggacgctcaatcgccagatcagcgacatggccggccatgtcgggcggatgttgagcacggtgctcaaggaaaaagagttggcggaattgatgcaggcggcgaagcgtgtgccgatgatgccgggcaaggcgacggcgcgcgtgatacgcttggagcaacgagaactatggtcatag

SEQ ID NO: 371 - DNA, 765 bp, Artificial
  Alicyclobacillus acidocaldarius mutated SEQ ID NO 359
gtgacgagcggtatgcggcgttttacgaactcttcccggacggctgaggaggtgacagggatggaggggcactacacctacgctctgatggggccgacgagcgaacacacggtggcgtgtgacctggcgcctgatacgttcgtggaggtcctgcgtggcgcgatggaggccatcggggttcgcttggacgagttagtgttgcggatctacgtgcaagagggcgcgggaggctggcagttggtgcacgggcgtgtcaaggacgctcgcgaagcccagcagacgtgcctcttgccaatgccgccggagcctccgtcaggagacccggaagtgctcgatgacgcgacgtatcaggaaatcgggtacgcggcgttgaatctttatcgcgtgctgtggcagtctcgccagcgtatcaaagcgtcgagtctgaagacgaaggtgcgagttcggcaatcgttgcgggcgctggacgagcgcatgcgtcttgttgagcaggcggtcgagggtacggagtggtgggacctgttccggttgcggtatcagcagggcaaaaagcttgtagcgtgcgcgatggaactgcacatgtcgtcgcggacgctcaatcgccagatcagcgacatggccggccatgtcgggcggatgttgagcacggtgctcaaggaacgggagttggcggaattgatgcaggcggcgaagcgtgtgccgatgatgccgggcaaggcgacggcgcgcgtgatacgcttggagcaacgagaactatggtcatag

SEQ ID NO: 372 - DNA, 765 bp, Artificial
  Alicyclobacillus acidocaldarius mutated SEQ ID NO 359
gtgacgagcggtatgcggcgttttacgaactcttcccggacggctgaggaggtgacagggatggaggggcactacacctacgctctgatggggccgacgagcgaacacacggtggcgtgtgacctggcgcctgatacgttcgtggaggtcctgcgtggcgcgatggaggccatcggggttcgcttggacgagttagtgttgcggatctacgtgcaagagggcgcgggaggctggcagttggtgcacgggcgtgtcaaggacgctcgcgaagcccagcagacgtgcctcttgccaatgccgccggagcctccgtcaggagacccggaagtgctcgatgacgcgacgtatcaggacatcgggtacgcggcgttgaatctttatcgcgtgctgtggcagtctcgccagcgtatcaaagcgtcgagtctgaagacgaaggtgcgagttcggcaatcgttgcgggcgctggacgagcgcatgcgtcttgttgagcaggcggtcgagggtacggagtggtgggacctgttccggttgcggtatcagcagggcaaaaagcttgtagcgtgcgcgatggaactgcacatgtcgtcgcggacgctcaatcgccagatcagcgacatggccggccatgtcgggcggatgttgagcacggtgctcaaggaacgggagttggcggaattgatgcaggcggcgaagcgtgtgccgatgatgccgggcaaggcgacggcgcgcgtgttacgcttggagcaacgagaactatggtcatag

SEQ ID NO: 373 - DNA, 765 bp, Artificial
  Alicyclobacillus acidocaldarius mutated SEQ ID NO 359
gtgacgagcggtatgcggcgttttacgcaatcttcccggacggctgaggaggtgacagggatggaggggcactacacctacgctctgatggggccgacgagcgaacacacggtggcgtgtgacctggcgcctgatacgttcgtggaggtcctgcgtggcgcgatggaggccatcggggttcgcttggacgagttagtgttgcggatctacgtgcaagagggcgcgggaggctggcagttggtgcacgggcgtgtcaaggacgctcgcgaagcccagcagacgtgcctcttgccaatgccgccggagcctccgtcaggagacccggaagtgctcgatgacgcgacgtatcaggacatcgggtacgcggcgttgaatctttatcgcgtgctgtggcagtctcgccagcgtatcaaagcgtcgagtctgaagacgaaggtgcgagttcggcaatcgttgcgggcgctggacgagcgcatgcgtcttgttgagcaggcggtcgagggtacggagtggtgggacctgttccggttgcggtatcagcagggcaaaaagcttgtagcgtgcgcgatggaactgcacatgtcgtcgcggacgctcaatcgccagatcagcgacatggccggccatgtcgggcggatgttgagcacggtgctcaaggaacgggagttggcggaattgatgcaggcggcgaagcgtgtgccgatgatgccgggcaaggcgacggcgcgcgtgatacgcttggagcaacgagaactatggtcatag

SEQ ID NO: 374 - DNA, 765 bp, Artificial
  Alicyclobacillus acidocaldarius mutated SEQ ID NO 359
gtgacgagcggtatgcggcgttttacgaactcttcccggacggctgaggatgtgacagggatggaggggcactacacctacgctctgatggggccgacgagcgaacacacggtggcgtgtgacctggcgcctgatacgttcgtggaggtcctgcgtggcgcgatggaggccatcggggttcgcttggacgagttagtgttgcggatctacgtgcaagagggcgcgggaggctggcagttggtgcacgggcgtgtcaaggacgctcgcgaagcccagcagacgtgcctcttgccaatgccgccggagcctccgtcaggagacccggaagtgctcgatgacgcgacgtatcaggacatcgggtacgcggcgttgaatctttatcgcgtgctgtggcagtctcgccagcgtatcaaagcgtcgagtctgaagacgaaggtgcgagttcggcaatcgttgcgggcgctggacgagcgcatgcgtcttgttgagcaggcggtcgagggtacggagtggtgggacctgttccggttgcggtatcagcagggcaaaaagcttgtagcgtgcgcgatggaactgcacatgtcgtcgcggacgctcaatcgccagatcagcgacatggccggccatgtcgggcggatgttgagcacggtgctcaaggaacgggagttggcggaattgatgcaggcggcgaagcgtgtgccgatgatgccgggcaaggcgacggcgcgcgtgatacgcttggagcaacgagaactatggtcatag

SEQ ID NO: 375 - protein, 314 aa, Alicyclobacillus acidocaldarius
MWFKYTQKQQTTQPCAGFSSLRTMGRFPSRRKVFFRPPLQGGTNMAYTPAKVRKGWSENWFRCPNSIYDIDYISGYAKAVYIFLCRCADGEGQSFPGYNAIAKAIGFGRTRTIEAIKELEQAGLLVKEHRRNEETGEYYSNLYTVIHPDDVAFRGGMSPHGIPMSRDDTPLSPDDIPMSPHDRRVSPGGREVRSIDQDPPTKIYIHTRSQAAATLATSNNEHLTSNTALEEVCETVNEALVQLGIRAQKKTLLHWLQIATPEEIIEAASLATREGVKSPAGYIGTVLRNGLVRVEKSTAKHKDPRYNEFYKLFP

SEQ ID NO: 376 - DNA, 945 bp, Alicyclobacillus acidocaldarius
gtgtggtttaagtatacccaaaaacaacagaccacgcaaccctgtgctggcttctccagcctgagaacaatgggacgctttccttcgcgaaggaaagtgttttttcgtcctccactccaaggaggaacgaatatggcctataccccagcaaaagtccgcaaaggctggtctgagaactggttccgctgccccaacagtatctacgacatcgactacatcagtggctacgccaaagctgtctacatctttctttgccgttgtgccgacggagaaggacaaagcttcccgggatacaatgcaatcgcaaaagcgattggatttggtcgtactcgaacgatagaagccattaaggaattagaacaagcagggctcttggtgaaagaacaccgacgaaacgaagagacgggtgaatactacagtaatctctacacggtgattcaccctgacgacgttgcttttagggggggtatgtcgccacacggtatacctatgtcgcgtgacgacacacccctgtcgccagacgacatacctatgtcgccacacgacagacgtgtgtcgccaggcggacgagaagtaagatctatagatcaagatccacctacaaagatctacatacacacacggagccaagcagctgccacgttggctaccagcaacaatgagcacctgacatctaacactgcacttgaggaagtgtgtgagactgtaaatgaggcgttggtccagctgggcatacgagcacaaaagaagactctacttcactggttacagattgcgactccggaagagatcattgaagcggcttctcttgctactcgagagggtgtcaaatcaccggctgggtacatcggaacagttcttcggaacggtttggttcgagtcgagaagtcaactgcgaaacataaagaccctagatacaatgaattctataagttgtttccctaa

SEQ ID NO: 377 - protein, 83 aa, Pelotomaculum thermopropionicum
DAIFERHDLTTLQKLVYIYFCRRANNNGQSTPSYDDIAKDCGCHRSSAIEAVNTLGKMGLVVKHRRKRHNGSDTSNMYVVFPP

SEQ ID NO: 378 - protein, 89 aa, Clostridium difficile
KEWFWLENDLVDREDLGIYEKMIYIVLARYSDNESCCFPSYKTIALKCGCSERQAKSVVKILENKGLIKKENRIKSNSNEKESNIYFVL

SEQ ID NO: 379 - protein, 87 aa, Clostridium difficile
WFWLENDLVDREDLGIYEKMIYIVLARYSDNESCCFPSYKTIALKCGCSERQAKSVVKILENKGLIKKENRIKSNSNEKESNIYFVL

SEQ ID NO: 380 - protein, 206 aa, Geobacter lovleyi
PNAISRSTELSSTAKLVFGKLCQYAGQNGQAYPSYKTLAGDVGVERRQAIRAVKELVDYGLIKPVGRKKGDGGFTSNIYAFLWHQTFSDDGLTDPGDKNDTRGGVTNVTTPQCHKRHHLVSDMSPKENHTRESNSETTTTEEIRLLLSGTPLSKISEKEVRILIKRHGNERVMQAADIAAEKWRRERKEIKNPGGYLQTFCVNLVV

SEQ ID NO: 381 - protein, 97 aa, Bacillus cereus
FFMIDNEVIDNGELDVYAFKTYAVIVRYANKKTKSAFPSLNTLAKRVGCGKKKVIECIKILVEKGYVSKTLRKDNKGDHLSNLYHLLPTSNISKKQG

SEQ ID NO: 382 - protein, 314 aa, Artificial
  Alicyclobacillus acidocaldarius mutated SEQ ID NO 375
MWFKYTQKQQTTQPCAGFSSLRTMGRFPSRRKVFFRPPLQGGTNMAYTPAKVRKGWSENWFRCPNSIYDIDYISGYAKAVYIFLCRCADGEGQSFPGYNAIAKAIGFGRTRTIEAIKELEQAGLLVKEHRRNEETGEYYSNLYTVIHPDDVAFRGGMSPHGIPMSRDDTPLSPDDIPMSPHDRRVSPGGREVRSIDQDPPTKIYIHTRSQAAATLATSNNEHLTSNTALEEVCETVNEALVQLGIRAQKKTLLHWLQIATPEEIIEAASLATREGVKSPAGYIGTVLRNGLVRVEKSTAKHKDPRYNDFYKLFP

SEQ ID NO: 383 - protein, 314 aa, Artificial
  Alicyclobacillus acidocaldarius mutated SEQ ID NO 375
MWFKYTQKQQTTQPCAGFSSLRTMGRFPSRRKVFFRPPLQGGTNMAYTPAKVRKGWSENWFRCPNSIYDIDYISGYAKAVYIFLCRCADGEGQSFPGYNAIAKAIGFGRTRTIEAIKELEQAGLLVKEHRRNEETGEYYSNLYTVIHPDDVAFRGGMSPHGIPMSRDDTPLSPDDIPMSPHDRRVSPGGREVRSIDQDPPTKIYIHTRSQAAATLATSNNDHLTSNTALEEVCETVNEALVQLGIRAQKKTLLHWLQIATPEEIIEAASLATREGVKSPAGYIGTVLRNGLVRVEKSTAKHKDPRYNEFYKLFP

SEQ ID NO: 384 - protein, 314 aa, Artificial
  Alicyclobacillus acidocaldarius mutated SEQ ID NO 375
MWFKYTQKQQTTQPCAGFSSLRTMGRFPSRRKVFFRPPLQGGTNMAYTPAKVRKGWSENWFRCPNSIYDIDYISGYAKAVYIFLCRCADGEGQSFPGYNAIAKAIGFGRTRTIEAIKELEQAGLLVKEHRRNEETGEYYSNLYTVIHPDDVAFRGGMSPHGIPMSRDDTPLSPDDIPMSPHDRRVSPGGREVRSIDQDPPTKIYIHTRSQAAATLATSNNEHLTSNTALEEVCETVNEALVQLGIRAQKKTLLHWLQIATPEEIIEAASLATREGVKSPAGYIGTVLRNGLIRVEKSTAKHKDPRYNEFYKLFP

SEQ ID NO: 385 - protein, 314 aa, Artificial
  Alicyclobacillus acidocaldarius mutated SEQ ID NO 375
MWFKYTQKQQTTQPCAGFSSLRTMGRFPSRRKVFFRPPLQGGTNMAYTPAKVRKGWSENWFRCPNSIYDIDYISGYAKAVYIFLCRCADGEGQSFPGYNAIAKAIGFGRTRTIEAIKELEQAGLLVKEHRRNEETGEYYSNLYTVIHPDDVAFRGGMSPHGIPMSRDDTPLSPDDIPMSPHDRRVSPGGREVRSIDQDPPTKIYIHTRSQAAATLATSNNEHLTSNTALEEVCETVNEALVQLGIRAQKKTLLHWLQIATPEEILEAASLATREGVKSPAGYIGTVLRNGLVRVEKSTAKHKDPRYNEFYKLFP

SEQ ID NO: 386 - protein, 314 aa, Artificial
  Alicyclobacillus acidocaldarius mutated SEQ ID NO 375
MWFKYTQKQQTTQPCAGFSSLRTMGRFPSRRKVFFRPPLQGGTNMAYTPAKVRKGWSENWFRCPNSIYDIDYISGYAKAVYIFLCRCADGEGQSFPGYNAIAKAIGFGRTRTIEAIKELEQAGLLVKEHRRNEETGEYYSNLYTVIHPDDVAFRGGMSPHGIPMSRDDTPISPDDIPMSPHDRRVSPGGREVRSIDQDPPTKIYIHTRSQAAATLATSNNEHLTSNTALEEVCETVNEALVQLGIRAQKKTLLHWLQIATPEEIIEAASLATREGVKSPAGYIGTVLRNGLVRVEKSTAKHKDPRYNEFYKLFP

SEQ ID NO: 387 - DNA, 945 bp, Artificial
  Alicyclobacillus acidocaldarius mutated SEQ ID NO 376
gtgtggtttaagtatacccaaaaacaacagaccacgcaaccctgtgctggcttctccagcctgagaacaatgggacgctttccttcgcgaaggaaagtgttttttcgtcctccactccaaggaggaacgaatatggcctataccccagcaaaagtccgcaaaggctggtctgagaactggttccgctgccccaacagtatctacgacatcgactacatcagtggctacgccaaagctgtctacatctttctttgccgttgtgccgacggagaaggacaaagcttcccgggatacaatgcaatcgcaaaagcgattggatttggtcgtactcgaacgatagaagccattaaggaattagaacaagcagggctcttggtgaaagaacaccgacgaaacgaagagacgggtgaatactacagtaatctctacacggtgattcaccctgacgacgttgcttttagggggggtatgtcgccacacggtatacctatgtcgcgtgacgacacacccctgtcgccagacgacatacctatgtcgccacacgacagacgtgtgtcgccaggcggacgagaagtaagatctatagatcaagatccacctacaaagatctacatacacacacggagccaagcagctgccacgttggctaccagcaacaatgagcacctgacatctaacactgcacttgaggaagtgtgtgagactgtaaatgaggcgttggtccagctgggcatacgagcacaaaagaagactctacttcactggttacagattgcgactccggaagagatcattgaagcggcttctcttgctactcgagagggtgtcaaatcaccggctgggtacatcggaacagttcttcggaacggtttggttcgagtcgagaagtcaactgcgaaacataaagaccctagatacaatgatttctataagttgtttccctaa

SEQ ID NO: 388 - DNA, 945 bp, Artificial
  Alicyclobacillus acidocaldarius mutated SEQ ID NO 376
gtgtggtttaagtatacccaaaaacaacagaccacgcaaccctgtgctggcttctccagcctgagaacaatgggacgctttccttcgcgaaggaaagtgttttttcgtcctccactccaaggaggaacgaatatggcctataccccagcaaaagtccgcaaaggctggtctgagaactggttccgctgccccaacagtatctacgacatcgactacatcagtggctacgccaaagctgtctacatctttctttgccgttgtgccgacggagaaggacaaagcttcccgggatacaatgcaatcgcaaaagcgattggatttggtcgtactcgaacgatagaagccattaaggaattagaacaagcagggctcttggtgaaagaacaccgacgaaacgaagagacgggtgaatactacagtaatctctacacggtgattcaccctgacgacgttgcttttagggggggtatgtcgccacacggtatacctatgtcgcgtgacgacacacccctgtcgccagacgacatacctatgtcgccacacgacagacgtgtgtcgccaggcggacgagaagtaagatctatagatcaagatccacctacaaagatctacatacacacacggagccaagcagctgccacgttggctaccagcaacaatgatcacctgacatctaacactgcacttgaggaagtgtgtgagactgtaaatgaggcgttggtccagctgggcatacgagcacaaaagaagactctacttcactggttacagattgcgactccggaagagatcattgaagcggcttctcttgctactcgagagggtgtcaaatcaccggctgggtacatcggaacagttcttcggaacggtttggttcgagtcgagaagtcaactgcgaaacataaagaccctagatacaatgaattctataagttgtttccctaa

SEQ ID NO: 389 - DNA, 945 bp, Artificial
  Alicyclobacillus acidocaldarius mutated SEQ ID NO 376
gtgtggtttaagtatacccaaaaacaacagaccacgcaaccctgtgctggcttctccagcctgagaacaatgggacgctttccttcgcgaaggaaagtgttttttcgtcctccactccaaggaggaacgaatatggcctataccccagcaaaagtccgcaaaggctggtctgagaactggttccgctgccccaacagtatctacgacatcgactacatcagtggctacgccaaagctgtctacatctttctttgccgttgtgccgacggagaaggacaaagcttcccgggatacaatgcaatcgcaaaagcgattggatttggtcgtactcgaacgatagaagccattaaggaattagaacaagcagggctcttggtgaaagaacaccgacgaaacgaagagacgggtgaatactacagtaatctctacacggtgattcaccctgacgacgttgcttttagggggggtatgtcgccacacggtatacctatgtcgcgtgacgacacacccctgtcgccagacgacatacctatgtcgccacacgacagacgtgtgtcgccaggcggacgagaagtaagatctatagatcaagatccacctacaaagatctacatacacacacggagccaagcagctgccacgttggctaccagcaacaatgagcacctgacatctaacactgcacttgaggaagtgtgtgagactgtaaatgaggcgttggtccagctgggcatacgagcacaaaagaagactctacttcactggttacagattgcgactccggaagagatcattgaagcggcttctcttgctactcgagagggtgtcaaatcaccggctgggtacatcggaacagttcttcggaacggtttgattcgagtcgagaagtcaactgcgaaacataaagaccctagatacaatgaattctataagttgtttccctaa

SEQ ID NO: 390 - DNA, 945 bp, Artificial
  Alicyclobacillus acidocaldarius mutated SEQ ID NO 376
gtgtggtttaagtatacccaaaaacaacagaccacgcaaccctgtgctggcttctccagcctgagaacaatgggacgctttccttcgcgaaggaaagtgttttttcgtcctccactccaaggaggaacgaatatggcctataccccagcaaaagtccgcaaaggctggtctgagaactggttccgctgccccaacagtatctacgacatcgactacatcagtggctacgccaaagctgtctacatctttctttgccgttgtgccgacggagaaggacaaagcttcccgggatacaatgcaatcgcaaaagcgattggatttggtcgtactcgaacgatagaagccattaaggaattagaacaagcagggctcttggtgaaagaacaccgacgaaacgaagagacgggtgaatactacagtaatctctacacggtgattcaccctgacgacgttgcttttagggggggtatgtcgccacacggtatacctatgtcgcgtgacgacacacccctgtcgccagacgacatacctatgtcgccacacgacagacgtgtgtcgccaggcggacgagaagtaagatctatagatcaagatccacctacaaagatctacatacacacacggagccaagcagctgccacgttggctaccagcaacaatgagcacctgacatctaacactgcacttgaggaagtgtgtgagactgtaaatgaggcgttggtccagctgggcatacgagcacaaaagaagactctacttcactggttacagattgcgactccggaagagatcttagaagcggcttctcttgctactcgagagggtgtcaaatcaccggctgggtacatcggaacagttcttcggaacggtttggttcgagtcgagaagtcaactgcgaaacataaagaccctagatacaatgaattctataagttgtttccctaa

SEQ ID NO: 391 - DNA, 945 bp, Artificial
  Alicyclobacillus acidocaldarius mutated SEQ ID NO 376
gtgtggtttaagtatacccaaaaacaacagaccacgcaaccctgtgctggcttctccagcctgagaacaatgggacgctttccttcgcgaaggaaagtgttttttcgtcctccactccaaggaggaacgaatatggcctataccccagcaaaagtccgcaaaggctggtctgagaactggttccgctgccccaacagtatctacgacatcgactacatcagtggctacgccaaagctgtctacatctttctttgccgttgtgccgacggagaaggacaaagcttcccgggatacaatgcaatcgcaaaagcgattggatttggtcgtactcgaacgatagaagccattaaggaattagaacaagcagggctcttggtgaaagaacaccgacgaaacgaagagacgggtgaatactacagtaatctctacacggtgattcaccctgacgacgttgcttttagggggggtatgtcgccacacggtatacctatgtcgcgtgacgacacacccatttcgccagacgacatacctatgtcgccacacgacagacgtgtgtcgccaggcggacgagaagtaagatctatagatcaagatccacctacaaagatctacatacacacacggagccaagcagctgccacgttggctaccagcaacaatgagcacctgacatctaacactgcacttgaggaagtgtgtgagactgtaaatgaggcgttggtccagctgggcatacgagcacaaaagaagactctacttcactggttacagattgcgactccggaagagatcattgaagcggcttctcttgctactcgagagggtgtcaaatcaccggctgggtacatcggaacagttcttcggaacggtttggttcgagtcgagaagtcaactgcgaaacataaagaccctagatacaatgaattctataagttgtttccctaa

SEQ ID NO: 392 - protein, 377 aa, Alicyclobacillus acidocaldarius
MRQQVAYLEEQIHLLRHRLFGASSEKRRKTQAESDSVQLSLFNEAEVEADAQSSEETGEADTKAPSEDVETETITYERRKPRAVRERDAWLYQGEADEVVEYRLSDDERVCPKCAGELHEMSREITRRVKIIPAQMKKVEYVRYVYACRHCEAQDVETPVVRAPTPKPVQAKSLATPEAVAYVMTKKFVDGMPLYRQEQQFARHGYPLSRQTLANWVVHAAETWLEPLYAKLRQVLLAQRYLHADETTLQVLHEAGRAAQTQSYMWVYRSGTDEPPVVLYDYQETRNAEHPQRFLAGFQGYLHVDGYAGYEGLPDVTLAGCWAHARRKFDEALKAVPPKERKGKTAAEAIAWRKPTCASLTTSHTPRSPRTFQTSKE

SEQ ID NO: 393 - DNA, 1134 bp, Alicyclobacillus acidocaldarius
ttgcgccaacaggtggcctacttggaggagcagatccatctgctccgtcatcgtctgtttggggcttccagtgaaaaacggcgcaagacccaggctgagtcggacagcgtccagctctcgctgttcaacgaagccgaagtcgaagcggacgcccaaagttcggaagagaccggcgaagccgatacgaaagcgccgtcagaagacgtggagacggagaccatcacgtatgagcgccggaagcctcgcgcggtgcgcgaacgtgacgcctggctatatcagggcgaagcagatgaggtcgtcgaataccgactgtcagatgacgagcgagtctgcccgaaatgtgcgggtgaactgcatgagatgagccgcgagatcacgcggcgcgtgaaaatcatcccggcccagatgaaaaaagtcgagtacgtgcggtacgtgtacgcctgccggcattgtgaagcgcaggacgtggagacccctgtggtgcgtgcaccgacgccgaagccggtgcaggcgaagagtctcgcgacgccggaagcagtggcatacgtgatgacgaagaaatttgtcgacgggatgccgctgtatcggcaagagcaacaatttgcgcggcacgggtatccgctgtcccgccagacgctggcgaactgggtcgtgcacgcggcggagacatggttagagccgctctatgcgaaacttcgccaagtgctcttggcgcagcgttatctgcatgcggacgaaacgacgctgcaagtgttacatgaagccgggcgcgcagcgcagacccagtcgtacatgtgggtgtaccggagcggtacggacgaaccgcctgtggtgctgtacgactaccaagagacgcggaatgcagaacatccgcagcggttcttggcgggatttcaaggttatctgcacgtggatggatacgcgggctatgagggcttgccggatgtcacccttgccggatgttgggcgcatgcgcgacgaaaatttgacgaagccctcaaggcagtgcctcctaaggagcgaaagggtaagacggcggccgaggcaatcgcttggcgcaaacccacgtgtgcgtcgctgacgaccagccacacaccccgcagtccacggacctttcagacttcgaaggaatga

SEQ ID NO: 394 - protein, 327 aa, Syntrophomonas wolfei
LNAKVKWYEEQFRLSRQKQFGASSEKTTPEQINLFNEAEDITDPKLEEPSLETVTYQRKKKQAGQREDKLKDLPVEIIEYRLEKHEQICPCCQGELHEMSIQVRHEIKIIPAQAISVKHVQYIYACRRCEKENITTPIIKAEMPKPILPGSLASPSILAYIMDQKYTNSLPLYRQEQQFSRLGIELSRQTMANWLLAAADPWLKIIYDRLHEQLLEKDILHADETTLQVLKEPGRRAESKSYMWLYRTGRDGPPIVLYDYQTTRASKHPDSFLSGFKGYLQTDGYSGYGSLTSVTLAGCWAHARRKFTEALKALPAEQKDKPVAASI

SEQ ID NO: 395 - protein, 325 aa, Syntrophomonas wolfei
LNAKVKWYEEQYRLSRQKQFGTSSEKTTPEQINLFNEAEDIVDPEIKEPDIETITYERKKKQPGQKADKLKDLPVEVIEYRLLEHEQVCPCCQGSLHEMSTQIRQEIKVIPAQVKVVQHVQYIYSCRQCEKENITTPIIKAQMPNPILPGSLASPSILAYIMDQKYTNSMPLYRQEQQLSRLGIELSRQTMANWVLNVADPWLKIIYDRLHVELLDRDILHADETTLQVLKEPGRSAETKSYMWLYRTGRDGPPIVLYEYQTTRASKHPDRFLSGFKGYLQTDGYSAYGKLTGITLVGCWAHARRKFTEALKALPAAQKDKPVAA

SEQ ID NO: 396 - protein, 227 aa, Moorella thermoacetica
MSTEVRQELKIIPAQVKVVKHIRYVYACRHCEREELTTPVVTAPMPAPVLPGSPVSPSLLAYVMHQKYGEGLPLYRQEQQFKSLGLELSRQTLANWVLHGANTWLTHIYDRLHEYLLKRDILHADETTLQVLREPGREAATKSFLWLYRTGRDGPSIVLYDYQTTRASKHPCRFLAGFKGYLHVDGYAGYNELPDVTLVGCWAHARRKFDEALKALPEDKRNAAVAA

SEQ ID NO: 397 - protein, 314 aa, Bacillus selenitireducens
MQKKKFGTSSEKTDERFEQGSLFNESEKEQDAAEEEPTVEAITYERKKKRKARKDLTENLYTETVTYTLPVEDQVCSCCNGELHIMKTQVKDELEIIPAEVKVKRYETTIYSCRHCERTGTRNPIVKAPSPERPFPGSLASPSIVSYMINQKFVQGVPLYRQEQEFKRMDVPISRQTMSNWIIEASEQMLEPIWDLMIRILTSLDVLHADETTVQVLKEDGKEAAAKSYMWLYRSGSHDVPIVIYDYQPGRASKYPRRFLEGFTGYLHVDGYGGYHALKPKVELVGCWAHARRKFFDAVQTLPDDRDSTTSAAK

SEQ ID NO: 398 - protein, 332 aa, Desulfitobacterium hafniense
IKQQNQWLMEQFRLLKHKQYGASSEQHSAEQMDLFNEAEATAELSAPEPPLTEVKTHYRKRTRLTTDKLPEDLPVEVMEYELPEPERRCPECSGELHTMGRDIWEELKIIPAKAVIVRHIQHVYACRCCEATSEHVPMLKAQRPSPVIKGGFACAETIAHLAVQKFMMGSPLYRQEQEWKHNGILLSRQTMSNWLIKASQDWLEPLYEAMKLRLCEHDVLHGDETTLQVLKEPGKTAQSKSYMWLYRTSGEAKHPLVIYEYQPDRKHNHPQTFLKEFSGYLHTDGYEAYHKLPGNIIVVGCAAHLRRKFFDALKTLPKDRQADSNAAKGVAY

SEQ ID NO: 399 - protein, 377 aa, Artificial
  Alicyclobacillus acidocaldarius mutated SEQ ID NO 392
MRQQVAYLEEQIHLLRHRLFGASSEKRRKTQAESDSVQLSLFNEAEVEADAQSSEETGEADTKAPSEDVETETITYERRKPRAVRERDAWLYQGEADEVVEYRLSDDERVCPKCAGELHEMSREITRRVKIIPAQMKKVEYVRYVYACRHCEAQDVETPVVRAPTPKPVQAKSLATPEAVAYVMTKKFVDGMPLYRQEQQFARHGYPLSRQTLANWVVHAAETWLEPLYAKLRQILLAQRYLHADETTLQVLHEAGRAAQTQSYMWVYRSGTDEPPVVLYDYQETRNAEHPQRFLAGFQGYLHVDGYAGYEGLPDVTLAGCWAHARRKFDEALKAVPPKERKGKTAAEAIAWRKPTCASLTTSHTPRSPRTFQTSKE

SEQ ID NO: 400 - protein, 377 aa, Artificial
  Alicyclobacillus acidocaldarius mutated SEQ ID NO 392
MRQQVAYLEEQIHLLRHRLFGASSEKRRKTQAESDSVQLSLFNEAEVEADAQSSDETGEADTKAPSEDVETETITYERRKPRAVRERDAWLYQGEADEVVEYRLSDDERVCPKCAGELHEMSREITRRVKIIPAQMKKVEYVRYVYACRHCEAQDVETPVVRAPTPKPVQAKSLATPEAVAYVMTKKFVDGMPLYRQEQQFARHGYPLSRQTLANWVVHAAETWLEPLYAKLRQVLLAQRYLHADETTLQVLHEAGRAAQTQSYMWVYRSGTDEPPVVLYDYQETRNAEHPQRFLAGFQGYLHVDGYAGYEGLPDVTLAGCWAHARRKFDEALKAVPPKERKGKTAAEAIAWRKPTCASLTTSHTPRSPRTFQTSKE

SEQ ID NO: 401 - protein, 377 aa, Artificial
  Alicyclobacillus acidocaldarius mutated SEQ ID NO 392
MRQQVAYLEEQIHLLRHRLFGASSEKRRKTQAESDSVQLSLFNEAEVEADAQSSEETGEADTKAPSEDVETETITYERRKPRAVRERDAWLYQGEADEVVEYRLSDDERVCPKCAGELHEMSREITKRVKIIPAQMKKVEYVRYVYACRHCEAQDVETPVVRAPTPKPVQAKSLATPEAVAYVMTKKFVDGMPLYRQEQQFARHGYPLSRQTLANWVVHAAETWLEPLYAKLRQVLLAQRYLHADETTLQVLHEAGRAAQTQSYMWVYRSGTDEPPVVLYDYQETRNAEHPQRFLAGFQGYLHVDGYAGYEGLPDVTLAGCWAHARRKFDEALKAVPPKERKGKTAAEAIAWRKPTCASLTTSHTPRSPRTFQTSKE

SEQ ID NO: 402 - protein, 377 aa, Artificial
  Alicyclobacillus acidocaldarius mutated SEQ ID NO 392
MRQQIAYLEEQIHLLRHRLFGASSEKRRKTQAESDSVQLSLFNEAEVEADAQSSEETGEADTKAPSEDVETETITYERRKPRAVRERDAWLYQGEADEVVEYRLSDDERVCPKCAGELHEMSREITRRVKIIPAQMKKVEYVRYVYACRHCEAQDVETPVVRAPTPKPVQAKSLATPEAVAYVMTKKFVDGMPLYRQEQQFARHGYPLSRQTLANWVVHAAETWLEPLYAKLRQVLLAQRYLHADETTLQVLHEAGRAAQTQSYMWVYRSGTDEPPVVLYDYQETRNAEHPQRFLAGFQGYLHVDGYAGYEGLPDVTLAGCWAHARRKFDEALKAVPPKERKGKTAAEAIAWRKPTCASLTTSHTPRSPRTFQTSKE

SEQ ID NO: 403 - protein, 377 aa, Artificial
  Alicyclobacillus acidocaldarius mutated SEQ ID NO 392
MRQQVAYLEEQIHLLRHRLFGASSEKRRKTQAESDSVQLSLFNEAEVEADAQSSEETGEADTKAPSEDVETETITYERRKPRAVRERDAWLYQGEADEVVEYRLSEDERVCPKCAGELHEMSREITRRVKIIPAQMKKVEYVRYVYACRHCEAQDVETPVVRAPTPKPVQAKSLATPEAVAYVMTKKFVDGMPLYRQEQQFARHGYPLSRQTLANWVVHAAETWLEPLYAKLRQVLLAQRYLHADETTLQVLHEAGRAAQTQSYMWVYRSGTDEPPVVLYDYQETRNAEHPQRFLAGFQGYLHVDGYAGYEGLPDVTLAGCWAHARRKFDEALKAVPPKERKGKTAAEAIAWRKPTCASLTTSHTPRSPRTFQTSKE

SEQ ID NO: 404 - DNA, 1134 bp, Artificial
  Alicyclobacillus acidocaldarius mutated SEQ ID NO 393
ttgcgccaacaggtggcctacttggaggagcagatccatctgctccgtcatcgtctgtttggggcttccagtgaaaaacggcgcaagacccaggctgagtcggacagcgtccagctctcgctgttcaacgaagccgaagtcgaagcggacgcccaaagttcggaagagaccggcgaagccgatacgaaagcgccgtcagaagacgtggagacggagaccatcacgtatgagcgccggaagcctcgcgcggtgcgcgaacgtgacgcctggctatatcagggcgaagcagatgaggtcgtcgaataccgactgtcagatgacgagcgagtctgcccgaaatgtgcgggtgaactgcatgagatgagccgcgagatcacgcggcgcgtgaaaatcatcccggcccagatgaaaaaagtcgagtacgtgcggtacgtgtacgcctgccggcattgtgaagcgcaggacgtggagacccctgtggtgcgtgcaccgacgccgaagccggtgcaggcgaagagtctcgcgacgccggaagcagtggcatacgtgatgacgaagaaatttgtcgacgggatgccgctgtatcggcaagagcaacaatttgcgcggcacgggtatccgctgtcccgccagacgctggcgaactgggtcgtgcacgcggcggagacatggttagagccgctctatgcgaaacttcgccaaattctcttggcgcagcgttatctgcatgcggacgaaacgacgctgcaagtgttacatgaagccgggcgcgcagcgcagacccagtcgtacatgtgggtgtaccggagcggtacggacgaaccgcctgtggtgctgtacgactaccaagagacgcggaatgcagaacatccgcagcggttcttggcgggatttcaaggttatctgcacgtggatggatacgcgggctatgagggcttgccggatgtcacccttgccggatgttgggcgcatgcgcgacgaaaatttgacgaagccctcaaggcagtgcctcctaaggagcgaaagggtaagacggcggccgaggcaatcgcttggcgcaaacccacgtgtgcgtcgctgacgaccagccacacaccccgcagtccacggacctttcagacttcgaaggaatga

SEQ ID NO: 405 - DNA, 1134 bp, Artificial
  Alicyclobacillus acidocaldarius mutated SEQ ID NO 393
ttgcgccaacaggtggcctacttggaggagcagatccatctgctccgtcatcgtctgtttggggcttccagtgaaaaacggcgcaagacccaggctgagtcggacagcgtccagctctcgctgttcaacgaagccgaagtcgaagcggacgcccaaagttcggatgagaccggcgaagccgatacgaaagcgccgtcagaagacgtggagacggagaccatcacgtatgagcgccggaagcctcgcgcggtgcgcgaacgtgacgcctggctatatcagggcgaagcagatgaggtcgtcgaataccgactgtcagatgacgagcgagtctgcccgaaatgtgcgggtgaactgcatgagatgagccgcgagatcacgcggcgcgtgaaaatcatcccggcccagatgaaaaaagtcgagtacgtgcggtacgtgtacgcctgccggcattgtgaagcgcaggacgtggagacccctgtggtgcgtgcaccgacgccgaagccggtgcaggcgaagagtctcgcgacgccggaagcagtggcatacgtgatgacgaagaaatttgtcgacgggatgccgctgtatcggcaagagcaacaatttgcgcggcacgggtatccgctgtcccgccagacgctggcgaactgggtcgtgcacgcggcggagacatggttagagccgctctatgcgaaacttcgccaagtgctcttggcgcagcgttatctgcatgcggacgaaacgacgctgcaagtgttacatgaagccgggcgcgcagcgcagacccagtcgtacatgtgggtgtaccggagcggtacggacgaaccgcctgtggtgctgtacgactaccaagagacgcggaatgcagaacatccgcagcggttcttggcgggatttcaaggttatctgcacgtggatggatacgcgggctatgagggcttgccggatgtcacccttgccggatgttgggcgcatgcgcgacgaaaatttgacgaagccctcaaggcagtgcctcctaaggagcgaaagggtaagacggcggccgaggcaatcgcttggcgcaaacccacgtgtgcgtcgctgacgaccagccacacaccccgcagtccacggacctttcagacttcgaaggaatga

SEQ ID NO: 406 - DNA, 1134 bp, Artificial
  Alicyclobacillus acidocaldarius mutated SEQ ID NO 393
ttgcgccaacaggtggcctacttggaggagcagatccatctgctccgtcatcgtctgtttggggcttccagtgaaaaacggcgcaagacccaggctgagtcggacagcgtccagctctcgctgttcaacgaagccgaagtcgaagcggacgcccaaagttcggaagagaccggcgaagccgatacgaaagcgccgtcagaagacgtggagacggagaccatcacgtatgagcgccggaagcctcgcgcggtgcgcgaacgtgacgcctggctatatcagggcgaagcagatgaggtcgtcgaataccgactgtcagatgacgagcgagtctgcccgaaatgtgcgggtgaactgcatgagatgagccgcgagatcacgaaacgcgtgaaaatcatcccggcccagatgaaaaaagtcgagtacgtgcggtacgtgtacgcctgccggcattgtgaagcgcaggacgtggagacccctgtggtgcgtgcaccgacgccgaagccggtgcaggcgaagagtctcgcgacgccggaagcagtggcatacgtgatgacgaagaaatttgtcgacgggatgccgctgtatcggcaagagcaacaatttgcgcggcacgggtatccgctgtcccgccagacgctggcgaactgggtcgtgcacgcggcggagacatggttagagccgctctatgcgaaacttcgccaagtgctcttggcgcagcgttatctgcatgcggacgaaacgacgctgcaagtgttacatgaagccgggcgcgcagcgcagacccagtcgtacatgtgggtgtaccggagcggtacggacgaaccgcctgtggtgctgtacgactaccaagagacgcggaatgcagaacatccgcagcggttcttggcgggatttcaaggttatctgcacgtggatggatacgcgggctatgagggcttgccggatgtcacccttgccggatgttgggcgcatgcgcgacgaaaatttgacgaagccctcaaggcagtgcctcctaaggagcgaaagggtaagacggcggccgaggcaatcgcttggcgcaaacccacgtgtgcgtcgctgacgaccagccacacaccccgcagtccacggacctttcagacttcgaaggaatga

SEQ ID NO: 407 - DNA, 1134 bp, Artificial
  Alicyclobacillus acidocaldarius mutated SEQ ID NO 393
ttgcgccaacagattgcctacttggaggagcagatccatctgctccgtcatcgtctgtttggggcttccagtgaaaaacggcgcaagacccaggctgagtcggacagcgtccagctctcgctgttcaacgaagccgaagtcgaagcggacgcccaaagttcggaagagaccggcgaagccgatacgaaagcgccgtcagaagacgtggagacggagaccatcacgtatgagcgccggaagcctcgcgcggtgcgcgaacgtgacgcctggctatatcagggcgaagcagatgaggtcgtcgaataccgactgtcagatgacgagcgagtctgcccgaaatgtgcgggtgaactgcatgagatgagccgcgagatcacgcggcgcgtgaaaatcatcccggcccagatgaaaaaagtcgagtacgtgcggtacgtgtacgcctgccggcattgtgaagcgcaggacgtggagacccctgtggtgcgtgcaccgacgccgaagccggtgcaggcgaagagtctcgcgacgccggaagcagtggcatacgtgatgacgaagaaatttgtcgacgggatgccgctgtatcggcaagagcaacaatttgcgcggcacgggtatccgctgtcccgccagacgctggcgaactgggtcgtgcacgcggcggagacatggttagagccgctctatgcgaaacttcgccaagtgctcttggcgcagcgttatctgcatgcggacgaaacgacgctgcaagtgttacatgaagccgggcgcgcagcgcagacccagtcgtacatgtgggtgtaccggagcggtacggacgaaccgcctgtggtgctgtacgactaccaagagacgcggaatgcagaacatccgcagcggttcttggcgggatttcaaggttatctgcacgtggatggatacgcgggctatgagggcttgccggatgtcacccttgccggatgttgggcgcatgcgcgacgaaaatttgacgaagccctcaaggcagtgcctcctaaggagcgaaagggtaagacggcggccgaggcaatcgcttggcgcaaacccacgtgtgcgtcgctgacgaccagccacacaccccgcagtccacggacctttcagacttcgaaggaatga

SEQ ID NO: 408 - DNA, 1134 bp, Artificial
  Alicyclobacillus acidocaldarius mutated SEQ ID NO 393
ttgcgccaacaggtggcctacttggaggagcagatccatctgctccgtcatcgtctgtttggggcttccagtgaaaaacggcgcaagacccaggctgagtcggacagcgtccagctctcgctgttcaacgaagccgaagtcgaagcggacgcccaaagttcggaagagaccggcgaagccgatacgaaagcgccgtcagaagacgtggagacggagaccatcacgtatgagcgccggaagcctcgcgcggtgcgcgaacgtgacgcctggctatatcagggcgaagcagatgaggtcgtcgaataccgactgtcagaagacgagcgagtctgcccgaaatgtgcgggtgaactgcatgagatgagccgcgagatcacgcggcgcgtgaaaatcatcccggcccagatgaaaaaagtcgagtacgtgcggtacgtgtacgcctgccggcattgtgaagcgcaggacgtggagacccctgtggtgcgtgcaccgacgccgaagccggtgcaggcgaagagtctcgcgacgccggaagcagtggcatacgtgatgacgaagaaatttgtcgacgggatgccgctgtatcggcaagagcaacaatttgcgcggcacgggtatccgctgtcccgccagacgctggcgaactgggtcgtgcacgcggcggagacatggttagagccgctctatgcgaaacttcgccaagtgctcttggcgcagcgttatctgcatgcggacgaaacgacgctgcaagtgttacatgaagccgggcgcgcagcgcagacccagtcgtacatgtgggtgtaccggagcggtacggacgaaccgcctgtggtgctgtacgactaccaagagacgcggaatgcagaacatccgcagcggttcttggcgggatttcaaggttatctgcacgtggatggatacgcgggctatgagggcttgccggatgtcacccttgccggatgttgggcgcatgcgcgacgaaaatttgacgaagccctcaaggcagtgcctcctaaggagcgaaagggtaagacggcggccgaggcaatcgcttggcgcaaacccacgtgtgcgtcgctgacgaccagccacacaccccgcagtccacggacctttcagacttcgaaggaatga

SEQ ID NO: 409 - protein, 120 aa, Alicyclobacillus acidocaldarius
MLAFDWTSDHRVYLACGATDMRKSIDGLAALVQASFQLDPFSPCLFVFCNRQRDKLKILHWSHNGFWLYYRRLERGRFDWPETGDAKTMVITRRELNWLLDGLPLEQPRAHRAVYVRSAI

SEQ ID NO: 410 - DNA, 363 bp, Alicyclobacillus acidocaldarius
ttgttagccttcgactggacttcggatcaccgcgtgtatctcgcctgcggtgccacagacatgcgcaaatccattgacggactcgccgcgctcgtccaggcgtcgtttcagctcgatccgttttcgccatgtttgtttgtcttctgcaatcggcaacgggacaagctcaaaatcctgcactggtcgcacaacggcttttggctgtactatcggcgcttagagcgcggccgattcgactggcccgagactggcgatgccaagaccatggtgatcacacggcgagagctgaactggctcctggatggtctgccgctcgagcagccgagagcgcatcgagccgtgtatgtccgttctgcgatctaa

SEQ ID NO: 411 - protein, 110 aa, Moorella thermoacetica
RVYLACGATDLRKSIDGLAVLVKEGFELDPFSSCLFVFCNRNRDKLKILHWEHNGFWLYYRRLEKGKFVWPQDTTSSTITITRRELRWLLDGLPLKQPQAHPEVKARTIL

SEQ ID NO: 412 - protein, 110 aa, Pelotomaculum thermopropionicum
RVYLALGATDLRKSIDGLAVLVKEGFELDPFSSCLFVFCNRKCDKLKILHWDHNGFWLHYRRLEKGKFHWPADAGSPTLVISRRELRWLLDGLSLKQPKAHPEVKARTIL

SEQ ID NO: 413 - protein, 112 aa, Syntrophomonas wolfei
SNRQVYLACGSTDLRKSIDGLAVLVKEAFELNPFSPCLFVFCNRQRNKLKILQWDHNGFWLYYRRLERGKFEWPAADSQVVSISYREFRWLLDGLSLKQKQAHKAVKERTII

SEQ ID NO: 414 - protein, 109 aa, Syntrophomonas wolfei
SNRLVYLACGSTDLRKSIDGLAVLVKESFHLDPFSPCLFVFCNRKRDKLKILQWEHNGFWLHYRRLERGKFDWPTAHTDVVSISYREFRWLLDGLSLKQNQAHKAVKQR

SEQ ID NO: 415 - protein, 101 aa, Bacillus selenitireducens
VYLARGSTDLRKSIDGLAAIVQEGFELDPFSSSLFVFCNRYRDKIKILYWDHNGFWLYYRRLEKGRFPWPTSGSDEPMIITERQLRWLLDGLPLDQKGAHR

SEQ ID NO: 416 - protein, 120 aa, Artificial
  Alicyclobacillus acidocaldarius mutated SEQ ID NO 409
MLAFDWTSDHRVYLACGATDMRKSIDGLAALVQASFQLDPFSPCLFVFCNRQKDKLKILHWSHNGFWLYYRRLERGRFDWPETGDAKTMVITRRELNWLLDGLPLEQPRAHRAVYVRSAI

SEQ ID NO: 417 - protein, 120 aa, Artificial
  Alicyclobacillus acidocaldarius mutated SEQ ID NO 409
MLAFDWTSDHRVYLACGATDMRKSIDGLAALVQASFQLDPFSPCLFVFCNRQRDKLKILHWSHNGFWLYYRRLERGRFDWPETGDAKTMIITRRELNWLLDGLPLEQPRAHRAVYVRSAI

SEQ ID NO: 418 - protein, 120 aa, Artificial
  Alicyclobacillus acidocaldarius mutated SEQ ID NO 409
MLAFDWTSDHRVYLACGATDMRKSIDGLAALVQASFQLDPFSPCLFVFCNRQRDKLKILHWSHNGFWLYYRRLERGRFDWPDTGDAKTMVITRRELNWLLDGLPLEQPRAHRAVYVRSAI

SEQ ID NO: 419 - protein, 120 aa, Artificial
  Alicyclobacillus acidocaldarius mutated SEQ ID NO 409
MIAFDWTSDHRVYLACGATDMRKSIDGLAALVQASFQLDPFSPCLFVFCNRQRDKLKILHWSHNGFWLYYRRLERGRFDWPETGDAKTMVITRRELNWLLDGLPLEQPRAHRAVYVRSAI

SEQ ID NO: 420 - protein, 120 aa, Artificial
  Alicyclobacillus acidocaldarius mutated SEQ ID NO 409
MLAFDWTSDHRVYLACGATDMRKSIDGLAALVQASFQLDPFSPCLFVFCNRQRDKLKILHWSHNGFWLYYRRLERGRFDWPETGEAKTMVITRRELNWLLDGLPLEQPRAHRAVYVRSAI

SEQ ID NO: 421 - DNA, 363 bp, Artificial
  Alicyclobacillus acidocaldarius mutated SEQ ID NO 410
ttgttagccttcgactggacttcggatcaccgcgtgtatctcgcctgcggtgccacagacatgcgcaaatccattgacggactcgccgcgctcgtccaggcgtcgtttcagctcgatccgttttcgccatgtttgtttgtcttctgcaatcggcaaaaagacaagctcaaaatcctgcactggtcgcacaacggcttttggctgtactatcggcgcttagagcgcggccgattcgactggcccgagactggcgatgccaagaccatggtgatcacacggcgagagctgaactggctcctggatggtctgccgctcgagcagccgagagcgcatcgagccgtgtatgtccgttctgcgatctaa

SEQ ID NO: 422 - DNA, 363 bp, Artificial
  Alicyclobacillus acidocaldarius mutated SEQ ID NO 410
ttgttagccttcgactggacttcggatcaccgcgtgtatctcgcctgcggtgccacagacatgcgcaaatccattgacggactcgccgcgctcgtccaggcgtcgtttcagctcgatccgttttcgccatgtttgtttgtcttctgcaatcggcaacgggacaagctcaaaatcctgcactggtcgcacaacggcttttggctgtactatcggcgcttagagcgcggccgattcgactggcccgagactggcgatgccaagaccatgattatcacacggcgagagctgaactggctcctggatggtctgccgctcgagcagccgagagcgcatcgagccgtgtatgtccgttctgcgatctaa

SEQ ID NO: 423 - DNA, 363 bp, Artificial
  Alicyclobacillus acidocaldarius mutated SEQ ID NO 410
ttgttagccttcgactggacttcggatcaccgcgtgtatctcgcctgcggtgccacagacatgcgcaaatccattgacggactcgccgcgctcgtccaggcgtcgtttcagctcgatccgttttcgccatgtttgtttgtcttctgcaatcggcaacgggacaagctcaaaatcctgcactggtcgcacaacggcttttggctgtactatcggcgcttagagcgcggccgattcgactggcccgatactggcgatgccaagaccatggtgatcacacggcgagagctgaactggctcctggatggtctgccgctcgagcagccgagagcgcatcgagccgtgtatgtccgttctgcgatctaa

SEQ ID NO: 424 - DNA, 363 bp, Artificial
  Alicyclobacillus acidocaldarius mutated SEQ ID NO 410
ttgattgccttcgactggacttcggatcaccgcgtgtatctcgcctgcggtgccacagacatgcgcaaatccattgacggactcgccgcgctcgtccaggcgtcgtttcagctcgatccgttttcgccatgtttgtttgtcttctgcaatcggcaacgggacaagctcaaaatcctgcactggtcgcacaacggcttttggctgtactatcggcgcttagagcgcggccgattcgactggcccgagactggcgatgccaagaccatggtgatcacacggcgagagctgaactggctcctggatggtctgccgctcgagcagccgagagcgcatcgagccgtgtatgtccgttctgcgatctaa

SEQ ID NO: 425 - DNA, 363 bp, Artificial
  Alicyclobacillus acidocaldarius mutated SEQ ID NO 410
ttgttagccttcgactggacttcggatcaccgcgtgtatctcgcctgcggtgccacagacatgcgcaaatccattgacggactcgccgcgctcgtccaggcgtcgtttcagctcgatccgttttcgccatgtttgtttgtcttctgcaatcggcaacgggacaagctcaaaatcctgcactggtcgcacaacggcttttggctgtactatcggcgcttagagcgcggccgattcgactggcccgagactggcgaagccaagaccatggtgatcacacggcgagagctgaactggctcctggatggtctgccgctcgagcagccgagagcgcatcgagccgtgtatgtccgttctgcgatctaa

SEQ ID NO: 426 - protein, 130 aa, Alicyclobacillus acidocaldarius
MAFILPSVENVVIKPREGSCMREHMSHQERRELWRERIAAFYDSGQSASQFCAEHGLKPHQFWYWLRRLRNETAPGTQATSFVSVVTTSSPSDASRSPLTLRVGSVEIDVHPGYDASTLAELIRLVMHVC

SEQ ID NO: 427 - DNA, 393 bp, Alicyclobacillus acidocaldarius
atggctttcatcctcccgtcggttgagaatgtcgtcatcaagccacgagagggttcttgtatgcgagagcacatgtctcaccaggagcgtcgtgaactttggcgtgaacgtatcgctgccttctacgacagcggccagtccgccagtcagttttgcgctgaacacggtctgaagcctcatcagttctggtactggcttcgtcgactacgaaacgaaaccgcacctggtacgcaagccacgtcgttcgtgtcggtcgtgacgacctcatcaccttcggatgcaagccgttcgcccctgaccctgcgcgtgggttcggtcgagattgacgtccatcctggctacgacgcctcgacgcttgctgagctcatccggctcgtgatgcacgtttgttag

SEQ ID NO: 428 - protein, 107 aa, Moorella thermoacetica
MTKAELQELWASRIAEYKMSGQSVKEWCATHEGVSPRQLWYWLRKYKNQNGVLSAQSTRWLPVEISEQTSNVSNSLLVRIGPAIIEVSPSFDPVLLSQVVKVLVALC

SEQ ID NO: 429 - protein, 105 aa, Syntrophomonas wolfei
MSSNERKAWWEERLAEHEASGQRVTAWCEENSITPRQFYYWRRKLRTEHVEKEQPVKWLSLKYESRQLGIAGDAIAVHVGQATVEIRKGFDRELFCEIIQVLQTI

SEQ ID NO: 430 - protein, 103 aa, Syntrophomonas wolfei
MVNNDLRSLWEQRLADYETSGKSIATWCREHSIRNNQFYYWRKKLRMDQVENNQPVKWLPLEVEQANLAPGSIGVHVGQATVEIKPGFDPHLLRQIVKVLQTI

SEQ ID NO: 431 - protein, 99 aa, delta proteobacterium
RSKRRFWAAHVAAWEKSGLTQTAYCREHGLSRHAFGWWRRKFRDQPASEQPLLVQVPTVARPTAATAAADFSGLRLLLPRGLQLEINQGFDAATLGRVI

SEQ ID NO: 432 - protein, 99 aa, delta proteobacterium
RSKRRFWAAHVAAWEKSGLTQTAYCREHGLSRHAFGWWRRKFRDQPASEQPLLVQVPTVTRPTAATAAADFSGLRLLLPRGLQLEINQGFDAATLGRVI

SEQ ID NO: 433 - protein, 130 aa, Artificial
  Alicyclobacillus acidocaldarius mutated SEQ ID NO 426
MAFILPSVENVVIKPREGSCMREHMSHQERRELWRDRIAAFYDSGQSASQFCAEHGLKPHQFWYWLRRLRNETAPGTQATSFVSVVTTSSPSDASRSPLTLRVGSVEIDVHPGYDASTLAELIRLVMHVC

SEQ ID NO: 434 - protein, 130 aa, Artificial
  Alicyclobacillus acidocaldarius mutated SEQ ID NO 426
MAFILPSVENVVIKPREGSCMREHMSHQERRELWRERIAAFYDSGQSASQFCAEHGLKPHQFWYWLRRLRNETAPGTQATSFVSVVTTSSPSDASRSPLTLRVGSVEIDVHPGYDASTLAELIRIVMHVC

SEQ ID NO: 435 - protein, 130 aa, Artificial
  Alicyclobacillus acidocaldarius mutated SEQ ID NO 426
MAFILPSVENVVIKPREGSCMREHMSHNERRELWRERIAAFYDSGQSASQFCAEHGLKPHQFWYWLRRLRNETAPGTQATSFVSVVTTSSPSDASRSPLTLRVGSVEIDVHPGYDASTLAELIRLVMHVC

SEQ ID NO: 436 - protein, 130 aa, Artificial
  Alicyclobacillus acidocaldarius mutated SEQ ID NO 426
MAFILPSVENVVIRPREGSCMREHMSHQERRELWRERIAAFYDSGQSASQFCAEHGLKPHQFWYWLRRLRNETAPGTQATSFVSVVTTSSPSDASRSPLTLRVGSVEIDVHPGYDASTLAELIRLVMHVC

SEQ ID NO: 437 - protein, 130 aa, Artificial
  Alicyclobacillus acidocaldarius mutated SEQ ID NO 426
MAFILPSVENVVIKPREGSCMREHMSHQERRELWRERIAAFYDSGQSASQFCAEHGLKPHQFWYWLRRLRNETAPGTQATSFVSVVTTSSPSDASRSPLTLRVGSVEIDVHPGYDASTLAELIKLVMHVC

SEQ ID NO: 438 - DNA, 393 bp, Artificial
  Alicyclobacillus acidocaldarius mutated SEQ ID NO 427
atggctttcatcctcccgtcggttgagaatgtcgtcatcaagccacgagagggttcttgtatgcgagagcacatgtctcaccaggagcgtcgtgaactttggcgtgatcgtatcgctgccttctacgacagcggccagtccgccagtcagttttgcgctgaacacggtctgaagcctcatcagttctggtactggcttcgtcgactacgaaacgaaaccgcacctggtacgcaagccacgtcgttcgtgtcggtcgtgacgacctcatcaccttcggatgcaagccgttcgcccctgaccctgcgcgtgggttcggtcgagattgacgtccatcctggctacgacgcctcgacgcttgctgagctcatccggctcgtgatgcacgtttgttag

SEQ ID NO: 439 - DNA, 393 bp, Artificial
  Alicyclobacillus acidocaldarius mutated SEQ ID NO 427
atggctttcatcctcccgtcggttgagaatgtcgtcatcaagccacgagagggttcttgtatgcgagagcacatgtctcaccaggagcgtcgtgaactttggcgtgaacgtatcgctgccttctacgacagcggccagtccgccagtcagttttgcgctgaacacggtctgaagcctcatcagttctggtactggcttcgtcgactacgaaacgaaaccgcacctggtacgcaagccacgtcgttcgtgtcggtcgtgacgacctcatcaccttcggatgcaagccgttcgcccctgaccctgcgcgtgggttcggtcgagattgacgtccatcctggctacgacgcctcgacgcttgctgagctcatccggattgtgatgcacgtttgttag

SEQ ID NO: 440 - DNA, 393 bp, Artificial
  Alicyclobacillus acidocaldarius mutated SEQ ID NO 427
atggctttcatcctcccgtcggttgagaatgtcgtcatcaagccacgagagggttcttgtatgcgagagcacatgtctcacaatgagcgtcgtgaactttggcgtgaacgtatcgctgccttctacgacagcggccagtccgccagtcagttttgcgctgaacacggtctgaagcctcatcagttctggtactggcttcgtcgactacgaaacgaaaccgcacctggtacgcaagccacgtcgttcgtgtcggtcgtgacgacctcatcaccttcggatgcaagccgttcgcccctgaccctgcgcgtgggttcggtcgagattgacgtccatcctggctacgacgcctcgacgcttgctgagctcatccggctcgtgatgcacgtttgttag

SEQ ID NO: 441 - DNA, 393 bp, Artificial
  Alicyclobacillus acidocaldarius mutated SEQ ID NO 427
atggctttcatcctcccgtcggttgagaatgtcgtcatccgtccacgagagggttcttgtatgcgagagcacatgtctcaccaggagcgtcgtgaactttggcgtgaacgtatcgctgccttctacgacagcggccagtccgccagtcagttttgcgctgaacacggtctgaagcctcatcagttctggtactggcttcgtcgactacgaaacgaaaccgcacctggtacgcaagccacgtcgttcgtgtcggtcgtgacgacctcatcaccttcggatgcaagccgttcgcccctgaccctgcgcgtgggttcggtcgagattgacgtccatcctggctacgacgcctcgacgcttgctgagctcatccggctcgtgatgcacgtttgttag

SEQ ID NO: 442 - DNA, 393 bp, Artificial
  Alicyclobacillus acidocaldarius mutated SEQ ID NO 427
atggctttcatcctcccgtcggttgagaatgtcgtcatcaagccacgagagggttcttgtatgcgagagcacatgtctcaccaggagcgtcgtgaactttggcgtgaacgtatcgctgccttctacgacagcggccagtccgccagtcagttttgcgctgaacacggtctgaagcctcatcagttctggtactggcttcgtcgactacgaaacgaaaccgcacctggtacgcaagccacgtcgttcgtgtcggtcgtgacgacctcatcaccttcggatgcaagccgttcgcccctgaccctgcgcgtgggttcggtcgagattgacgtccatcctggctacgacgcctcgacgcttgctgagctcatcaaactcgtgatgcacgtttgttag

SEQ ID NO: 443 - protein, 410 aa, Alicyclobacillus acidocaldarius
MNEKPQAVVVIGTREHEGEVELVRALGYRVLLLNTKINIEDALVADVPVELDLNDETLVISKVIDLTNHYYIKAVFTLNEYRVPLSARIAETLGLQRTISYEAAQNCRNKKLTRRTLMRNGIQAMKFATVKTPAEALDVIADMDLPVVVKPANDAGSHLVYRCDTLQEVWEAVEAIAQTPYNWVGQNRDPEILIEEYLVGKEYSVEACTIQGETHILAITEKETTTTNVSVEIGHTVPAILEEEQVSSIHDLVKKALRALGVDNCVTHTEIKLDGNSLRIVEVNARPAGDKIPLLVRAVTGYDLRELALHIALGGQFENAPRHEVLAPVAAIRFLIADKHGVVSYDSRGVLEFEEMKYIEFFTKNGYVVKKTTSNYNRLGYFVVFGKNRDHVETVNRKILSKLNLRISDI

SEQ ID NO: 444 - DNA, 1233 bp, Alicyclobacillus acidocaldarius
atgaatgaaaagccgcaggcagtagttgtaataggtacacgtgaacatgaaggagaagttgagcttgttcgtgcattgggctatcgcgttctattattgaatacaaagattaacatcgaagatgcgttagttgcagacgtccccgttgaattagatttgaatgacgagaccctcgttattagtaaggtaatcgatttaacaaaccactattacattaaagcagtatttacattgaacgaatatcgcgtaccattgagtgctcgaattgcggaaactctaggattacaaagaacaatttcgtacgaggctgctcaaaattgccggaacaaaaaattgactcgacgaacgttaatgcgaaacggtattcaagcaatgaagtttgctacagtaaaaactcctgcagaagcgctcgacgtaattgcagacatggatcttccagtcgttgttaaaccagcaaacgatgcggggagtcacttggtttatcgttgtgatacacttcaagaagtgtgggaggctgtagaggctatcgcccaaacaccctataattgggttggtcaaaatcgagatcctgagattctgattgaagagtaccttgttggtaaggaatatagtgtggaggcatgtactatccaaggtgaaactcatatattagccataactgagaaagaaacaacaaccacaaatgtgtcagttgaaattggtcatacggttccagctattcttgaggaagaacaagtttcttctattcacgatttagttaagaaagcccttcgggcgttaggcgtagacaattgtgtgacacatactgaaattaagcttgatgggaacagtcttcggattgtcgaggttaatgctcgaccggcgggagataaaatcccactcttagtgagggcggttactggttacgatcttcgggaattggcattgcatatagctttaggcgggcaatttgaaaacgcgccgcgccatgaagtcttagcccccgttgcggcaattcgatttttaatagcggataaacatggggtagtttcttatgacagccgaggtgtgcttgagtttgaagaaatgaagtatattgaattttttactaagaatggatatgtcgtaaagaaaacaactagtaactataatcgtcttggttatttcgtggtcttcggtaaaaatcgcgaccatgtggaaaccgtaaatcgcaagatcttatcaaagttgaatttgcggatttccgatatatag

SEQ ID NO: 445 - protein, 401 aa, Bacillus cereus
QYVLVISPRDNEVDLVKELGYGVILIRKNISFDEMFSVEVPVEIDLNDEEIVVGKCKELSEKYNVVGVYTLNEYRIPLAAKVGEILEINSFLSYETAITCRNKKLARKKLNNSNVSSVKFILIRKLDNLNEKLEGFSFPVIVKPSNDSGSKNVYLCKDYNEVKQAVDVISNSKLNLVGQTLDPEAIVEEYLDGPEYSIESYTIDGKTTIVGVTEKVVTPFPLSVEVGHNFPAVLEEDIETSIHETVINALDVIGVDFGVTHTEVKVTSDGPKVIEVNARPGGDRITDLVEYVTGIDLRRIALRINLGLPIKNSCCNKELVPSSSIRFLIADKEGYISFNENFRAESIKEIHWYVNKGERVNKTTSNFDRIGYYIVDGNKKESSKKIADSLNECFELAISEL

SEQ ID NO: 446 - protein, 401 aa, Bacillus cereus
QYVLVISPRDNEVDLVKELGYGVILIRKNISFDEMFSVEVPVEIDLNDEETVVGKCKELSEKYNIVGVYTLNEYRIPLAAKVGEILEINSFLSYETAIICRNKKLARKKLNDSNVSSVKFVLIRELDNLNEKLEDFSFPVIVKPSNDSGSKNVYLCKDYNEVKQAVDVISHSKLNLVGQTLDPEAIVEEYLDGPEYSIESYTIDGKTTIVGVTEKVVTPFPLSVEVGHNFPAVLEEDIETSIHETVINALDVIGVDFGVTHTEVKVTSDGPKVIEVNARPGGDRITDLVEYVTGIDLRRIALRINLGLPIKNSCCNKELVSSSSIRFLIADKEGYISFNENFRAESIKEIHWYVNKGERVNKTTSNFDRIGYYIVDGNTKESSKKIADSLNGCFELAISEL

SEQ ID NO: 447 - protein, 391 aa, Photorhabdus luminescens
KKPSGSIELKKAKELGAYIIFIGSRKYYNKVSDNDLLYIDEFFEADTNDDELVINMVEYINAKKKIQGVITFMEFYVPLVAKVAETLGLKGITYENALRARNKHLMRESFRQKNVPIPKYALISNIDSAKIEAAKIGYPNIIKPINMAGSRGVLRNDNVIELERNFREVCEITPPFGVKKSSLFLIEEYLEGQEYSIESISFNGVVNIVTITKKYVSSNGYFVELGHTLPANIPLQQKIEIEKVVTQALFALGIYNGGGHTEVKVTSDGVKVIEVGARLGGDHIPELVEMATGIDMWKAVIQVSLNISPDLSKKFSKYAAISYITAPSGIVKKVNYIKNGFIHFDVNVGEHIESLKNSSQRLEYAIACGVTAEQAEFESHHLKENIIIEIA

SEQ ID NO: 448 - protein, 357 aa, Saccharopolyspora erythraea
ETNDVAALAEHVARLQPVLGFDGVLTSCDYYLPAVAHIAARLGLPGAPPEAVERACSKDLTRRALREAGVPGPAFALAESAAGLEEAAAALGYPLVLKPVDLCAGMFVRKVTDDVELRDAYAALRQFPVNARGQRRNPLVLLEELLTGPEVSVETVTSRGRTSVIGVTDKSIAGAPWFVETGHMFPAALDLDTERAVVETAVAAVEALGLDNVVGHTELKLTPDGPRIVEVNPRPAGNQITELVRRVTGIDLAAAYAQVALGEEPALERAETGAGSAAISFLLPPKEGVIGEVVGVQDLDGADGVVDWKFKSSGHRSGPATSNNNYLGHVMVTAPDPGRARAKAEALVGGLDVRYAE

SEQ ID NO: 449 - protein, 359 aa, Streptomyces collinus
IRCDTNSDAALRAALQDRFRREEIAGVTTTSDFYVPAAARLARWLGLPGNPPEAVTACRDKSALRALLRRAGVHQPRYAVVREPGEVAAAVARTGLPCVVKPADDSGSVNVLLCTDEAQARAQAERILAVTTNVRGMPTARTVLVEEYLDGPEYSVEMFSQDGEAVCVGITAKSVTGDPHFVEHRHLFPAPLPAATAERITETVMAALDAAGIRLGATHTEVKLTGSGPAVIEINPRPAGGMIPELVRLASGVDLLEQQLKAATGQAPDLKPGHGAHAGIQFLLADADGVLDAVDGVARARAVDGVEAVTVTVAPGAVVRRARSAGDRVGHVIACRPGPEQVTAALDEARDLLRLTVGE

SEQ ID NO: 450 - protein, 410 aa, Artificial
  Alicyclobacillus acidocaldarius mutated SEQ ID NO 443
MNEKPQAVVVIGTREHEGEVELVRALGYRVLLLNTKINIEDALVADVPVELDLNDETLVISKVIDLTNHYYIKAVFTLNEYRVPLSARIAETLGLQRTISYEAAQNCRNKKLTRRTLMRNGIQAMKFATVKTPAEALDVIADMDLPVVVKPANDAGSHLVYRCDTLQEVWEAVEAIAQTPYNWVGQNRDPEILIEEYLVGKEYSVEACTIQGETHLLAITEKETTTTNVSVEIGHTVPAILEEEQVSSIHDLVKKALRALGVDNCVTHTEIKLDGNSLRIVEVNARPAGDKIPLLVRAVTGYDLRELALHIALGGQFENAPRHEVLAPVAAIRFLIADKHGVVSYDSRGVLEFEEMKYIEFFTKNGYVVKKTTSNYNRLGYFVVFGKNRDHVETVNRKILSKLNLRISDI

SEQ ID NO: 451 - protein, 410 aa, Artificial
  Alicyclobacillus acidocaldarius mutated SEQ ID NO 443
MNEKPQAVVVIGTREHEGEVELVRALGYRVLLLNTKINIEDALVADVPVELDLNDETLVISKVIDLTNHYYIKAVFTLNEYRVPLSARIAETLGLQRTISYEAAQNCRNKKLTRRTLMRNGIQAMKFATVKTPAEALDVIADMDLPVVVKPANDAGSHLVYRCDTLQEVWEAVEAIAQTPYNWVGQNRDPEILIEEYLVGKEYSVEACTLQGETHILAITEKETTTTNVSVEIGHTVPAILEEEQVSSIHDLVKKALRALGVDNCVTHTEIKLDGNSLRIVEVNARPAGDKIPLLVRAVTGYDLRELALHIALGGQFENAPRHEVLAPVAAIRFLIADKHGVVSYDSRGVLEFEEMKYIEFFTKNGYVVKKTTSNYNRLGYFVVFGKNRDHVETVNRKILSKLNLRISDI

SEQ ID NO: 452 - protein, 410 aa, Artificial
  Alicyclobacillus acidocaldarius mutated SEQ ID NO 443
MNEKPQAVVVIGTREHEGEVELVRALGYRVLLLNTKINIEDALVADVPVELDLNDETLVISKVIDLTNHYYIKAVFTLNEYRVPISARIAETLGLQRTISYEAAQNCRNKKLTRRTLMRNGIQAMKFATVKTPAEALDVIADMDLPVVVKPANDAGSHLVYRCDTLQEVWEAVEAIAQTPYNWVGQNRDPEILIEEYLVGKEYSVEACTIQGETHILAITEKETTTTNVSVEIGHTVPAILEEEQVSSIHDLVKKALRALGVDNCVTHTEIKLDGNSLRIVEVNARPAGDKIPLLVRAVTGYDLRELALHIALGGQFENAPRHEVLAPVAAIRFLIADKHGVVSYDSRGVLEFEEMKYIEFFTKNGYVVKKTTSNYNRLGYFVVFGKNRDHVETVNRKILSKLNLRISDI

SEQ ID NO: 453 - protein, 410 aa, Artificial
  Alicyclobacillus acidocaldarius mutated SEQ ID NO 443
MNEKPQAVVVIGTREHEGEVELVRALGYRVLLLNTKINIEDALVADVPVELDLNDETLVISKVIDLTNHYYIKAVFTLNEYRVPLSARIAETLGLQRTISYEAAQNCRNKKLTRRTLMRNGIQAMKFATVKTPAEALDVIADMDLPVVVKPANDAGSHLVYRCDTLQEVWEAVEAIAQTPYNWVGQNRDPEILIEEYLVGKEYSVEACTIQGETHILAITEKETTTTNVSVEIGHTVPAILEEEQVSSIHDLVKKALRALGVDNCVTHTEIKLDGNSLRIVEVNARPAGDKIPILVRAVTGYDLRELALHIALGGQFENAPRHEVLAPVAAIRFLIADKHGVVSYDSRGVLEFEEMKYIEFFTKNGYVVKKTTSNYNRLGYFVVFGKNRDHVETVNRKILSKLNLRISDI

SEQ ID NO: 454 - protein, 410 aa, Artificial
  Alicyclobacillus acidocaldarius mutated SEQ ID NO 443
MNEKPQAVVVIGTREHEGEVELVRALGYRVLLLNTKINIEDALVADVPVELDLNDETLVISKVIDLTNHYYIKAVFTLNEYRVPLSARIAETLGLQRTISYEAAQNCRNKKLTRRTLMRNGIQAMKFATVKTPAEALDVIADMDIPVVVKPANDAGSHLVYRCDTLQEVWEAVEAIAQTPYNWVGQNRDPEILIEEYLVGKEYSVEACTIQGETHILAITEKETTTTNVSVEIGHTVPAILEEEQVSSIHDLVKKALRALGVDNCVTHTEIKLDGNSLRIVEVNARPAGDKIPLLVRAVTGYDLRELALHIALGGQFENAPRHEVLAPVAAIRFLIADKHGVVSYDSRGVLEFEEMKYIEFFTKNGYVVKKTTSNYNRLGYFVVFGKNRDHVETVNRKILSKLNLRISDI

SEQ ID NO: 455 - DNA, 1233 bp, Artificial
  Alicyclobacillus acidocaldarius mutated SEQ ID NO 444
atgaatgaaaagccgcaggcagtagttgtaataggtacacgtgaacatgaaggagaagttgagcttgttcgtgcattgggctatcgcgttctattattgaatacaaagattaacatcgaagatgcgttagttgcagacgtccccgttgaattagatttgaatgacgagaccctcgttattagtaaggtaatcgatttaacaaaccactattacattaaagcagtatttacattgaacgaatatcgcgtaccattgagtgctcgaattgcggaaactctaggattacaaagaacaatttcgtacgaggctgctcaaaattgccggaacaaaaaattgactcgacgaacgttaatgcgaaacggtattcaagcaatgaagtttgctacagtaaaaactcctgcagaagcgctcgacgtaattgcagacatggatcttccagtcgttgttaaaccagcaaacgatgcggggagtcacttggtttatcgttgtgatacacttcaagaagtgtgggaggctgtagaggctatcgcccaaacaccctataattgggttggtcaaaatcgagatcctgagattctgattgaagagtaccttgttggtaaggaatatagtgtggaggcatgtactatccaaggtgaaactcatttattagccataactgagaaagaaacaacaaccacaaatgtgtcagttgaaattggtcatacggttccagctattcttgaggaagaacaagtttcttctattcacgatttagttaagaaagcccttcgggcgttaggcgtagacaattgtgtgacacatactgaaattaagcttgatgggaacagtcttcggattgtcgaggttaatgctcgaccggcgggagataaaatcccactcttagtgagggcggttactggttacgatcttcgggaattggcattgcatatagctttaggcgggcaatttgaaaacgcgccgcgccatgaagtcttagcccccgttgcggcaattcgatttttaatagcggataaacatggggtagtttcttatgacagccgaggtgtgcttgagtttgaagaaatgaagtatattgaattttttactaagaatggatatgtcgtaaagaaaacaactagtaactataatcgtcttggttatttcgtggtcttcggtaaaaatcgcgaccatgtggaaaccgtaaatcgcaagatcttatcaaagttgaatttgcggatttccgatatatag

SEQ ID NO: 456 - DNA, 1233 bp, Artificial
  Alicyclobacillus acidocaldarius mutated SEQ ID NO 444
atgaatgaaaagccgcaggcagtagttgtaataggtacacgtgaacatgaaggagaagttgagcttgttcgtgcattgggctatcgcgttctattattgaatacaaagattaacatcgaagatgcgttagttgcagacgtccccgttgaattagatttgaatgacgagaccctcgttattagtaaggtaatcgatttaacaaaccactattacattaaagcagtatttacattgaacgaatatcgcgtaccattgagtgctcgaattgcggaaactctaggattacaaagaacaatttcgtacgaggctgctcaaaattgccggaacaaaaaattgactcgacgaacgttaatgcgaaacggtattcaagcaatgaagtttgctacagtaaaaactcctgcagaagcgctcgacgtaattgcagacatggatcttccagtcgttgttaaaccagcaaacgatgcggggagtcacttggtttatcgttgtgatacacttcaagaagtgtgggaggctgtagaggctatcgcccaaacaccctataattgggttggtcaaaatcgagatcctgagattctgattgaagagtaccttgttggtaaggaatatagtgtggaggcatgtactttacaaggtgaaactcatatattagccataactgagaaagaaacaacaaccacaaatgtgtcagttgaaattggtcatacggttccagctattcttgaggaagaacaagtttcttctattcacgatttagttaagaaagcccttcgggcgttaggcgtagacaattgtgtgacacatactgaaattaagcttgatgggaacagtcttcggattgtcgaggttaatgctcgaccggcgggagataaaatcccactcttagtgagggcggttactggttacgatcttcgggaattggcattgcatatagctttaggcgggcaatttgaaaacgcgccgcgccatgaagtcttagcccccgttgcggcaattcgatttttaatagcggataaacatggggtagtttcttatgacagccgaggtgtgcttgagtttgaagaaatgaagtatattgaattttttactaagaatggatatgtcgtaaagaaaacaactagtaactataatcgtcttggttatttcgtggtcttcggtaaaaatcgcgaccatgtggaaaccgtaaatcgcaagatcttatcaaagttgaatttgcggatttccgatatatag

SEQ ID NO: 457 - DNA, 1233 bp, Artificial
  Alicyclobacillus acidocaldarius mutated SEQ ID NO 444
atgaatgaaaagccgcaggcagtagttgtaataggtacacgtgaacatgaaggagaagttgagcttgttcgtgcattgggctatcgcgttctattattgaatacaaagattaacatcgaagatgcgttagttgcagacgtccccgttgaattagatttgaatgacgagaccctcgttattagtaaggtaatcgatttaacaaaccactattacattaaagcagtatttacattgaacgaatatcgcgtaccaattagtgctcgaattgcggaaactctaggattacaaagaacaatttcgtacgaggctgctcaaaattgccggaacaaaaaattgactcgacgaacgttaatgcgaaacggtattcaagcaatgaagtttgctacagtaaaaactcctgcagaagcgctcgacgtaattgcagacatggatcttccagtcgttgttaaaccagcaaacgatgcggggagtcacttggtttatcgttgtgatacacttcaagaagtgtgggaggctgtagaggctatcgcccaaacaccctataattgggttggtcaaaatcgagatcctgagattctgattgaagagtaccttgttggtaaggaatatagtgtggaggcatgtactatccaaggtgaaactcatatattagccataactgagaaagaaacaacaaccacaaatgtgtcagttgaaattggtcatacggttccagctattcttgaggaagaacaagtttcttctattcacgatttagttaagaaagcccttcgggcgttaggcgtagacaattgtgtgacacatactgaaattaagcttgatgggaacagtcttcggattgtcgaggttaatgctcgaccggcgggagataaaatcccactcttagtgagggcggttactggttacgatcttcgggaattggcattgcatatagctttaggcgggcaatttgaaaacgcgccgcgccatgaagtcttagcccccgttgcggcaattcgatttttaatagcggataaacatggggtagtttcttatgacagccgaggtgtgcttgagtttgaagaaatgaagtatattgaattttttactaagaatggatatgtcgtaaagaaaacaactagtaactataatcgtcttggttatttcgtggtcttcggtaaaaatcgcgaccatgtggaaaccgtaaatcgcaagatcttatcaaagttgaatttgcggatttccgatatatag

SEQ ID NO: 458 - DNA, 1233 bp, Artificial
  Alicyclobacillus acidocaldarius mutated SEQ ID NO 444
atgaatgaaaagccgcaggcagtagttgtaataggtacacgtgaacatgaaggagaagttgagcttgttcgtgcattgggctatcgcgttctattattgaatacaaagattaacatcgaagatgcgttagttgcagacgtccccgttgaattagatttgaatgacgagaccctcgttattagtaaggtaatcgatttaacaaaccactattacattaaagcagtatttacattgaacgaatatcgcgtaccattgagtgctcgaattgcggaaactctaggattacaaagaacaatttcgtacgaggctgctcaaaattgccggaacaaaaaattgactcgacgaacgttaatgcgaaacggtattcaagcaatgaagtttgctacagtaaaaactcctgcagaagcgctcgacgtaattgcagacatggatcttccagtcgttgttaaaccagcaaacgatgcggggagtcacttggtttatcgttgtgatacacttcaagaagtgtgggaggctgtagaggctatcgcccaaacaccctataattgggttggtcaaaatcgagatcctgagattctgattgaagagtaccttgttggtaaggaatatagtgtggaggcatgtactatccaaggtgaaactcatatattagccataactgagaaagaaacaacaaccacaaatgtgtcagttgaaattggtcatacggttccagctattcttgaggaagaacaagtttcttctattcacgatttagttaagaaagcccttcgggcgttaggcgtagacaattgtgtgacacatactgaaattaagcttgatgggaacagtcttcggattgtcgaggttaatgctcgaccggcgggagataaaatcccaattttagtgagggcggttactggttacgatcttcgggaattggcattgcatatagctttaggcgggcaatttgaaaacgcgccgcgccatgaagtcttagcccccgttgcggcaattcgatttttaatagcggataaacatggggtagtttcttatgacagccgaggtgtgcttgagtttgaagaaatgaagtatattgaattttttactaagaatggatatgtcgtaaagaaaacaactagtaactataatcgtcttggttatttcgtggtcttcggtaaaaatcgcgaccatgtggaaaccgtaaatcgcaagatcttatcaaagttgaatttgcggatttccgatatatag

SEQ ID NO: 459 - DNA, 1233 bp, Artificial
  Alicyclobacillus acidocaldarius mutated SEQ ID NO 444
atgaatgaaaagccgcaggcagtagttgtaataggtacacgtgaacatgaaggagaagttgagcttgttcgtgcattgggctatcgcgttctattattgaatacaaagattaacatcgaagatgcgttagttgcagacgtccccgttgaattagatttgaatgacgagaccctcgttattagtaaggtaatcgatttaacaaaccactattacattaaagcagtatttacattgaacgaatatcgcgtaccattgagtgctcgaattgcggaaactctaggattacaaagaacaatttcgtacgaggctgctcaaaattgccggaacaaaaaattgactcgacgaacgttaatgcgaaacggtattcaagcaatgaagtttgctacagtaaaaactcctgcagaagcgctcgacgtaattgcagacatggatattccagtcgttgttaaaccagcaaacgatgcggggagtcacttggtttatcgttgtgatacacttcaagaagtgtgggaggctgtagaggctatcgcccaaacaccctataattgggttggtcaaaatcgagatcctgagattctgattgaagagtaccttgttggtaaggaatatagtgtggaggcatgtactatccaaggtgaaactcatatattagccataactgagaaagaaacaacaaccacaaatgtgtcagttgaaattggtcatacggttccagctattcttgaggaagaacaagtttcttctattcacgatttagttaagaaagcccttcgggcgttaggcgtagacaattgtgtgacacatactgaaattaagcttgatgggaacagtcttcggattgtcgaggttaatgctcgaccggcgggagataaaatcccactcttagtgagggcggttactggttacgatcttcgggaattggcattgcatatagctttaggcgggcaatttgaaaacgcgccgcgccatgaagtcttagcccccgttgcggcaattcgatttttaatagcggataaacatggggtagtttcttatgacagccgaggtgtgcttgagtttgaagaaatgaagtatattgaattttttactaagaatggatatgtcgtaaagaaaacaactagtaactataatcgtcttggttatttcgtggtcttcggtaaaaatcgcgaccatgtggaaaccgtaaatcgcaagatcttatcaaagttgaatttgcggatttccgatatatag

SEQ ID NO: 460 - protein, 393 aa, Alicyclobacillus acidocaldarius
MKIVYTLSFAVFLLVTGTGIVAPLIGPYAHSLGAGGFWIGLLFSGFYIVRLLVGTPVGRLADHQGPKRVLIYSLILYPLISIAYWSAHSVGVLFAARLLHGLASAMMLPMAMTYVGAITPPGQEGRYMGIYNTFLFIAGGIGPLLGGLLASELSPNAAFLSLSLLAIGSLLLVIPLPRVSSASKEKNGMNHWGMGDLIISPGILALAVLNVENAVLDVFQVSFFPVFAQNRGLSLLAIGFLIAINSIVIGASQVPCGWLVDRTNKYYLVLVSGIVTSVLLTMFPLCRKLWVITMLMILIGFSSAITIAASSALSTMLGRTGGMGHVMGFLNSATSFGMIVGPIVSGIILDKLNVYFTFYFNSIVWLVSTMLFAMLWMVHNRRISKKQDVPISY

SEQ ID NO: 461 - DNA, 1182 bp, Alicyclobacillus acidocaldarius
atgaagatagtatatacattgagtttcgcggtattcctgttggtaactggcaccggaattgttgccccgttaattgggccgtatgcgcatagtttaggtgctggagggttttggattggtttgttatttagtgggttttatattgttcgtttgttagttgggactcctgtcggtcgacttgcagatcaccaagggccaaaaagagtacttatctacagcttgatactttatcccttgatttcgatagcttattggagcgcgcacagtgtaggggttttgtttgcggctcggttattgcacggtttagcttcggcaatgatgttgcctatggcgatgacttatgtgggggcaattactccgccagggcaagaaggaagatatatgggtatttataataccttcctgtttatcgcgggaggaattggacctctgctcggtggattattagcaagtgaattatcgccaaatgccgcttttctcagtctatcgctcttggcaataggttctttgttgctggtaattccgttgccgagagtttcatctgcgtctaaggaaaaaaacggtatgaatcattgggggatgggagatttaattatatcccctggtatacttgcccttgctgtactgaatgtggagaatgccgtattagacgtgtttcaagtgtctttttttccagtgttcgcgcagaatcgtgggctaagtttgctggctattgggttcctgatagccataaatagtattgtgataggtgcaagtcaggttccatgtgggtggctggtagaccgcactaataaatattaccttgtgttagtgtctggaattgtcacttctgttctattgacgatgtttcctttatgcaggaaattatgggtgattacgatgctcatgattctgataggattttcctcggcgataactattgcggcctcgtcagctttatctactatgcttggacgtactggtggaatgggccatgtcatggggttcctgaattcagcaacgagctttgggatgattgtaggtccgattgtatcgggtattatcttagataagttaaatgtttacttcacattttacttcaatagcattgtatggttggtcagtacaatgctatttgctatgttgtggatggtgcacaatagacgtatctcgaagaaacaagacgtacctatttcatattaa

SEQ ID NO: 462 - protein, 364 aa, Methanospirillum hungatei
SLYVAVFSTMLGIGIVIPLLPRFAETLGASGFGIGMIFSSFALSRAFAMPFFGRYSDICGRRQFIIIGLLLYAIFSLLYVPAGSVLELSGIRFLQGIASAMVFPIAMAYIGDIAPPGMEGRYLGTFTSSLFLGMGLGPFLGGIVTDIAGMDTAFICMGALTGVALLTCIFFLPGYQGSRKEQSSILHLLIHPGLRIPLLYQMMNAFANGTFMVFLPVIAAHVGNLSAGETGLVISVSVLSTALLQRVCGRLADRFDKYLLIATGCLTVTVALALVPGFEGLWSYLFFALLMGIGGGISVPAMYALVTIAGRDVGQGAAMGTINMVMSMGMIISPVVCGLFMDQTGISSVFYLSAVIVLVVTPVF

SEQ ID NO: 463 - protein, 389 aa, Methanoculleus marisnigri
RIYNVLFISVFATMLGLGIVSPLLPIYAENLGATGIWLGIIFSAFALSRSVFMPVIGRISDRRGRKWIILIGMFAYAVLSLAYIIVDSVYSLTAVRFAHGLASAMVVPIAMAYVADLSEKGREGSHMGNFSISMFLGMGMGPLLGGFLNDAFGLDSVFYVMAGLSAFATILVGISLPEAKRGTFTVQEGNPVPMRKILTLPVMRGVMVFAFISALGRGGMMVFIPVFGPLIAISPTEVGIVLSANTFLMALLQVPMGRITDTGNKVVLIVAGSAITALAIGAIPFSGSFGPLLAITSLVGIGGAIQQPAIMALTVDAGRTIGMGTSMGAYNTVFGIGMIIAPLMGGVFMDYIGIDAVFYVGGAISLLGTGIFAVMMQRNARAADRKDIP

SEQ ID NO: 464 - protein, 374 aa, Desulfatibacillum alkenivorans
KIFITLFFSIFTSVTGVGIVVPLLPVYANNLGASGFMVGMIFGSFSLSRILFLPYFGKRSDMIGRKPFITIGLFAYSLVSIAFMFSHGVTQLVVIRFIQGIASAMILPVCQAYIGEIAPQGREGFFMGLFNISMYSSLSLGPILGGVVNDHFGLQTAFACMGVLSLLAFFMAQHFLPPVKEEPRQERGREPVTYRILAKNAGIMGAVLLRTTYTFCIGAIWGFLPVYADAHFNLSSSAIGFLIMLGVLTSGVLTTPMGWLADRVDKRLLCVIGSVMISVAVYSFTFADGFWHLFASNMAFGIGGGIMAPALTAICVIEGHKERAMGSVMALLTIGHSLGMLAGSVATGVLMDMFSLSAAFTASAVLAILGTVVF

SEQ ID NO: 465 - protein, 384 aa, delta proteobacterium
RLLLPLLFSVFIALLGIGIIVPVMPIFATSLGASGLALGFIIASFSITRGLCQPGVGMLSDRWGRKGFLLGGLLIFGVVGLLIPQAVSVENLVLIRALHGVGSAMIVPVAMAYVSDLAPVGEEGRYMGLLNTAIFAGIGSGPLLGGIFTDLWGMPSAFYAMSTLSFLALGLILLQMPAMPAASRTGNADGLFTVMGKMLANRSTTGLLLARMATMLIMVPTMAFLPLLMTQAFQASGMQIGTVIAVRTLINASLQGYCGRLADRYDKLRLLRYGCLVISGVMCLIPLAGHYWVLLLLFAVLGLGEAIIWPTLGALATEEGRVYGQGTMMGVFNLAMSAGVLGGALGAGFATDLLGLTWSFPVIGLLVLLLTFLAIGMIAADRLA

SEQ ID NO: 466 - protein, 365 aa, Desulfatibacillum alkenivorans
ILVLLSVSVGVSMIGLGIIWPLIPVYAVELGAGGFMVGLIIASFNLSKAAFGPFMGRFSDSLGRKKFITVGLIAYTCMSVMYVLAGSAETLIAVRIFHGMASVMVVPIAMALAADIAPKHELGLYMGTLNMAVMLGLGAGPVLGGALRDHFGMDSAFIAMGLLALITCILVVIVIPSDAETRSFKENQARSSVGQIVRHRIALGIIFMRFLAASGQGAVYTFLPLLGLKMDMSSSQVGILLSANIFLIAFLQRFSGRLADRVNPKYLVIFGTFLAGFAVLGMPMVKGFFLVLVLNIVMGAANGLALPGGLVITAQLGRTMGMASLMSITDAAWSLGMIVSPILSGIILDVYGLPYVFLMGSALIL

SEQ ID NO: 467 - protein, 393 aa, Artificial
  Alicyclobacillus acidocaldarius mutated SEQ ID NO 460
MKIVYTLSFAVFLLVTGTGIVAPLIGPYAHSLGAGGFWIGLLFSGFYIVRLLVGTPVGRLADHQGPKRVLIYSLILYPLISIAYWSAHSVGVLFAARLLHGLASAMMLPMAMTYVGAITPPGQEGRYMGIYNTFLFIAGGIGPLLGGLLASELSPNAAFLSLSLLAIGSLLLVIPLPRVSSASKEKNGMNHWGMGDLIISPGILALAVLNVENAVLDVFQVSFFPVFAQNRGLSLLAIGFLIAINSIVIGASQVPCGWLVDRTNKYYLVLVSGIVTSVLLTMFPLCRKLWVITMLMILIGFSSAITIAASSALSTMLGRTGGMGHVMGFLNSATSFGMIVGPIVSGIILDKLNVYFTFYFNSIVWLVSTMLFAMLWMVHNRRLSKKQDVPISY

SEQ ID NO: 468 - protein, 393 aa, Artificial
  Alicyclobacillus acidocaldarius mutated SEQ ID NO 460
MKIVYTLSFAVFLLVTGTGIVAPLIGPYAHSLGAGGFWIGLLFSGFYIVRLLVGTPVGRLADHQGPKRVLIYSLILYPLISIAYWSAHSVGVLFAARLLHGLASAMMLPMAMTYVGAITPPGQEGRYMGIYNTFLFIAGGIGPLLGGLLASELSPNAAFLSLSLLAIGSLLLVIPLPRVSSASKEKNGMNHWGMGDLILSPGILALAVLNVENAVLDVFQVSFFPVFAQNRGLSLLAIGFLIAINSIVIGASQVPCGWLVDRTNKYYLVLVSGIVTSVLLTMFPLCRKLWVITMLMILIGFSSAITIAASSALSTMLGRTGGMGHVMGFLNSATSFGMIVGPIVSGIILDKLNVYFTFYFNSIVWLVSTMLFAMLWMVHNRRISKKQDVPISY

SEQ ID NO: 469 - protein, 393 aa, Artificial
  Alicyclobacillus acidocaldarius mutated SEQ ID NO 460
MKIVYTLSFAVFLLVTGTGIVAPLIGPYAHSLGAGGFWIGLLFSGFYIVRLLVGTPVGRLADHQGPKRVLIYSLILYPLISIAYWSAHSVGVLFAARLLHGLASAMMLPMAMTYVGAITPPGQEGRYMGIYNTFLFIAGGIGPLLGGLLASELSPNAAFLSLSLLAIGSLLLVIPLPRVSSASKEKNGMNHWGMGDLIISPGILALAVLNVENAVLDVFQVSFFPVFAQNRGLSLLAIGFLIAINSIVIGASQVPCGWLVDRTNKYYLVLVSGIVTSVLLTMFPLCRKLWVITMLMILIGFSSAITIAASSALSTMLGRTGGMGHVMGFLNSATSFGMIVGPIVSGIILDKLNVYFTFYFNSIVWLVSTMLFAMLWMVHNRRISKRQDVPISY

SEQ ID NO: 470 - protein, 393 aa, Artificial
  Alicyclobacillus acidocaldarius mutated SEQ ID NO 460
MKIVYTLSFAVFLLVTGTGIVAPLIGPYAHSLGAGGFWIGLLFSGFYIVRLLVGTPVGRLADHQGPKRVLIYSLILYPLISIAYWSAHSVGVLFAARLLHGLASAMMLPMAMTYVGAITPPGQEGRYMGIYNTFLFIAGGIGPLLGGLLASELSPNAAFLSLSLLAIGSLLLVIPLPRVSSASREKNGMNHWGMGDLIISPGILALAVLNVENAVLDVFQVSFFPVFAQNRGLSLLAIGFLIAINSIVIGASQVPCGWLVDRTNKYYLVLVSGIVTSVLLTMFPLCRKLWVITMLMILIGFSSAITIAASSALSTMLGRTGGMGHVMGFLNSATSFGMIVGPIVSGIILDKLNVYFTFYFNSIVWLVSTMLFAMLWMVHNRRISKKQDVPISY

SEQ ID NO: 471 - protein, 393 aa, Artificial
  Alicyclobacillus acidocaldarius mutated SEQ ID NO 460
MKIVYTLSFAVFLLVTGTGIVAPLIGPYAHSLGAGGFWIGLLFSGFYIVRLLVGTPVGRLADHQGPKRVLIYSLILYPLISIAYWSAHSVGVLFAARLLHGLASAMMLPMAMTYVGAITPPGQEGRYMGIYNTFLFIAGGIGPLLGGLLASELSPNAAFLSLSLLAIGSLLLVIPLPRVSSASKEKNGMNHWGMGDLIISPGILALAVLNVENAVLDVFQVSFFPVFAQNRGLSLLAIGFLIAINSIVIGASQVPCGWLVDRTNKYYLVLVSGIVTSVLLTMFPLCRKLWVITMLMILIGFSSAITIAASSALSTMLGRTGGMGHVMGFLNSATSFGMIVGPIVSGIILDKLNVYFTFYFNSIVWLVSTMLFAMLWMVHQRRISKKQDVPISY

SEQ ID NO: 472 - DNA, 1182 bp, Artificial
  Alicyclobacillus acidocaldarius mutated SEQ ID NO 461
atgaagatagtatatacattgagtttcgcggtattcctgttggtaactggcaccggaattgttgccccgttaattgggccgtatgcgcatagtttaggtgctggagggttttggattggtttgttatttagtgggttttatattgttcgtttgttagttgggactcctgtcggtcgacttgcagatcaccaagggccaaaaagagtacttatctacagcttgatactttatcccttgatttcgatagcttattggagcgcgcacagtgtaggggttttgtttgcggctcggttattgcacggtttagcttcggcaatgatgttgcctatggcgatgacttatgtgggggcaattactccgccagggcaagaaggaagatatatgggtatttataataccttcctgtttatcgcgggaggaattggacctctgctcggtggattattagcaagtgaattatcgccaaatgccgcttttctcagtctatcgctcttggcaataggttctttgttgctggtaattccgttgccgagagtttcatctgcgtctaaggaaaaaaacggtatgaatcattgggggatgggagatttaattatatcccctggtatacttgcccttgctgtactgaatgtggagaatgccgtattagacgtgtttcaagtgtctttttttccagtgttcgcgcagaatcgtgggctaagtttgctggctattgggttcctgatagccataaatagtattgtgataggtgcaagtcaggttccatgtgggtggctggtagaccgcactaataaatattaccttgtgttagtgtctggaattgtcacttctgttctattgacgatgtttcctttatgcaggaaattatgggtgattacgatgctcatgattctgataggattttcctcggcgataactattgcggcctcgtcagctttatctactatgcttggacgtactggtggaatgggccatgtcatggggttcctgaattcagcaacgagctttgggatgattgtaggtccgattgtatcgggtattatcttagataagttaaatgtttacttcacattttacttcaatagcattgtatggttggtcagtacaatgctatttgctatgttgtggatggtgcacaatagacgtttatcgaagaaacaagacgtacctatttcatattaa

SEQ ID NO: 473 - DNA, 1182 bp, Artificial
  Alicyclobacillus acidocaldarius mutated SEQ ID NO 461
atgaagatagtatatacattgagtttcgcggtattcctgttggtaactggcaccggaattgttgccccgttaattgggccgtatgcgcatagtttaggtgctggagggttttggattggtttgttatttagtgggttttatattgttcgtttgttagttgggactcctgtcggtcgacttgcagatcaccaagggccaaaaagagtacttatctacagcttgatactttatcccttgatttcgatagcttattggagcgcgcacagtgtaggggttttgtttgcggctcggttattgcacggtttagcttcggcaatgatgttgcctatggcgatgacttatgtgggggcaattactccgccagggcaagaaggaagatatatgggtatttataataccttcctgtttatcgcgggaggaattggacctctgctcggtggattattagcaagtgaattatcgccaaatgccgcttttctcagtctatcgctcttggcaataggttctttgttgctggtaattccgttgccgagagtttcatctgcgtctaaggaaaaaaacggtatgaatcattgggggatgggagatttaattttatcccctggtatacttgcccttgctgtactgaatgtggagaatgccgtattagacgtgtttcaagtgtctttttttccagtgttcgcgcagaatcgtgggctaagtttgctggctattgggttcctgatagccataaatagtattgtgataggtgcaagtcaggttccatgtgggtggctggtagaccgcactaataaatattaccttgtgttagtgtctggaattgtcacttctgttctattgacgatgtttcctttatgcaggaaattatgggtgattacgatgctcatgattctgataggattttcctcggcgataactattgcggcctcgtcagctttatctactatgcttggacgtactggtggaatgggccatgtcatggggttcctgaattcagcaacgagctttgggatgattgtaggtccgattgtatcgggtattatcttagataagttaaatgtttacttcacattttacttcaatagcattgtatggttggtcagtacaatgctatttgctatgttgtggatggtgcacaatagacgtatctcgaagaaacaagacgtacctatttcatattaa

SEQ ID NO: 474 - DNA, 1182 bp, Artificial
  Alicyclobacillus acidocaldarius mutated SEQ ID NO 461
atgaagatagtatatacattgagtttcgcggtattcctgttggtaactggcaccggaattgttgccccgttaattgggccgtatgcgcatagtttaggtgctggagggttttggattggtttgttatttagtgggttttatattgttcgtttgttagttgggactcctgtcggtcgacttgcagatcaccaagggccaaaaagagtacttatctacagcttgatactttatcccttgatttcgatagcttattggagcgcgcacagtgtaggggttttgtttgcggctcggttattgcacggtttagcttcggcaatgatgttgcctatggcgatgacttatgtgggggcaattactccgccagggcaagaaggaagatatatgggtatttataataccttcctgtttatcgcgggaggaattggacctctgctcggtggattattagcaagtgaattatcgccaaatgccgcttttctcagtctatcgctcttggcaataggttctttgttgctggtaattccgttgccgagagtttcatctgcgtctaaggaaaaaaacggtatgaatcattgggggatgggagatttaattatatcccctggtatacttgcccttgctgtactgaatgtggagaatgccgtattagacgtgtttcaagtgtctttttttccagtgttcgcgcagaatcgtgggctaagtttgctggctattgggttcctgatagccataaatagtattgtgataggtgcaagtcaggttccatgtgggtggctggtagaccgcactaataaatattaccttgtgttagtgtctggaattgtcacttctgttctattgacgatgtttcctttatgcaggaaattatgggtgattacgatgctcatgattctgataggattttcctcggcgataactattgcggcctcgtcagctttatctactatgcttggacgtactggtggaatgggccatgtcatggggttcctgaattcagcaacgagctttgggatgattgtaggtccgattgtatcgggtattatcttagataagttaaatgtttacttcacattttacttcaatagcattgtatggttggtcagtacaatgctatttgctatgttgtggatggtgcacaatagacgtatctcgaagcgtcaagacgtacctatttcatattaa

SEQ ID NO: 475 - DNA, 1182 bp, Artificial
  Alicyclobacillus acidocaldarius mutated SEQ ID NO 461
atgaagatagtatatacattgagtttcgcggtattcctgttggtaactggcaccggaattgttgccccgttaattgggccgtatgcgcatagtttaggtgctggagggttttggattggtttgttatttagtgggttttatattgttcgtttgttagttgggactcctgtcggtcgacttgcagatcaccaagggccaaaaagagtacttatctacagcttgatactttatcccttgatttcgatagcttattggagcgcgcacagtgtaggggttttgtttgcggctcggttattgcacggtttagcttcggcaatgatgttgcctatggcgatgacttatgtgggggcaattactccgccagggcaagaaggaagatatatgggtatttataataccttcctgtttatcgcgggaggaattggacctctgctcggtggattattagcaagtgaattatcgccaaatgccgcttttctcagtctatcgctcttggcaataggttctttgttgctggtaattccgttgccgagagtttcatctgcgtctcgtgaaaaaaacggtatgaatcattgggggatgggagatttaattatatcccctggtatacttgcccttgctgtactgaatgtggagaatgccgtattagacgtgtttcaagtgtctttttttccagtgttcgcgcagaatcgtgggctaagtttgctggctattgggttcctgatagccataaatagtattgtgataggtgcaagtcaggttccatgtgggtggctggtagaccgcactaataaatattaccttgtgttagtgtctggaattgtcacttctgttctattgacgatgtttcctttatgcaggaaattatgggtgattacgatgctcatgattctgataggattttcctcggcgataactattgcggcctcgtcagctttatctactatgcttggacgtactggtggaatgggccatgtcatggggttcctgaattcagcaacgagctttgggatgattgtaggtccgattgtatcgggtattatcttagataagttaaatgtttacttcacattttacttcaatagcattgtatggttggtcagtacaatgctatttgctatgttgtggatggtgcacaatagacgtatctcgaagaaacaagacgtacctatttcatattaa

SEQ ID NO: 476 - DNA, 1182 bp, Artificial
  Alicyclobacillus acidocaldarius mutated SEQ ID NO 461
atgaagatagtatatacattgagtttcgcggtattcctgttggtaactggcaccggaattgttgccccgttaattgggccgtatgcgcatagtttaggtgctggagggttttggattggtttgttatttagtgggttttatattgttcgtttgttagttgggactcctgtcggtcgacttgcagatcaccaagggccaaaaagagtacttatctacagcttgatactttatcccttgatttcgatagcttattggagcgcgcacagtgtaggggttttgtttgcggctcggttattgcacggtttagcttcggcaatgatgttgcctatggcgatgacttatgtgggggcaattactccgccagggcaagaaggaagatatatgggtatttataataccttcctgtttatcgcgggaggaattggacctctgctcggtggattattagcaagtgaattatcgccaaatgccgcttttctcagtctatcgctcttggcaataggttctttgttgctggtaattccgttgccgagagtttcatctgcgtctaaggaaaaaaacggtatgaatcattgggggatgggagatttaattatatcccctggtatacttgcccttgctgtactgaatgtggagaatgccgtattagacgtgtttcaagtgtctttttttccagtgttcgcgcagaatcgtgggctaagtttgctggctattgggttcctgatagccataaatagtattgtgataggtgcaagtcaggttccatgtgggtggctggtagaccgcactaataaatattaccttgtgttagtgtctggaattgtcacttctgttctattgacgatgtttcctttatgcaggaaattatgggtgattacgatgctcatgattctgataggattttcctcggcgataactattgcggcctcgtcagctttatctactatgcttggacgtactggtggaatgggccatgtcatggggttcctgaattcagcaacgagctttgggatgattgtaggtccgattgtatcgggtattatcttagataagttaaatgtttacttcacattttacttcaatagcattgtatggttggtcagtacaatgctatttgctatgttgtggatggtgcaccaaagacgtatctcgaagaaacaagacgtacctatttcatattaa

SEQ ID NO: 477 - protein, 270 aa, Alicyclobacillus acidocaldarius
MRKNVNANCCSAEPEPLTPAKRVIKDFYDTVAVGSGPYPASTDRFSPAAPTEKILEYVKRTNCRRILDVGCGMGTTLLRMAQEHVSGVQFIGVDFSEKMIERARTSSLSLHDDLRKKIGFFVANAESLPYMEGQFDFVFSECVLNLIPEREKAIAEVMRVLAPGGMFVYTDFVAFSPISNSIRDNLNLVSGCRAGSKTLSENIRLLEETGFVKIECIDFTSDKNKRYADLMNESEQIRREFEEFRNLYPDAAAFLDERVGYYLILGCKPI

SEQ ID NO: 478 - DNA, 813 bp, Alicyclobacillus acidocaldarius
atgagaaagaatgtgaacgcgaattgttgctcagcggaacctgaaccgttgacgccggcaaagagggttattaaggatttttatgatactgttgccgtgggaagtggaccatatccggcttcaacggataggttctcgccggctgcgccaactgagaagatcttagagtatgtaaagcggaccaattgcaggcgtatcctcgatgtaggttgcggcatgggaacaacgcttcttcgtatggctcaagagcatgtatccggtgttcaatttataggcgtagattttagcgaaaagatgattgaaagagcacgtacgtctagtttgtcactacatgatgacctaagaaagaaaataggattctttgtcgcaaatgctgagtctctaccctacatggaaggacaatttgacttcgttttcagcgaatgcgtacttaatttgattcctgaacgcgaaaaagctattgccgaagtcatgcgagtacttgcccctggaggtatgtttgtatacacagatttcgttgcgttctcaccaatttccaattctatccgtgataatctgaatctcgttagcggatgcagagcgggaagtaaaacgttgagtgagaatattcgattattagaggaaacgggtttcgttaaaattgaatgcattgatttcacatcggacaagaacaaacgctatgctgacttgatgaacgagagtgaacaaattcgcagggaatttgaagagtttcgaaatttgtatcctgacgccgcagctttcttggatgaaagagtgggatattacctgatccttggctgcaagccgatttga

SEQ ID NO: 479 - protein, 157 aa, delta proteobacterium
VLDLGSGGGFDCFLAARQVGETGRVIGVDMTPEMISQARANATKSGDRNVEFRLGEIENLPVADGAVDVIISNCVINLSPEKRRVFAEAYRILKAGGRLAISDVVATAELPEAVRKDMALYTGCIAGASLVSDIEQMLTEVGFTEIRVSTKDESKSF

SEQ ID NO: 480 - protein, 146 aa, Symbiobacterium thermophilum
VLDLGSGAGFDCFLAARQVGESGRVIGVDMTPEMLARARENARKGGFANVEFRLGEIEHLPVADESVDVIISNCVINLSPEKEQVFREAFRVLRPGGRIAVADMVSLAPLPPEVREDLALYAGCVAGVATVGELRTMLTEAGFVDI

SEQ ID NO: 481 - protein, 144 aa, Salinibacter ruber
RVLDLGSGAGMDAFVARRTVGPDGHVHGVDFAEEMVAKARANADTLDYDNVTFEVGDIEALPVESGAFDVILSNCVLNLVPDKEAAFAQMHRALRPGGRFSVSDVVHAGALPDGLREAAELYVGCVAGAMERDMYLDRLREAGF

SEQ ID NO: 482 - protein, 170 aa, Methanosarcina mazei
VLDLGSGGGFDCFLAAQKIGSSGKVIGVDMTLEMVEKAQANARKYGYSNVEFRHGDIESLPVKDSSVDVIISNCVINLAPDKEKVFREAFRVLKPEGRMYISDMVLLDELPEELKNDSELLAGCIAGAVLKEEYLGLLKKAGFSVEILNEDLDISKRQYRDLPVESLKLK

SEQ ID NO: 483 - protein, 198 aa, Flavobacteriales bacterium
SSCCGATTPSNKVYNIMMDDYTETDGYVEDADLGLGCGLPTEFAKIKKGDTVIDLGSGAGNDCFVARHETGSEGKVLGIDFTPIMIEKARINAEKLGYNNVEFREGDIDAMPVSDEVADVIVSNCVLNLVPNKNKVIGEMFRVLKPGGHFSVSDIVLVGNLPEALKADAEMYAGCVAGAIQKEDYLKIIEDKGFMNLK

SEQ ID NO: 484 - protein, 270 aa, Artificial
  Alicyclobacillus acidocaldarius mutated SEQ ID NO 477
MRKNVNANCCSAEPEPLTPAKRVIKDFYDTVAVGSGPYPASTERFSPAAPTEKILEYVKRTNCRRILDVGCGMGTTLLRMAQEHVSGVQFIGVDFSEKMIERARTSSLSLHDDLRKKIGFFVANAESLPYMEGQFDFVFSECVLNLIPEREKAIAEVMRVLAPGGMFVYTDFVAFSPISNSIRDNLNLVSGCRAGSKTLSENIRLLEETGFVKIECIDFTSDKNKRYADLMNESEQIRREFEEFRNLYPDAAAFLDERVGYYLILGCKPI

SEQ ID NO: 485 - protein, 270 aa, Artificial
  Alicyclobacillus acidocaldarius mutated SEQ ID NO 477
MRKNVNANCCSAEPEPLTPAKRVIKDFYDTVAVGSGPYPASTDRFSPAAPTEKILEYVKRTNCRRILDVGCGMGTTLLRMAQEHVSGVQFIGVDFSEKMIERARTSSLSLHDDLRKKIGFFVANAESLPYMEGQFDFVFSECVLNLIPEREKAIAEVMRVLAPGGMFIYTDFVAFSPISNSIRDNLNLVSGCRAGSKTLSENIRLLEETGFVKIECIDFTSDKNKRYADLMNESEQIRREFEEFRNLYPDAAAFLDERVGYYLILGCKPI

SEQ ID NO: 486 - protein, 270 aa, Artificial
  Alicyclobacillus acidocaldarius mutated SEQ ID NO 477
MRKNVNANCCSAEPEPLTPAKRVIKDFYDTVAVGSGPYPASTDRFSPAAPTEKILEYVKRTNCRRILDVGCGMGTTLLRMAQEHVSGVQFIGVDFSEKMIERARTSSLSLHDDLRKKIGFFVANAESLPYMEGQFDFVFSECVLNLIPEREKAIAEVMRVLAPGGMFVYTDFVAFSPISNSIRDNINLVSGCRAGSKTLSENIRLLEETGFVKIECIDFTSDKNKRYADLMNESEQIRREFEEFRNLYPDAAAFLDERVGYYLILGCKPI

SEQ ID NO: 487 - protein, 270 aa, Artificial
  Alicyclobacillus acidocaldarius mutated SEQ ID NO 477
MRKNVNANCCSAEPEPLTPAKRVIKDFYDTVAVGSGPYPASTDRFSPAAPTEKILEYVKRTNCRRILDVGCGMGTTLLRMAQEHVSGVQFIGVDFSEKMIERARTSSLSLHDDLRKKIGFFVANAESLPYMEGQFDFVFSECVLNLIPEREKAIAEVMRVLAPGGMFVYTDFVAFSPISNSIRDNLNLVSGCRAGSKTLSENIRLLEETGFVKIECIDFTSDKNKRYADLMNDSEQIRREFEEFRNLYPDAAAFLDERVGYYLILGCKPI

SEQ ID NO: 488 - protein, 270 aa, Artificial
  Alicyclobacillus acidocaldarius mutated SEQ ID NO 477
MRKNVNANCCSAEPEPLTPAKRVIKDFYDTVAVGSGPYPASTDRFSPAAPTEKILEYVKRTNCRRILDVGCGMGTTLLRMAQEHVSGVQFIGVDFSEKMIERARTSSLSLHDDLRKKIGFFVANAESLPYMEGQFDFVFSECVLNLIPEREKAIAEVMRVLAPGGMFVYTDFVAFSPISNSIRDNLNLVSGCRAGSKTLSENIRLLEETGFVKIECIDFTSDKNKRYADLMNESEQIRREFEEFRNLYPDAAAFLDERVGYYLILGCKPL

SEQ ID NO: 489 - DNA, 813 bp, Artificial
  Alicyclobacillus acidocaldarius mutated SEQ ID NO 478
atgagaaagaatgtgaacgcgaattgttgctcagcggaacctgaaccgttgacgccggcaaagagggttattaaggatttttatgatactgttgccgtgggaagtggaccatatccggcttcaacggaaaggttctcgccggctgcgccaactgagaagatcttagagtatgtaaagcggaccaattgcaggcgtatcctcgatgtaggttgcggcatgggaacaacgcttcttcgtatggctcaagagcatgtatccggtgttcaatttataggcgtagattttagcgaaaagatgattgaaagagcacgtacgtctagtttgtcactacatgatgacctaagaaagaaaataggattctttgtcgcaaatgctgagtctctaccctacatggaaggacaatttgacttcgttttcagcgaatgcgtacttaatttgattcctgaacgcgaaaaagctattgccgaagtcatgcgagtacttgcccctggaggtatgtttgtatacacagatttcgttgcgttctcaccaatttccaattctatccgtgataatctgaatctcgttagcggatgcagagcgggaagtaaaacgttgagtgagaatattcgattattagaggaaacgggtttcgttaaaattgaatgcattgatttcacatcggacaagaacaaacgctatgctgacttgatgaacgagagtgaacaaattcgcagggaatttgaagagtttcgaaatttgtatcctgacgccgcagctttcttggatgaaagagtgggatattacctgatccttggctgcaagccgatttga

SEQ ID NO: 490 - DNA, 813 bp, Artificial
  Alicyclobacillus acidocaldarius mutated SEQ ID NO 478
atgagaaagaatgtgaacgcgaattgttgctcagcggaacctgaaccgttgacgccggcaaagagggttattaaggatttttatgatactgttgccgtgggaagtggaccatatccggcttcaacggataggttctcgccggctgcgccaactgagaagatcttagagtatgtaaagcggaccaattgcaggcgtatcctcgatgtaggttgcggcatgggaacaacgcttcttcgtatggctcaagagcatgtatccggtgttcaatttataggcgtagattttagcgaaaagatgattgaaagagcacgtacgtctagtttgtcactacatgatgacctaagaaagaaaataggattctttgtcgcaaatgctgagtctctaccctacatggaaggacaatttgacttcgttttcagcgaatgcgtacttaatttgattcctgaacgcgaaaaagctattgccgaagtcatgcgagtacttgcccctggaggtatgtttatttacacagatttcgttgcgttctcaccaatttccaattctatccgtgataatctgaatctcgttagcggatgcagagcgggaagtaaaacgttgagtgagaatattcgattattagaggaaacgggtttcgttaaaattgaatgcattgatttcacatcggacaagaacaaacgctatgctgacttgatgaacgagagtgaacaaattcgcagggaatttgaagagtttcgaaatttgtatcctgacgccgcagctttcttggatgaaagagtgggatattacctgatccttggctgcaagccgatttga

SEQ ID NO: 491 - DNA, 813 bp, Artificial
  Alicyclobacillus acidocaldarius mutated SEQ ID NO 478
atgagaaagaatgtgaacgcgaattgttgctcagcggaacctgaaccgttgacgccggcaaagagggttattaaggatttttatgatactgttgccgtgggaagtggaccatatccggcttcaacggataggttctcgccggctgcgccaactgagaagatcttagagtatgtaaagcggaccaattgcaggcgtatcctcgatgtaggttgcggcatgggaacaacgcttcttcgtatggctcaagagcatgtatccggtgttcaatttataggcgtagattttagcgaaaagatgattgaaagagcacgtacgtctagtttgtcactacatgatgacctaagaaagaaaataggattctttgtcgcaaatgctgagtctctaccctacatggaaggacaatttgacttcgttttcagcgaatgcgtacttaatttgattcctgaacgcgaaaaagctattgccgaagtcatgcgagtacttgcccctggaggtatgtttgtatacacagatttcgttgcgttctcaccaatttccaattctatccgtgataatattaatctcgttagcggatgcagagcgggaagtaaaacgttgagtgagaatattcgattattagaggaaacgggtttcgttaaaattgaatgcattgatttcacatcggacaagaacaaacgctatgctgacttgatgaacgagagtgaacaaattcgcagggaatttgaagagtttcgaaatttgtatcctgacgccgcagctttcttggatgaaagagtgggatattacctgatccttggctgcaagccgatttga

SEQ ID NO: 492 - DNA, 813 bp, Artificial
  Alicyclobacillus acidocaldarius mutated SEQ ID NO 478
atgagaaagaatgtgaacgcgaattgttgctcagcggaacctgaaccgttgacgccggcaaagagggttattaaggatttttatgatactgttgccgtgggaagtggaccatatccggcttcaacggataggttctcgccggctgcgccaactgagaagatcttagagtatgtaaagcggaccaattgcaggcgtatcctcgatgtaggttgcggcatgggaacaacgcttcttcgtatggctcaagagcatgtatccggtgttcaatttataggcgtagattttagcgaaaagatgattgaaagagcacgtacgtctagtttgtcactacatgatgacctaagaaagaaaataggattctttgtcgcaaatgctgagtctctaccctacatggaaggacaatttgacttcgttttcagcgaatgcgtacttaatttgattcctgaacgcgaaaaagctattgccgaagtcatgcgagtacttgcccctggaggtatgtttgtatacacagatttcgttgcgttctcaccaatttccaattctatccgtgataatctgaatctcgttagcggatgcagagcgggaagtaaaacgttgagtgagaatattcgattattagaggaaacgggtttcgttaaaattgaatgcattgatttcacatcggacaagaacaaacgctatgctgacttgatgaacgatagtgaacaaattcgcagggaatttgaagagtttcgaaatttgtatcctgacgccgcagctttcttggatgaaagagtgggatattacctgatccttggctgcaagccgatttga

SEQ ID NO: 493 - DNA, 813 bp, Artificial
  Alicyclobacillus acidocaldarius mutated SEQ ID NO 478
atgagaaagaatgtgaacgcgaattgttgctcagcggaacctgaaccgttgacgccggcaaagagggttattaaggatttttatgatactgttgccgtgggaagtggaccatatccggcttcaacggataggttctcgccggctgcgccaactgagaagatcttagagtatgtaaagcggaccaattgcaggcgtatcctcgatgtaggttgcggcatgggaacaacgcttcttcgtatggctcaagagcatgtatccggtgttcaatttataggcgtagattttagcgaaaagatgattgaaagagcacgtacgtctagtttgtcactacatgatgacctaagaaagaaaataggattctttgtcgcaaatgctgagtctctaccctacatggaaggacaatttgacttcgttttcagcgaatgcgtacttaatttgattcctgaacgcgaaaaagctattgccgaagtcatgcgagtacttgcccctggaggtatgtttgtatacacagatttcgttgcgttctcaccaatttccaattctatccgtgataatctgaatctcgttagcggatgcagagcgggaagtaaaacgttgagtgagaatattcgattattagaggaaacgggtttcgttaaaattgaatgcattgatttcacatcggacaagaacaaacgctatgctgacttgatgaacgagagtgaacaaattcgcagggaatttgaagagtttcgaaatttgtatcctgacgccgcagctttcttggatgaaagagtgggatattacctgatccttggctgcaagccgttatga

SEQ ID NO: 494 - protein, 423 aa, Alicyclobacillus acidocaldarius
MKILLVSVFEGGFQPQTIATAAGALSEIGVEIDALDVYIEDLRFNKVSDANLVAISVPLFDSIQPAIALSKEIRKINPRTHVTFFGQHATIHAQKLASTYGDSCIRGDWEYPLINLARYLMGNNSELVGVLLADDAKKGKSTPVYIGRNDLRVPARSILPPLDKYPQPHVERIMGSKQVVGATEIARGCHHKCLYCSVFAAYNGKVVLIPEDIVLEDAKNLVEQGMTHLSFIDADFFNAKWHGIKIIRKLHEKYPFLTYDFTTRVDHILENRDTFREMVNLGVKFVTSALEFPSEELLDEVEKQITVNDIREAIKFLREIGMKLNPTFIMFNPWTRLEDLIEFRAFIEDNNLQDLIDPVQYQTRLHLYKGSPLLIKKSVKNLELTELEFHYEWKHPDPRVDELYSQLHKPVENGVMKRCCLKC

SEQ ID NO: 495 - DNA, 1272 bp, Alicyclobacillus acidocaldarius
atgaaaattctattggtctcggtttttgaaggtgggtttcaacctcaaactatagcaactgccgcaggagctttatctgaaattggcgtggagattgatgcgttagatgtatatatagaagatctgagatttaataaagtgtccgatgcaaaccttgtcgcgatttccgtgccgctatttgactcaattcaacctgctatcgcgctgtcgaaagaaattcgtaaaataaacccacgcacacatgtcactttcttcggtcaacatgccacaattcatgcacaaaaactggcttcgacatatggtgattcatgcatccggggtgactgggaatatccgttaattaatcttgctcggtatctgatgggcaataatagcgaattagttggggtacttcttgctgatgacgcaaagaagggtaaaagtactcctgtttacattggaaggaatgacctgcgagtcccggctaggagtattttacccccgttagataagtatccacaacctcatgtggaacgtatcatgggatctaaacaggtggtaggcgctactgagattgctcggggctgtcatcataaatgtctgtactgttccgtctttgccgcgtataacggaaaggttgtattgattcccgaagacattgttttggaggatgcaaaaaatttggttgagcagggtatgacccatttgtcgtttattgatgcggacttcttcaatgcaaaatggcatggaattaaaattatacggaagctgcatgaaaaatatccgttcttaacatatgacttcactacgcgggtggatcacattcttgagaatagagatacatttcgagaaatggttaatctcggcgttaaatttgtaacttctgctctggaatttccttcagaggaattactcgatgaggtggaaaagcaaattactgttaatgatattcgcgaggcaatcaagttcctgagagaaatcggaatgaaattgaacccaacattcattatgttcaatccatggacaagactggaggatctaattgagttcagagcatttatagaagataacaatttacaagacttgattgaccccgtacagtatcaaacacgactacatctttacaaaggatctccattattgataaaaaaatctgtaaaaaatttagaattaacagagttagaattccactatgaatggaaacatccagatcctagagttgacgagttgtatagtcagcttcataaaccagtggaaaatggagtgatgaagaggtgttgtttgaagtgctag

SEQ ID NO: 496 - protein, 424 aa, Bacillus cereus
MNILLVSNFEGGFQPNTIATAATPLVKAGFDVEILDTYVEGLVEEKFKDKQLVAISVPLFDAVTAGIEVAKKVAEINPDAHITFFGQHATINANRLAGRYSDSCISGEWEHPLTLLAKHLSGETQESLPGVLSAEQAIKGESVHPYMARNHLDIPSRHLLPALHKYPQKQINRLLGSDQVVGSTEIARGCHHKCLYCSVFAAYDGKVILVPEEIVLQDVRNLVEGGMTHLTFIDADFFNAKYHGIKILRKLHEEFPELTYDFTTRVDHILENKKTLAEMKELGVKFITSALEFPSEEVLDAVAKDTSVADIEQGIAYLREIDIKLNPTFIMFNPWTTFEDLTTFRSFVEDNELGNIIDPIQYETRLYLYKGSPLLHKQSIQDLELTEYEFHYDWKHPDSKIDELYFEMLTPPEEGIFKRCCLKC

SEQ ID NO: 497 - protein, 424 aa, Bacillus cereus
MNILLVSNFEGGFQPNTIATAATPLVKAGFNVEILDTYVEGLVEEKFKDKQLVAISVPLFDAVTAGIEVAKKVAEINPDAHITFFGQHATINANRLAGRYSDSCISGEWEHPLTLLAKHLSGETQESLPGVLSAEQAIKGESVHPYMARNHLDIPSRHLLPALHKYPQKQINRLLGSDQVVGSTEIARGCHHKCLYCSVFAAYDGKVILVPEEIVLQDVRNLVEGGMTHLTFIDADFFNAKYHGIKILRKLHEEFPELTYDFTTRVDHILENKKTLAEMKELGVKFITSALEFPSEEVLDAVAKDTSVADIEQGIAYLREIDIKLNPTFIMFNPWTTFEDLTTFRSFVEDNELGNIIDPIQYETRLYLYKGSPLLRKQSIQDLELTEYEFHYDWKHPDSKIDELYFEMLTPPEEGIFKRCCLKC

SEQ ID NO: 498 - protein, 226 aa, Burkholderia oklahomensis
MYAAYDGKVIMVTDDIVVEDVRNLVKQGMEHLTFTDAEFFNAKNHGVRIMRRLHEEFPHLTYDFTTRVDHILEHEDAIREMSGLGLRFITSALEFPTQKVLDIVAKEISVDDIEMAIRRLKAIGVKLNPTFIMYNPWVSKEDILSFKAFIERNDLEDVVDPIQYETRLHLYKGSPLLNRASTAGLKLTEREFHFDWSHPDPAVDEMYYANVTPPEPGVFKRCCLKC

SEQ ID NO: 499 - protein, 401 aa, Sorangium cellulosum
MNVLLVSTYESGFQSLGTSVAAAHLLEADVRVNALDLSVTPTPDIDDLCRHDLVGFHLPMFHSVPAAVRVAGRLRQQEKAPKIFFYGLYADLFREKLLGRHGDYVLGTDWEDQIVPLVKRSPDPSVVQLQKRGFARQNRYRTPARQVLPHLGNYAKLVEDGAHMLAGCVEATRGCAHHCTHCPIPPVYGGKVTIIPEEVVLADIDNLVLMGARHVSFVDPDFLNVPRHGLSIMKAVNDKYPFLTYDFVAKVSHFRRHEQYVRELAKLGLKFVLTAMEFNDNEVLDILKKKHDIDDLDWSIGLFHELGVHLKPTFVMVNPWAEVGDIMDLLEFVETRGLIDAVDPIQYKIRLLLFNNSPLMDSVGLYASLGEESDYYTEWRHRNPAVEELHREICRWVDEAV

SEQ ID NO: 500 - protein, 407 aa, Solibacter usitatus
MRVLLVSTYEMGRQPFGLASPAAWLRAEGHEVTQADVSCTPMPKDAVEAAGLIAFFLPMHTATKLFLRLVDRVRAVNPRAHLCAYGLYAPLNERLLRGAGVGTVLGGEFESGLRDLARRLSSGDPAPAAPPVTISIERQQFLVPDRKGLPPLGAYAQLVVGNGTRRVGYTEASRGCKHLCRHCPVVPVYNGRFRIVQADIVLEDIRRQVAAGAAHITFGDPDFFNGPGHAVPIVEALHREWPWLSYDVTIKVEHLLKHRDLLPVLKETNCAFVTSAIESLDDEVLVKLAKGHTRAGFLEALVLMRAVDLPLSPTFIPFHPWTTLESYREFLRTLAENGLASQITPIQLAIRLLIPEGSLLMELPEVRALVGLFDARALSYPWRNPDPGLDRLCATIQATIKRGEKHR

SEQ ID NO: 501 - protein, 423 aa, Artificial
  Alicyclobacillus acidocaldarius mutated SEQ ID NO 494
MKILLVSVFEGGFQPQTIATAAGALSEIGVEIDALDVYIEDLRFNKVSDANLVAISVPLFDSIQPAIALSKEIRKINPRTHVTFFGQHATIHAQKLASTYGDSCIRGDWEYPLINLARYLMGNNSELVGVLLADDAKKGKSTPVYIGRNDLRVPARSILPPLDKYPQPHVERIMGSKQVVGATEIARGCHHKCLYCSVFAAYNGKVVLIPEDIVLEDAKNLVEQGMTHLSFIDADFFNAKWHGIKIIRKLHEKYPFLTYDFTTRVDHILENRDTFREMVNLGVKFVTSALEFPSEELLDEVEKQITVNDIREAIKFLREIGMKLNPTFIMFNPWTRLEDLIEFRAFIEDNNLQDLIDPVQYQTRLHLYKGSPLLIKKSVKNLELTELEFHYDWKHPDPRVDELYSQLHKPVENGVMKRCCLKC

SEQ ID NO: 502 - protein, 423 aa, Artificial
  Alicyclobacillus acidocaldarius mutated SEQ ID NO 494
MKILLVSVFEGGFQPQTIATAAGALSEIGVEIDALDVYIEDLRFNKVSDANLVAISVPIFDSIQPAIALSKEIRKINPRTHVTFFGQHATIHAQKLASTYGDSCIRGDWEYPLINLARYLMGNNSELVGVLLADDAKKGKSTPVYIGRNDLRVPARSILPPLDKYPQPHVERIMGSKQVVGATEIARGCHHKCLYCSVFAAYNGKVVLIPEDIVLEDAKNLVEQGMTHLSFIDADFFNAKWHGIKIIRKLHEKYPFLTYDFTTRVDHILENRDTFREMVNLGVKFVTSALEFPSEELLDEVEKQITVNDIREAIKFLREIGMKLNPTFIMFNPWTRLEDLIEFRAFIEDNNLQDLIDPVQYQTRLHLYKGSPLLIKKSVKNLELTELEFHYEWKHPDPRVDELYSQLHKPVENGVMKRCCLKC

SEQ ID NO: 503 - protein, 423 aa, Artificial
  Alicyclobacillus acidocaldarius mutated SEQ ID NO 494
MKILLVSVFEGGFQPQTIATAAGALSEIGVEIDALDVYIEDLRFNKVSDANLVAISVPLFDSIQPAIALSKEIRKINPRTHVTFFGQHATIHAQKLASTYGDSCIRGDWEYPLINLARYLMGNNSELVGVLLADDAKKGKSTPVYIGRNDLRVPARSILPPIDKYPQPHVERIMGSKQVVGATEIARGCHHKCLYCSVFAAYNGKVVLIPEDIVLEDAKNLVEQGMTHLSFIDADFFNAKWHGIKIIRKLHEKYPFLTYDFTTRVDHILENRDTFREMVNLGVKFVTSALEFPSEELLDEVEKQITVNDIREAIKFLREIGMKLNPTFIMFNPWTRLEDLIEFRAFIEDNNLQDLIDPVQYQTRLHLYKGSPLLIKKSVKNLELTELEFHYEWKHPDPRVDELYSQLHKPVENGVMKRCCLKC

SEQ ID NO: 504 - protein, 423 aa, Artificial
  Alicyclobacillus acidocaldarius mutated SEQ ID NO 494
MKILLVSVFEGGFQPQTIATAAGALSEIGVEIDALDVYIEDLRFNKVSDANLVAISVPLFDSIQPAIALSKEIRKINPRTHVTFFGQHATIHAQKLASTYGDSCIRGDWEYPLINLARYLMGNNSELVGVLLADDAKKGKSTPVYIGRNDLRVPARSILPPLDKYPQPHVERIMGSKQVVGATEIARGCHHKCLYCSVFAAYNGKVVLIPEDIVLEDAKNLVEQGMTHLSFIDADFFNAKWHGIKIIRKLHEKYPFLTYDFTTRVDHILENRDTFREMVNLGVKFVTSALEFPSEELLDEVEKQITVNDIREAIKFLREIGMKLNPTFIMFNPWTRLEDLIEFRAFIDDNNLQDLIDPVQYQTRLHLYKGSPLLIKKSVKNLELTELEFHYEWKHPDPRVDELYSQLHKPVENGVMKRCCLKC

SEQ ID NO: 505 - protein, 423 aa, Artificial
  Alicyclobacillus acidocaldarius mutated SEQ ID NO 494
MRILLVSVFEGGFQPQTIATAAGALSEIGVEIDALDVYIEDLRFNKVSDANLVAISVPLFDSIQPAIALSKEIRKINPRTHVTFFGQHATIHAQKLASTYGDSCIRGDWEYPLINLARYLMGNNSELVGVLLADDAKKGKSTPVYIGRNDLRVPARSILPPLDKYPQPHVERIMGSKQVVGATEIARGCHHKCLYCSVFAAYNGKVVLIPEDIVLEDAKNLVEQGMTHLSFIDADFFNAKWHGIKIIRKLHEKYPFLTYDFTTRVDHILENRDTFREMVNLGVKFVTSALEFPSEELLDEVEKQITVNDIREAIKFLREIGMKLNPTFIMFNPWTRLEDLIEFRAFIEDNNLQDLIDPVQYQTRLHLYKGSPLLIKKSVKNLELTELEFHYEWKHPDPRVDELYSQLHKPVENGVMKRCCLKC

SEQ ID NO: 506 - DNA, 1272 bp, Artificial
  Alicyclobacillus acidocaldarius mutated SEQ ID NO 495
atgaaaattctattggtctcggtttttgaaggtgggtttcaacctcaaactatagcaactgccgcaggagctttatctgaaattggcgtggagattgatgcgttagatgtatatatagaagatctgagatttaataaagtgtccgatgcaaaccttgtcgcgatttccgtgccgctatttgactcaattcaacctgctatcgcgctgtcgaaagaaattcgtaaaataaacccacgcacacatgtcactttcttcggtcaacatgccacaattcatgcacaaaaactggcttcgacatatggtgattcatgcatccggggtgactgggaatatccgttaattaatcttgctcggtatctgatgggcaataatagcgaattagttggggtacttcttgctgatgacgcaaagaagggtaaaagtactcctgtttacattggaaggaatgacctgcgagtcccggctaggagtattttacccccgttagataagtatccacaacctcatgtggaacgtatcatgggatctaaacaggtggtaggcgctactgagattgctcggggctgtcatcataaatgtctgtactgttccgtctttgccgcgtataacggaaaggttgtattgattcccgaagacattgttttggaggatgcaaaaaatttggttgagcagggtatgacccatttgtcgtttattgatgcggacttcttcaatgcaaaatggcatggaattaaaattatacggaagctgcatgaaaaatatccgttcttaacatatgacttcactacgcgggtggatcacattcttgagaatagagatacatttcgagaaatggttaatctcggcgttaaatttgtaacttctgctctggaatttccttcagaggaattactcgatgaggtggaaaagcaaattactgttaatgatattcgcgaggcaatcaagttcctgagagaaatcggaatgaaattgaacccaacattcattatgttcaatccatggacaagactggaggatctaattgagttcagagcatttatagaagataacaatttacaagacttgattgaccccgtacagtatcaaacacgactacatctttacaaaggatctccattattgataaaaaaatctgtaaaaaatttagaattaacagagttagaattccactatgattggaaacatccagatcctagagttgacgagttgtatagtcagcttcataaaccagtggaaaatggagtgatgaagaggtgttgtttgaagtgctag

SEQ ID NO: 507 - DNA, 1272 bp, Artificial
  Alicyclobacillus acidocaldarius mutated SEQ ID NO 495
atgaaaattctattggtctcggtttttgaaggtgggtttcaacctcaaactatagcaactgccgcaggagctttatctgaaattggcgtggagattgatgcgttagatgtatatatagaagatctgagatttaataaagtgtccgatgcaaaccttgtcgcgatttccgtgccgatttttgactcaattcaacctgctatcgcgctgtcgaaagaaattcgtaaaataaacccacgcacacatgtcactttcttcggtcaacatgccacaattcatgcacaaaaactggcttcgacatatggtgattcatgcatccggggtgactgggaatatccgttaattaatcttgctcggtatctgatgggcaataatagcgaattagttggggtacttcttgctgatgacgcaaagaagggtaaaagtactcctgtttacattggaaggaatgacctgcgagtcccggctaggagtattttacccccgttagataagtatccacaacctcatgtggaacgtatcatgggatctaaacaggtggtaggcgctactgagattgctcggggctgtcatcataaatgtctgtactgttccgtctttgccgcgtataacggaaaggttgtattgattcccgaagacattgttttggaggatgcaaaaaatttggttgagcagggtatgacccatttgtcgtttattgatgcggacttcttcaatgcaaaatggcatggaattaaaattatacggaagctgcatgaaaaatatccgttcttaacatatgacttcactacgcgggtggatcacattcttgagaatagagatacatttcgagaaatggttaatctcggcgttaaatttgtaacttctgctctggaatttccttcagaggaattactcgatgaggtggaaaagcaaattactgttaatgatattcgcgaggcaatcaagttcctgagagaaatcggaatgaaattgaacccaacattcattatgttcaatccatggacaagactggaggatctaattgagttcagagcatttatagaagataacaatttacaagacttgattgaccccgtacagtatcaaacacgactacatctttacaaaggatctccattattgataaaaaaatctgtaaaaaatttagaattaacagagttagaattccactatgaatggaaacatccagatcctagagttgacgagttgtatagtcagcttcataaaccagtggaaaatggagtgatgaagaggtgttgtttgaagtgctag

SEQ ID NO: 508 - DNA, 1272 bp, Artificial
  Alicyclobacillus acidocaldarius mutated SEQ ID NO 495
atgaaaattctattggtctcggtttttgaaggtgggtttcaacctcaaactatagcaactgccgcaggagctttatctgaaattggcgtggagattgatgcgttagatgtatatatagaagatctgagatttaataaagtgtccgatgcaaaccttgtcgcgatttccgtgccgctatttgactcaattcaacctgctatcgcgctgtcgaaagaaattcgtaaaataaacccacgcacacatgtcactttcttcggtcaacatgccacaattcatgcacaaaaactggcttcgacatatggtgattcatgcatccggggtgactgggaatatccgttaattaatcttgctcggtatctgatgggcaataatagcgaattagttggggtacttcttgctgatgacgcaaagaagggtaaaagtactcctgtttacattggaaggaatgacctgcgagtcccggctaggagtattttacccccgattgataagtatccacaacctcatgtggaacgtatcatgggatctaaacaggtggtaggcgctactgagattgctcggggctgtcatcataaatgtctgtactgttccgtctttgccgcgtataacggaaaggttgtattgattcccgaagacattgttttggaggatgcaaaaaatttggttgagcagggtatgacccatttgtcgtttattgatgcggacttcttcaatgcaaaatggcatggaattaaaattatacggaagctgcatgaaaaatatccgttcttaacatatgacttcactacgcgggtggatcacattcttgagaatagagatacatttcgagaaatggttaatctcggcgttaaatttgtaacttctgctctggaatttccttcagaggaattactcgatgaggtggaaaagcaaattactgttaatgatattcgcgaggcaatcaagttcctgagagaaatcggaatgaaattgaacccaacattcattatgttcaatccatggacaagactggaggatctaattgagttcagagcatttatagaagataacaatttacaagacttgattgaccccgtacagtatcaaacacgactacatctttacaaaggatctccattattgataaaaaaatctgtaaaaaatttagaattaacagagttagaattccactatgaatggaaacatccagatcctagagttgacgagttgtatagtcagcttcataaaccagtggaaaatggagtgatgaagaggtgttgtttgaagtgctag

SEQ ID NO: 509 - DNA, 1272 bp, Artificial
  Alicyclobacillus acidocaldarius mutated SEQ ID NO 495
atgaaaattctattggtctcggtttttgaaggtgggtttcaacctcaaactatagcaactgccgcaggagctttatctgaaattggcgtggagattgatgcgttagatgtatatatagaagatctgagatttaataaagtgtccgatgcaaaccttgtcgcgatttccgtgccgctatttgactcaattcaacctgctatcgcgctgtcgaaagaaattcgtaaaataaacccacgcacacatgtcactttcttcggtcaacatgccacaattcatgcacaaaaactggcttcgacatatggtgattcatgcatccggggtgactgggaatatccgttaattaatcttgctcggtatctgatgggcaataatagcgaattagttggggtacttcttgctgatgacgcaaagaagggtaaaagtactcctgtttacattggaaggaatgacctgcgagtcccggctaggagtattttacccccgttagataagtatccacaacctcatgtggaacgtatcatgggatctaaacaggtggtaggcgctactgagattgctcggggctgtcatcataaatgtctgtactgttccgtctttgccgcgtataacggaaaggttgtattgattcccgaagacattgttttggaggatgcaaaaaatttggttgagcagggtatgacccatttgtcgtttattgatgcggacttcttcaatgcaaaatggcatggaattaaaattatacggaagctgcatgaaaaatatccgttcttaacatatgacttcactacgcgggtggatcacattcttgagaatagagatacatttcgagaaatggttaatctcggcgttaaatttgtaacttctgctctggaatttccttcagaggaattactcgatgaggtggaaaagcaaattactgttaatgatattcgcgaggcaatcaagttcctgagagaaatcggaatgaaattgaacccaacattcattatgttcaatccatggacaagactggaggatctaattgagttcagagcatttatagatgataacaatttacaagacttgattgaccccgtacagtatcaaacacgactacatctttacaaaggatctccattattgataaaaaaatctgtaaaaaatttagaattaacagagttagaattccactatgaatggaaacatccagatcctagagttgacgagttgtatagtcagcttcataaaccagtggaaaatggagtgatgaagaggtgttgtttgaagtgctag

SEQ ID NO: 510 - DNA, 1272 bp, Artificial
  Alicyclobacillus acidocaldarius mutated SEQ ID NO 495
atgcgtattctattggtctcggtttttgaaggtgggtttcaacctcaaactatagcaactgccgcaggagctttatctgaaattggcgtggagattgatgcgttagatgtatatatagaagatctgagatttaataaagtgtccgatgcaaaccttgtcgcgatttccgtgccgctatttgactcaattcaacctgctatcgcgctgtcgaaagaaattcgtaaaataaacccacgcacacatgtcactttcttcggtcaacatgccacaattcatgcacaaaaactggcttcgacatatggtgattcatgcatccggggtgactgggaatatccgttaattaatcttgctcggtatctgatgggcaataatagcgaattagttggggtacttcttgctgatgacgcaaagaagggtaaaagtactcctgtttacattggaaggaatgacctgcgagtcccggctaggagtattttacccccgttagataagtatccacaacctcatgtggaacgtatcatgggatctaaacaggtggtaggcgctactgagattgctcggggctgtcatcataaatgtctgtactgttccgtctttgccgcgtataacggaaaggttgtattgattcccgaagacattgttttggaggatgcaaaaaatttggttgagcagggtatgacccatttgtcgtttattgatgcggacttcttcaatgcaaaatggcatggaattaaaattatacggaagctgcatgaaaaatatccgttcttaacatatgacttcactacgcgggtggatcacattcttgagaatagagatacatttcgagaaatggttaatctcggcgttaaatttgtaacttctgctctggaatttccttcagaggaattactcgatgaggtggaaaagcaaattactgttaatgatattcgcgaggcaatcaagttcctgagagaaatcggaatgaaattgaacccaacattcattatgttcaatccatggacaagactggaggatctaattgagttcagagcatttatagaagataacaatttacaagacttgattgaccccgtacagtatcaaacacgactacatctttacaaaggatctccattattgataaaaaaatctgtaaaaaatttagaattaacagagttagaattccactatgaatggaaacatccagatcctagagttgacgagttgtatagtcagcttcataaaccagtggaaaatggagtgatgaagaggtgttgtttgaagtgctag

SEQ ID NO: 511 - protein, 82 aa, Alicyclobacillus acidocaldarius
MTVILGSAVHGKAIKPFAGIAIGATVALDALFGGPISGASMNPARSFGPAVVSGMFHFLWIYFVATVLGAVIASAIYRIIRF

SEQ ID NO: 512 - DNA, 249 bp, Alicyclobacillus acidocaldarius
atgactgtaatcttgggatccgctgttcatggtaaagcaataaagccctttgctggcattgcaattggtgctactgttgcgctggatgctctatttggaggcccaatcagtggtgcgtccatgaatccggctcgttcgttcggacctgcagtagtctcaggcatgtttcattttttgtggatttatttcgtggctactgtgttgggggcagttatagcatcagctatttacaggatcattagattctga

SEQ ID NO: 513 - protein, 80 aa, Bacillus cereus
MMVIFASATHGKATKSFAGVAIGSTVALEAMFGGPISGASMNPARSFGPALISGTFEYLWIYLVATTLGALLAAIVYKFI

SEQ ID NO: 514 - protein, 77 aa, Caminibacter mediatlanticus
MIVIYTSAIHGKAIKSFAGIAIGFTVGIEAMIGGAISGASMNPARSIGPAIVSGNLDSLWLYIVASILGAIVAGVVF

SEQ ID NO: 515 - protein, 81 aa, Gloeobacter violaceus
MLVICGSALDARAPRGFAGLAIGLTVGLEAGFGGPISGASMNPARSFGPALVAGAWEAHWVYWLAPIAGALLAGWVWHQMR

SEQ ID NO: 516 - protein, 82 aa, Vitis vinifera
MFVISGVATDNRAIGELAGLAVGATVLLNVMFAGPISGASMNPARSLGPAIVSNTYRGIWIYLLAPTCGAISGAWVYNIIRF

SEQ ID NO: 517 - protein, 82 aa, Glycine max
MFVICGVATDNRAVGEFAGIAIGSTLLLNVIIGGPVTGASMNPARSLGPAFVHGEYEGIWIYLLAPVVGAIAGAWVYNIVRY

SEQ ID NO: 518 - protein, 82 aa, Artificial
  Alicyclobacillus acidocaldarius mutated SEQ ID NO 511
MTVILGSAVHGKAIKPFAGIAIGATVALDALFGGPISGASMNPARSFGPAVVSGMFHFLWIYFVATVIGAVIASAIYRIIRF

SEQ ID NO: 519 - protein, 82 aa, Artificial
  Alicyclobacillus acidocaldarius mutated SEQ ID NO 511
MTVILGSAVHGKAIRPFAGIAIGATVALDALFGGPISGASMNPARSFGPAVVSGMFHFLWIYFVATVLGAVIASAIYRIIRF

SEQ ID NO: 520 - protein, 82 aa, Artificial
  Alicyclobacillus acidocaldarius mutated SEQ ID NO 511
MTVIIGSAVHGKAIKPFAGIAIGATVALDALFGGPISGASMNPARSFGPAVVSGMFHFLWIYFVATVLGAVIASAIYRIIRF

SEQ ID NO: 521 - protein, 82 aa, Artificial
  Alicyclobacillus acidocaldarius mutated SEQ ID NO 511
MTVILGSAVHGKAIKPFAGIAIGATVALDALFGGPISGASMNPARSFGPAVVSGMFHFLWIYFVATVLGAVIASAIYRIIKF

SEQ ID NO: 522 - protein, 82 aa, Artificial
  Alicyclobacillus acidocaldarius mutated SEQ ID NO 511
MTVILGSAVHGKAIKPFAGIAIGATVALDALFGGPISGASMNPARSFGPAVVSGMFHFLWIYFVATILGAVIASAIYRIIRF

SEQ ID NO: 523 - DNA, 249 bp, Artificial
  Alicyclobacillus acidocaldarius mutated SEQ ID NO 512
atgactgtaatcttgggatccgctgttcatggtaaagcaataaagccctttgctggcattgcaattggtgctactgttgcgctggatgctctatttggaggcccaatcagtggtgcgtccatgaatccggctcgttcgttcggacctgcagtagtctcaggcatgtttcattttttgtggatttatttcgtggctactgtgattggggcagttatagcatcagctatttacaggatcattagattctga

SEQ ID NO: 524 - DNA, 249 bp, Artificial
  Alicyclobacillus acidocaldarius mutated SEQ ID NO 512
atgactgtaatcttgggatccgctgttcatggtaaagcaatacgtccctttgctggcattgcaattggtgctactgttgcgctggatgctctatttggaggcccaatcagtggtgcgtccatgaatccggctcgttcgttcggacctgcagtagtctcaggcatgtttcattttttgtggatttatttcgtggctactgtgttgggggcagttatagcatcagctatttacaggatcattagattctga

SEQ ID NO: 525 - DNA, 249 bp, Artificial
  Alicyclobacillus acidocaldarius mutated SEQ ID NO 512
atgactgtaatcattggatccgctgttcatggtaaagcaataaagccctttgctggcattgcaattggtgctactgttgcgctggatgctctatttggaggcccaatcagtggtgcgtccatgaatccggctcgttcgttcggacctgcagtagtctcaggcatgtttcattttttgtggatttatttcgtggctactgtgttgggggcagttatagcatcagctatttacaggatcattagattctga

SEQ ID NO: 526 - DNA, 249 bp, Artificial
  Alicyclobacillus acidocaldarius mutated SEQ ID NO 512
atgactgtaatcttgggatccgctgttcatggtaaagcaataaagccctttgctggcattgcaattggtgctactgttgcgctggatgctctatttggaggcccaatcagtggtgcgtccatgaatccggctcgttcgttcggacctgcagtagtctcaggcatgtttcattttttgtggatttatttcgtggctactgtgttgggggcagttatagcatcagctatttacaggatcattaaattctga

SEQ ID NO: 527 - DNA, 249 bp, Artificial
  Alicyclobacillus acidocaldarius mutated SEQ ID NO 512
atgactgtaatcttgggatccgctgttcatggtaaagcaataaagccctttgctggcattgcaattggtgctactgttgcgctggatgctctatttggaggcccaatcagtggtgcgtccatgaatccggctcgttcgttcggacctgcagtagtctcaggcatgtttcattttttgtggatttatttcgtggctactattttgggggcagttatagcatcagctatttacaggatcattagattctga

SEQ ID NO: 528 - protein, 369 aa, Alicyclobacillus acidocaldarius
MSVKLVLLGGFLGAGKTTTLIRAAHMFQSAGQNVAVITNDQGTELIDTELSRLNELNTEEVTGGCFCCRFNELYDKLISLKSQFRPDVIIAEAVGSCTDLAATVIRPLKQYYGKEFDVAPLTVVVDPGRILSEIGPKEKINFSRSVSYIFDKQLSEADIIALNKIDKYEERCINDLEDYLQKRYPTAVIHTFSAHRGDNMERLLDLWRTLNISGEKALDIDYDKYAQGEAKLAWLNSLIDLSVDEANHFDAKLWMHMFLDKLHEHFLREKMAIAHLKVYVGSDNGFIKASIVETGDTPTYIVKEPVNGQEFRVVINIRIETEPELLSLVVADALAIVNKEMKVKWKQTYHECFSPLPPNPTHRLRVAAK

SEQ ID NO: 529 - DNA, 1110 bp, Alicyclobacillus acidocaldarius
atgagtgtaaaactggtacttctcggaggatttttaggggcagggaaaaccacaacgttgattcgggctgcgcacatgtttcaaagtgcaggtcagaacgtcgcagtaattaccaacgatcaaggcacggaattaattgatacagaattgtcccgtttaaatgagctgaataccgaagaagttacgggcggttgtttttgctgcagattcaatgagctttatgacaaattgatatctctgaaatctcaatttcgaccagatgttattatcgctgaggcggttggaagttgcacagatttggccgccactgtcataagacctcttaaacaatattacggtaaggaattcgatgtggcgcctctgacggtagtcgtggatccgggtcgcattctttctgagattgggccaaaagagaaaattaatttttctagatctgttagctatatctttgataagcaactatcggaagccgatatcattgcgttgaacaagatagataagtacgaagagaggtgcattaatgatttggaggattatttacagaagcgctatcccactgctgttattcataccttttcggcccatcgaggagataacatggagaggttattggacctctggaggacactgaacataagtggagagaaagccctagatattgactatgacaagtatgcacaaggagaagcaaaacttgcttggctgaattcattgattgacttatccgtggacgaggctaatcatttcgatgctaagttatggatgcatatgtttctggataaattacacgaacattttcttcgtgaaaagatggcaattgcacatctaaaggtttacgttggttccgacaatggctttattaaagcgagtattgttgaaacaggagacacgccgacttatatagtcaaggagcctgtaaatggacaagaattccgcgtggtaatcaatattcgtatagagaccgagcctgagctcctgagtcttgtagtcgcggacgcactcgcaattgtaaataaggagatgaaagttaagtggaaacaaacatatcacgaatgcttcagtccattaccacctaatccgactcacaggttacgcgtagcggcaaaatga

SEQ ID NO: 530 - protein, 363 aa, Bacillus cereus
TARLVLLGGFLGAGKTTTMIKSALKLEKEGYRVAIVTNDQGKELIDTELARANGLESKEVTGGCFCCQFDDLYNNLNTLMKEKQPDVIIAEAVGSCTDLAATVIQPLKQYYADKFKTAPLTIVVEPARLLHELNLDENTKPFFSQSVSYIFEKQLAEADIIALNKVDRYSEEEIAKLKAYLQQRYPQTIIQTFSAERGDNLEALTHTWLTTDLGGDKVLDIDYELYAEGEAQLAWMNILGDIKAEQDINPREWAEKLLDNLNKHFIREKMAIAHLKVHVGFEGGYVKASMVQTGDAPTFTVENVKEGKEFRIVLNIRIEATPAILNLVVADSIGAINKELGSNWSETYNECFSPLPPKPVHRL

SEQ ID NO: 531 - protein, 359 aa, Blastopirellula marina
IRFVMIGGFLGAGKTTTIGRLAQHYRDQGLNVGIVTNDQATDLVDTQMLRSQGFRVGEVAGACFCCNFNELTGTVEKLAAEDRPDIVIAEPVGSCTDLVATVVQPLVRMFDAQFDVAPYGVILKPSHGLRILQGEDSGGFSPKAAYIFKKQLEEADFVIINRIDELDAEKVDLLASLITEAFPGTPILRTSAKTGAGFDALVELIDQRGEFGKKILDIDYDVYAEGEAELGWLNSSLKATASEAFDLDAFLMAIMNAMQKTLANSHAETAHLKTIGLWEGFYGVANLVSSDTAPILSLPSNCQAKEADVVVNARVGISPEELRQQVDDAIDAAAKKFGVRIERQQTQYFRPGRPVPTHR

SEQ ID NO: 532 - protein, 359 aa, Planctomyces maris
IKFIMVGGFLGAGKTTTLGRLAKYYSDQGLNVGVVTNDQAADLVDTNALRSQGLHVGEVAGACFCCHFNALMDTIEELGSEQKPDVILAEPVGSCTDLVATVIQPIKRLFDADFSILPYTVLMKPSHGLKILKNDKGSGFSPKAAYILKKQLEEADLILINRIDELSAEEVDEITALVNEQFPGTPVLRTSALTGEGFEPLLEFLEQDGDFGSKILDIDYDIYAEGEAELGWLNSSVHISAENSFSLDQLLLDVISQLQTSFKEKSVETAHLKTIGLWEGFFGVANLVSNDSEPRLSLSSDCTVTEADLIVNARVACDPEALTAQVKQVLQNCAQALNAKLEFRQTQSFRPGRPVPTHR

SEQ ID NO: 533 - protein, 362 aa, Gemmata obscuriglobus
MTVRFVMVGGFLGAGKTTTLGRLARHYQQQGKRVGVVTNDQAHDLVDTNTLRAQGLSVEEVPGACFCCRFDDLVGRVGSLEAGERPDVILAEPVGSCTDLVATVIQPLKDLYSGRFEVAPYAVLFKPSHGLRILRNQAAGGFSPKAAYIFKKQLEEADAIVINRVDELDPAQIDELSLLVTQQFPGTPVLRASATTGAGFDALTELLDQTGAFGRKILDIDYDIYAEGEAELGWLNATARLTSDEPFDLDALLTSVLGELAVVCRSLGGEVAHLKLIGMDDASAFAVGNVISSDTAPKLSLPSGLRPREADLIVNARVAIDPAVLEAEVKRVVALESAKVGVIAEFRTSQSLRPGRPVPTHR

SEQ ID NO: 534 - protein, 356 aa, Desulfuromonas acetoxidans
MSCRLILVGGFLGAGKTTLLAETAHKLSLQGLKVGLITNDQATNLVDTRMLVRSGAGVAEVSGSCFCCNFQGLLDAMDQLKKTFDADIVLAEPVGSCTDLSATIIQPLKDKLQSKLLISPLTVLADPIKLGAILAGGTAGLHDDAAYIYRKQLEEADLILISKVDLLTLPMVDDLLIRVRKAFPSAIVQPLSAERNVGLDYWLDHVLHKTTAGNTLLDIDYDRYAEGEAVLGWLNARFELRTTAGTWRTFAEAIMTRLHHQFAERNLPIGHVKLIVESESQVLFANLTGTEIEPKIRGEMTSTPHATMTINARVETSPEELRQIIWQALQQSSDGINVYQEQWNCLKPGRPEPTYR

SEQ ID NO: 535 - protein, 369 aa, Artificial
  Alicyclobacillus acidocaldarius mutated SEQ ID NO 528
MSVKLVLLGGFLGAGKTTTLIRAAHMFQSAGQNVAVITNDQGTELIDTELSRLNELNTEEVTGGCFCCRFNELYDKLISLKSQFRPDVIIAEAVGSCTDLAATVIRPLKQYYGKEFDVAPLTVVVDPGRILSEIGPKEKINFSRSVSYIFDKQLSEADIIALNKIDKYEERCINDLEDYLQKRYPTAVIHTFSAHRGDNMERLLDLWRTLNISGEKALDIDYDKYAQGEAKLAWLNSLIDLSVDEANHFDAKLWMHMFLDKLHEHFLREKMAIAHLKVYVGSDNGFIKASIVETGDTPTYIVKEPVNGQEFRVVINIRIETEPELLSLVVADALAIVNKDMKVKWKQTYHECFSPLPPNPTHRLRVAAK

SEQ ID NO: 536 - protein, 369 aa, Artificial
  Alicyclobacillus acidocaldarius mutated SEQ ID NO 528
MSVKLVLLGGFLGAGKTTTLIRAAHMFQSAGQNVAVITNDQGTELIDTELSRLNELNTEEVTGGCFCCRFNELYDKLISLKSQFRPDVIIAEAVGSCTDLAATVIRPLKQYYGKEFDVAPLTVVVDPGRILSEIGPKEKINFSRSVSYIFDKQLSEADIIALNKIDKYEERCINDLEDYLQKRYPTAVIHTFSAHRGDNMERLLDLWRTLNISGEKALDIDYDKYAQGEAKLAWLNSLIDLSVDEANHFDAKLWMHMFLDKLHEHFLREKMAIAHLKVYVGSDNGFIKASIVETGDTPTYIVKEPVNGQEFRVVINIRIETEPELLSLVVADALAIINKEMKVKWKQTYHECFSPLPPNPTHRLRVAAK

SEQ ID NO: 537 - protein, 369 aa, Artificial
  Alicyclobacillus acidocaldarius mutated SEQ ID NO 528
MSVKLVLLGGFLGAGKTTTLIRAAHMFQSAGQNVAVITNDQGTELIDTELSRLNELNTEEVTGGCFCCRFNELYDKLLSLKSQFRPDVIIAEAVGSCTDLAATVIRPLKQYYGKEFDVAPLTVVVDPGRILSEIGPKEKINFSRSVSYIFDKQLSEADIIALNKIDKYEERCINDLEDYLQKRYPTAVIHTFSAHRGDNMERLLDLWRTLNISGEKALDIDYDKYAQGEAKLAWLNSLIDLSVDEANHFDAKLWMHMFLDKLHEHFLREKMAIAHLKVYVGSDNGFIKASIVETGDTPTYIVKEPVNGQEFRVVINIRIETEPELLSLVVADALAIVNKEMKVKWKQTYHECFSPLPPNPTHRLRVAAK

SEQ ID NO: 538 - protein, 369 aa, Artificial
  Alicyclobacillus acidocaldarius mutated SEQ ID NO 528
MSVKLVLLGGFLGAGKTTTLIRAAHMFQSAGQNVAVITNDQGTELIDTELSRLNELNTEEVTGGCFCCRFNELYDRLISLKSQFRPDVIIAEAVGSCTDLAATVIRPLKQYYGKEFDVAPLTVVVDPGRILSEIGPKEKINFSRSVSYIFDKQLSEADIIALNKIDKYEERCINDLEDYLQKRYPTAVIHTFSAHRGDNMERLLDLWRTLNISGEKALDIDYDKYAQGEAKLAWLNSLIDLSVDEANHFDAKLWMHMFLDKLHEHFLREKMAIAHLKVYVGSDNGFIKASIVETGDTPTYIVKEPVNGQEFRVVINIRIETEPELLSLVVADALAIVNKEMKVKWKQTYHECFSPLPPNPTHRLRVAAK

SEQ ID NO: 539 - protein, 369 aa, Artificial
  Alicyclobacillus acidocaldarius mutated SEQ ID NO 528
MSVKLVLLGGFLGAGKTTTLIRAAHMFQSAGQNVAVITNDQGTELIDTELSRLNELNTEEVTGGCFCCRFNELYDKLISLKSQFRPDVIIAEAVGSCTDLAATVIRPLKQYYGKEFDVAPLTVVVDPGRILSEIGPKEKINFSRSVSYIFDKQLSEADIIALNKIDKYEERCINDLEDYLQKRYPTAVIHTFSAHRGDNMERLLDLWRTLNISGEKALDIDYDKYAQGEAKLAWLNSLIDLSVDEANHFDAKLWMHMFLDKLHEHFLREKMAIAHLKVYVGSDNGFIKASIVETGDTPTYLVKEPVNGQEFRVVINIRIETEPELLSLVVADALAIVNKEMKVKWKQTYHECFSPLPPNPTHRLRVAAK

SEQ ID NO: 540 - DNA, 1110 bp, Artificial
  Alicyclobacillus acidocaldarius mutated SEQ ID NO 529
atgagtgtaaaactggtacttctcggaggatttttaggggcagggaaaaccacaacgttgattcgggctgcgcacatgtttcaaagtgcaggtcagaacgtcgcagtaattaccaacgatcaaggcacggaattaattgatacagaattgtcccgtttaaatgagctgaataccgaagaagttacgggcggttgtttttgctgcagattcaatgagctttatgacaaattgatatctctgaaatctcaatttcgaccagatgttattatcgctgaggcggttggaagttgcacagatttggccgccactgtcataagacctcttaaacaatattacggtaaggaattcgatgtggcgcctctgacggtagtcgtggatccgggtcgcattctttctgagattgggccaaaagagaaaattaatttttctagatctgttagctatatctttgataagcaactatcggaagccgatatcattgcgttgaacaagatagataagtacgaagagaggtgcattaatgatttggaggattatttacagaagcgctatcccactgctgttattcataccttttcggcccatcgaggagataacatggagaggttattggacctctggaggacactgaacataagtggagagaaagccctagatattgactatgacaagtatgcacaaggagaagcaaaacttgcttggctgaattcattgattgacttatccgtggacgaggctaatcatttcgatgctaagttatggatgcatatgtttctggataaattacacgaacattttcttcgtgaaaagatggcaattgcacatctaaaggtttacgttggttccgacaatggctttattaaagcgagtattgttgaaacaggagacacgccgacttatatagtcaaggagcctgtaaatggacaagaattccgcgtggtaatcaatattcgtatagagaccgagcctgagctcctgagtcttgtagtcgcggacgcactcgcaattgtaaataaggatatgaaagttaagtggaaacaaacatatcacgaatgcttcagtccattaccacctaatccgactcacaggttacgcgtagcggcaaaatga

SEQ ID NO: 541 - DNA, 1110 bp, Artificial
  Alicyclobacillus acidocaldarius mutated SEQ ID NO 529
atgagtgtaaaactggtacttctcggaggatttttaggggcagggaaaaccacaacgttgattcgggctgcgcacatgtttcaaagtgcaggtcagaacgtcgcagtaattaccaacgatcaaggcacggaattaattgatacagaattgtcccgtttaaatgagctgaataccgaagaagttacgggcggttgtttttgctgcagattcaatgagctttatgacaaattgatatctctgaaatctcaatttcgaccagatgttattatcgctgaggcggttggaagttgcacagatttggccgccactgtcataagacctcttaaacaatattacggtaaggaattcgatgtggcgcctctgacggtagtcgtggatccgggtcgcattctttctgagattgggccaaaagagaaaattaatttttctagatctgttagctatatctttgataagcaactatcggaagccgatatcattgcgttgaacaagatagataagtacgaagagaggtgcattaatgatttggaggattatttacagaagcgctatcccactgctgttattcataccttttcggcccatcgaggagataacatggagaggttattggacctctggaggacactgaacataagtggagagaaagccctagatattgactatgacaagtatgcacaaggagaagcaaaacttgcttggctgaattcattgattgacttatccgtggacgaggctaatcatttcgatgctaagttatggatgcatatgtttctggataaattacacgaacattttcttcgtgaaaagatggcaattgcacatctaaaggtttacgttggttccgacaatggctttattaaagcgagtattgttgaaacaggagacacgccgacttatatagtcaaggagcctgtaaatggacaagaattccgcgtggtaatcaatattcgtatagagaccgagcctgagctcctgagtcttgtagtcgcggacgcactcgcaattattaataaggagatgaaagttaagtggaaacaaacatatcacgaatgcttcagtccattaccacctaatccgactcacaggttacgcgtagcggcaaaatga

SEQ ID NO: 542 - DNA, 1110 bp, Artificial
  Alicyclobacillus acidocaldarius mutated SEQ ID NO 529
atgagtgtaaaactggtacttctcggaggatttttaggggcagggaaaaccacaacgttgattcgggctgcgcacatgtttcaaagtgcaggtcagaacgtcgcagtaattaccaacgatcaaggcacggaattaattgatacagaattgtcccgtttaaatgagctgaataccgaagaagttacgggcggttgtttttgctgcagattcaatgagctttatgacaaattgttatctctgaaatctcaatttcgaccagatgttattatcgctgaggcggttggaagttgcacagatttggccgccactgtcataagacctcttaaacaatattacggtaaggaattcgatgtggcgcctctgacggtagtcgtggatccgggtcgcattctttctgagattgggccaaaagagaaaattaatttttctagatctgttagctatatctttgataagcaactatcggaagccgatatcattgcgttgaacaagatagataagtacgaagagaggtgcattaatgatttggaggattatttacagaagcgctatcccactgctgttattcataccttttcggcccatcgaggagataacatggagaggttattggacctctggaggacactgaacataagtggagagaaagccctagatattgactatgacaagtatgcacaaggagaagcaaaacttgcttggctgaattcattgattgacttatccgtggacgaggctaatcatttcgatgctaagttatggatgcatatgtttctggataaattacacgaacattttcttcgtgaaaagatggcaattgcacatctaaaggtttacgttggttccgacaatggctttattaaagcgagtattgttgaaacaggagacacgccgacttatatagtcaaggagcctgtaaatggacaagaattccgcgtggtaatcaatattcgtatagagaccgagcctgagctcctgagtcttgtagtcgcggacgcactcgcaattgtaaataaggagatgaaagttaagtggaaacaaacatatcacgaatgcttcagtccattaccacctaatccgactcacaggttacgcgtagcggcaaaatga

SEQ ID NO: 543 - DNA, 1110 bp, Artificial
  Alicyclobacillus acidocaldarius mutated SEQ ID NO 529
atgagtgtaaaactggtacttctcggaggatttttaggggcagggaaaaccacaacgttgattcgggctgcgcacatgtttcaaagtgcaggtcagaacgtcgcagtaattaccaacgatcaaggcacggaattaattgatacagaattgtcccgtttaaatgagctgaataccgaagaagttacgggcggttgtttttgctgcagattcaatgagctttatgaccgtttgatatctctgaaatctcaatttcgaccagatgttattatcgctgaggcggttggaagttgcacagatttggccgccactgtcataagacctcttaaacaatattacggtaaggaattcgatgtggcgcctctgacggtagtcgtggatccgggtcgcattctttctgagattgggccaaaagagaaaattaatttttctagatctgttagctatatctttgataagcaactatcggaagccgatatcattgcgttgaacaagatagataagtacgaagagaggtgcattaatgatttggaggattatttacagaagcgctatcccactgctgttattcataccttttcggcccatcgaggagataacatggagaggttattggacctctggaggacactgaacataagtggagagaaagccctagatattgactatgacaagtatgcacaaggagaagcaaaacttgcttggctgaattcattgattgacttatccgtggacgaggctaatcatttcgatgctaagttatggatgcatatgtttctggataaattacacgaacattttcttcgtgaaaagatggcaattgcacatctaaaggtttacgttggttccgacaatggctttattaaagcgagtattgttgaaacaggagacacgccgacttatatagtcaaggagcctgtaaatggacaagaattccgcgtggtaatcaatattcgtatagagaccgagcctgagctcctgagtcttgtagtcgcggacgcactcgcaattgtaaataaggagatgaaagttaagtggaaacaaacatatcacgaatgcttcagtccattaccacctaatccgactcacaggttacgcgtagcggcaaaatga

SEQ ID NO: 544 - DNA, 1110 bp, Artificial
  Alicyclobacillus acidocaldarius mutated SEQ ID NO 529
atgagtgtaaaactggtacttctcggaggatttttaggggcagggaaaaccacaacgttgattcgggctgcgcacatgtttcaaagtgcaggtcagaacgtcgcagtaattaccaacgatcaaggcacggaattaattgatacagaattgtcccgtttaaatgagctgaataccgaagaagttacgggcggttgtttttgctgcagattcaatgagctttatgacaaattgatatctctgaaatctcaatttcgaccagatgttattatcgctgaggcggttggaagttgcacagatttggccgccactgtcataagacctcttaaacaatattacggtaaggaattcgatgtggcgcctctgacggtagtcgtggatccgggtcgcattctttctgagattgggccaaaagagaaaattaatttttctagatctgttagctatatctttgataagcaactatcggaagccgatatcattgcgttgaacaagatagataagtacgaagagaggtgcattaatgatttggaggattatttacagaagcgctatcccactgctgttattcataccttttcggcccatcgaggagataacatggagaggttattggacctctggaggacactgaacataagtggagagaaagccctagatattgactatgacaagtatgcacaaggagaagcaaaacttgcttggctgaattcattgattgacttatccgtggacgaggctaatcatttcgatgctaagttatggatgcatatgtttctggataaattacacgaacattttcttcgtgaaaagatggcaattgcacatctaaaggtttacgttggttccgacaatggctttattaaagcgagtattgttgaaacaggagacacgccgacttatttagtcaaggagcctgtaaatggacaagaattccgcgtggtaatcaatattcgtatagagaccgagcctgagctcctgagtcttgtagtcgcggacgcactcgcaattgtaaataaggagatgaaagttaagtggaaacaaacatatcacgaatgcttcagtccattaccacctaatccgactcacaggttacgcgtagcggcaaaatga

SEQ ID NO: 545 - protein, 133 aa, Alicyclobacillus acidocaldarius
MIRGEEILLRKIVVEVLPKYSSENCCSVDGEETTIDCCNPLVEANELKDKIKNVLGDLVVIHVFDYTLSVDWSLAVNRLRQLFKERGFRGLSEMDNILEVVTPVVIVNGNLVSFVCPFDFEKIVSRIMTMSYE

SEQ ID NO: 546 - DNA, 402 bp, Alicyclobacillus acidocaldarius
atgatccgtggggaggagatcttgttgagaaaaatcgtagtagaggtacttcctaagtactcatcggaaaactgctgctcggtagacggcgaggagacgacaatcgactgttgcaatccacttgttgaagcaaatgagctgaaagataagatcaagaatgtgttaggtgatttggtagtaatacatgtatttgactatactcttagcgtcgactggagtctggccgtaaatagactacgacaattgtttaaagaaaggggattcagagggctttctgaaatggataatattttggaagttgtgactccagtagtgattgtcaatggaaatctcgtgtcgtttgtctgtccatttgactttgagaaaattgtcagccgcatcatgactatgtcatatgaatga

SEQ ID NO: 547 - protein, 116 aa, Bacillus cereus
LIEIFPSVVTNQTDCCDSDNNSEEGCCEESNQFFEESLELKEQLKEHFDKLVNVHLYNYELSMDRVLAQKKLSQLIQERGFGNISEDSVLRYVTPAVVVNGTLVSFATKPQMESVL

SEQ ID NO: 548 - protein, 54 aa, Theileria annulata
ELCDPVLEANGLKVAAKSTFGDMIIVELYKAAYVLGLWDVAAYNCLKTCKRRGY

SEQ ID NO: 549 - protein, 54 aa, Theileria parva; identical to SEQ ID NO: 548

SEQ ID NO: 550 - protein, 114 aa, Trypanosoma brucei
LAEALERYSDSEQLCSCTLRVFSVFPSSPYVDMNAIASLFKNTESEAVAIEAIHFLCSVAMSVKTLKQLIHTTGCVQRVLEVMRKYAGNASIQEYACSLLSYLSFDSETITSFI

SEQ ID NO: 551 - protein, 48 aa, Cryptosporidium hominis
NTNLEENELSDKTINLIQNLVIIHFSDLIINQLPLNSVNHTESLCKER

SEQ ID NO: 552 - protein, 133 aa, Artificial
  Alicyclobacillus acidocaldarius mutated SEQ ID NO 545
MIRGEEILLKKIVVEVLPKYSSENCCSVDGEETTIDCCNPLVEANELKDKIKNVLGDLVVIHVFDYTLSVDWSLAVNRLRQLFKERGFRGLSEMDNILEVVTPVVIVNGNLVSFVCPFDFEKIVSRIMTMSYE

SEQ ID NO: 553 - protein, 133 aa, Artificial
  Alicyclobacillus acidocaldarius mutated SEQ ID NO 545
MIRGEEILLRKIVVEVLPKYSSENCCSVDGEETTIDCCNPLVEANELKDKIKNVLGDLVVIHVFDYTLSVDWSLAVNRLRQLFKERGFRGLSEMENILEVVTPVVIVNGNLVSFVCPFDFEKIVSRIMTMSYE

SEQ ID NO: 554 - protein, 133 aa, Artificial
  Alicyclobacillus acidocaldarius mutated SEQ ID NO 545
MIRGEEILLRKIVVEVLPKYSSENCCSVDGEETTIDCCNPLVEANELKDKIKNVLGDLVVIHVFDYTLSIDWSLAVNRLRQLFKERGFRGLSEMDNILEVVTPVVIVNGNLVSFVCPFDFEKIVSRIMTMSYE

SEQ ID NO: 555 - protein, 133 aa, Artificial
  Alicyclobacillus acidocaldarius mutated SEQ ID NO 545
MIRGEEILLRKIVVEVLPKYSSENCCSVDGEETTIDCCNPLVEANDLKDKIKNVLGDLVVIHVFDYTLSVDWSLAVNRLRQLFKERGFRGLSEMDNILEVVTPVVIVNGNLVSFVCPFDFEKIVSRIMTMSYE

SEQ ID NO: 556 - protein, 133 aa, Artificial
  Alicyclobacillus acidocaldarius mutated SEQ ID NO 545
MIRGEEILLRKIVVEVLPKYSSENCCSVDGDETTIDCCNPLVEANELKDKIKNVLGDLVVIHVFDYTLSVDWSLAVNRLRQLFKERGFRGLSEMDNILEVVTPVVIVNGNLVSFVCPFDFEKIVSRIMTMSYE

SEQ ID NO: 557 - DNA, 402 bp, Artificial
  Alicyclobacillus acidocaldarius mutated SEQ ID NO 546
atgatccgtggggaggagatcttgttgaaaaaaatcgtagtagaggtacttcctaagtactcatcggaaaactgctgctcggtagacggcgaggagacgacaatcgactgttgcaatccacttgttgaagcaaatgagctgaaagataagatcaagaatgtgttaggtgatttggtagtaatacatgtatttgactatactcttagcgtcgactggagtctggccgtaaatagactacgacaattgtttaaagaaaggggattcagagggctttctgaaatggataatattttggaagttgtgactccagtagtgattgtcaatggaaatctcgtgtcgtttgtctgtccatttgactttgagaaaattgtcagccgcatcatgactatgtcatatgaatga

SEQ ID NO: 558 - DNA, 402 bp, Artificial
  Alicyclobacillus acidocaldarius mutated SEQ ID NO 546
atgatccgtggggaggagatcttgttgagaaaaatcgtagtagaggtacttcctaagtactcatcggaaaactgctgctcggtagacggcgaggagacgacaatcgactgttgcaatccacttgttgaagcaaatgagctgaaagataagatcaagaatgtgttaggtgatttggtagtaatacatgtatttgactatactcttagcgtcgactggagtctggccgtaaatagactacgacaattgtttaaagaaaggggattcagagggctttctgaaatggaaaatattttggaagttgtgactccagtagtgattgtcaatggaaatctcgtgtcgtttgtctgtccatttgactttgagaaaattgtcagccgcatcatgactatgtcatatgaatga

SEQ ID NO: 559 - DNA, 402 bp, Artificial
  Alicyclobacillus acidocaldarius mutated SEQ ID NO 546
atgatccgtggggaggagatcttgttgagaaaaatcgtagtagaggtacttcctaagtactcatcggaaaactgctgctcggtagacggcgaggagacgacaatcgactgttgcaatccacttgttgaagcaaatgagctgaaagataagatcaagaatgtgttaggtgatttggtagtaatacatgtatttgactatactcttagcattgactggagtctggccgtaaatagactacgacaattgtttaaagaaaggggattcagagggctttctgaaatggataatattttggaagttgtgactccagtagtgattgtcaatggaaatctcgtgtcgtttgtctgtccatttgactttgagaaaattgtcagccgcatcatgactatgtcatatgaatga

SEQ ID NO: 560 - DNA, 402 bp, Artificial
  Alicyclobacillus acidocaldarius mutated SEQ ID NO 546
atgatccgtggggaggagatcttgttgagaaaaatcgtagtagaggtacttcctaagtactcatcggaaaactgctgctcggtagacggcgaggagacgacaatcgactgttgcaatccacttgttgaagcaaatgatctgaaagataagatcaagaatgtgttaggtgatttggtagtaatacatgtatttgactatactcttagcgtcgactggagtctggccgtaaatagactacgacaattgtttaaagaaaggggattcagagggctttctgaaatggataatattttggaagttgtgactccagtagtgattgtcaatggaaatctcgtgtcgtttgtctgtccatttgactttgagaaaattgtcagccgcatcatgactatgtcatatgaatga

SEQ ID NO: 561 - DNA, 402 bp, Artificial
  Alicyclobacillus acidocaldarius mutated SEQ ID NO 546
atgatccgtggggaggagatcttgttgagaaaaatcgtagtagaggtacttcctaagtactcatcggaaaactgctgctcggtagacggcgatgagacgacaatcgactgttgcaatccacttgttgaagcaaatgagctgaaagataagatcaagaatgtgttaggtgatttggtagtaatacatgtatttgactatactcttagcgtcgactggagtctggccgtaaatagactacgacaattgtttaaagaaaggggattcagagggctttctgaaatggataatattttggaagttgtgactccagtagtgattgtcaatggaaatctcgtgtcgtttgtctgtccatttgactttgagaaaattgtcagccgcatcatgactatgtcatatgaatga

SEQ ID NO: 562 - protein, 168 aa, Alicyclobacillus acidocaldarius
MMVTVRVATHRDLPSILAIYNQGIEDRVATLEQDLKDMDYITNWFNEHTNRYPVFVAEYQNNIIGWADLHPYSHRCAYGGVAELSVYVHRGWRAKGVGQALLSALEAFARKHDFHKLVLATFPFNSAGLALYRKMGFREVGVFMNHGRLDGKWVDVLWMEKLLELKVE

SEQ ID NO: 563 - DNA, 507 bp, Alicyclobacillus acidocaldarius
gtgatggtcactgtccgagtggcgacgcacagagatcttccgtccatcttagccatctacaatcagggtatcgaggaccgggtggccaccctagaacaggatttgaaggatatggactacattacgaactggtttaatgaacacacaaaccgctatccagtttttgtggcggaataccaaaacaacatcattggctgggcagacttgcatccgtactcccatcgttgcgcctatgggggggtggcggaactttcggtttatgttcatcgaggatggcgcgccaaaggtgtcgggcaagccctccttagtgcgttggaggctttcgcgcggaagcacgactttcacaagttggttcttgccacgtttccttttaactctgcgggattggcgttataccgcaagatgggctttcgtgaggtgggcgtattcatgaaccatggcaggttagacggaaaatgggttgacgtattgtggatggaaaagctactggagctcaaagttgagtga

SEQ ID NO: 564 - protein, 161 aa, Bacillus licheniformis ATCC 14580
INIRKAISADLPFILTIYNQGIEDRIATLEQDLKEMSDIEIWFQEHQGRYSVLVAESKGEIVGWASLNPYSHRCAYQGVADLSVYVDRACRGKGIGGLLLQALEKTAKENSFYKIVLFTFPFNELGQNLYNKMGYRQVGIFKNQGILDGRFIDVMAMEKLL

SEQ ID NO: 565 - protein, 161 aa, Bacillus  SG-1
IIIRKAEIRDIDRILTIYNQGIEDRVATLETEPKDRTYMAEWLKAHQGRYTGIVAELEGEVIGWASLNPYSPRKAYAGVADISVYIERNSRGKGIGRKLLSSLEVKARENGFHKLVLFTFPFNKLGQQLYQKCGYREVGTFKNQGILDGIYVDVMAMEKLL

SEQ ID NO: 566 - protein, 162 aa, Bacillus  MB24
IRKATEQDAQEIMTIYNEGIEDRIATLETEIKTDKYVMEWLFQREKRYSVIVMEENSHIVGWASINPYSHRCAYRGVGELSIYIKREYRGKGLGQKLLLALEKTGQKNEFYKFVLFTFSFNNLGQGLYRKMGYREVGVFEKQGIMDGEHVDVMIMEKLLSVE

SEQ ID NO: 567 - protein, 164 aa, Alkaliphilus metalliredigens
MAYTVRIAELQDLKSITEIYNEGIEDRIATLETKIKSEAEMIPWLQQRSEKHKVITIENERDEVLGWASLNPFNSRCCYDGVADFSIYIKRQMRGMGLGKLLLKALIEVAREQDIHKLVLSTFKSNEAGQRLYESFGFREVGTYKNQGILDGKFVDVTIMEKLL

SEQ ID NO: 568 - protein, 164 aa, Exiguobacterium sibiricum
IRPVKEDDLKDILAIYNEGIEDRIATLETDTKELSFMEDWYRERTPRYAGFVAYEGTTILGFISLDPYNPRPVYQSVGELSVYITRTHRGQGIGRQLLHVIEEHAITQGFHKLILFTFPFNKIGQKLYIRSGFRIVGTFKEQGMLNGYYVDVLAMEKLLPKTID

SEQ ID NO: 569 - protein, 168 aa, Artificial
  Alicyclobacillus acidocaldarius mutated SEQ ID NO 562
MMVTVRVATHRDLPSILAIYNQGIEDRVATLEQDLKDMDYITNWFNEHTNRYPVFVAEYQNNIIGWADLHPYSHRCAYGGVAELSVYVHRGWRAKGVGQALLSALEAFARKHDFHKLVLATFPFNSAGLALYRKMGFREVGVFMNHGRLDGKWVDVIWMEKLLELKVE

SEQ ID NO: 570 - protein, 168 aa, Artificial
  Alicyclobacillus acidocaldarius mutated SEQ ID NO 562
MMVTVRVATHRDLPSILAIYNQGIEDRVATLEQDLKDMDYITNWFNEHTNRYPVFVAEYQNNIIGWADLHPYSHRCAYGGVAELSVYVHRGWRAKGVGQALLSALEAFARKHDFHKLVLATFPFNSAGLALYRKMGFREVGVFMNHGRLDGKWVDVLWMEKLLDLKVE

SEQ ID NO: 571 - protein, 168 aa, Artificial
  Alicyclobacillus acidocaldarius mutated SEQ ID NO 562
MMVTVRVATHRDLPSILAIYNQGIEDRVATLEQDLKDMDYITNWFNEHTNRYPIFVAEYQNNIIGWADLHPYSHRCAYGGVAELSVYVHRGWRAKGVGQALLSALEAFARKHDFHKLVLATFPFNSAGLALYRKMGFREVGVFMNHGRLDGKWVDVLWMEKLLELKVE

SEQ ID NO: 572 - protein, 168 aa, Artificial
  Alicyclobacillus acidocaldarius mutated SEQ ID NO 562
MMVTVRVATHRDLPSILAIYNQGIEDRVATLEQDLKDMDYITNWFNEHTNRYPVFVAEYQNNIIGWADLHPYSHRCAYGGVAELSVYVHRGWRAKGVGQALLSALEAFARKHEFHKLVLATFPFNSAGLALYRKMGFREVGVFMNHGRLDGKWVDVLWMEKLLELKVE

SEQ ID NO: 573 - protein, 168 aa, Artificial
  Alicyclobacillus acidocaldarius mutated SEQ ID NO 562
MMVTVRVATHRDLPSILAIYNQGIEDRVATLEQDLKDMDYITNWFNEHTNRYPVFVAEYQNNIIGWADLHPYSHRCAYGGVAELSVYVHRGWRAKGVGQALLSALEAFARRHDFHKLVLATFPFNSAGLALYRKMGFREVGVFMNHGRLDGKWVDVLWMEKLLELKVE

SEQ ID NO: 574 - DNA, 507 bp, Artificial
  Alicyclobacillus acidocaldarius mutated SEQ ID NO 563
gtgatggtcactgtccgagtggcgacgcacagagatcttccgtccatcttagccatctacaatcagggtatcgaggaccgggtggccaccctagaacaggatttgaaggatatggactacattacgaactggtttaatgaacacacaaaccgctatccagtttttgtggcggaataccaaaacaacatcattggctgggcagacttgcatccgtactcccatcgttgcgcctatgggggggtggcggaactttcggtttatgttcatcgaggatggcgcgccaaaggtgtcgggcaagccctccttagtgcgttggaggctttcgcgcggaagcacgactttcacaagttggttcttgccacgtttccttttaactctgcgggattggcgttataccgcaagatgggctttcgtgaggtgggcgtattcatgaaccatggcaggttagacggaaaatgggttgacgtaatttggatggaaaagctactggagctcaaagttgagtga

SEQ ID NO: 575 - DNA, 507 bp, Artificial
  Alicyclobacillus acidocaldarius mutated SEQ ID NO 563
gtgatggtcactgtccgagtggcgacgcacagagatcttccgtccatcttagccatctacaatcagggtatcgaggaccgggtggccaccctagaacaggatttgaaggatatggactacattacgaactggtttaatgaacacacaaaccgctatccagtttttgtggcggaataccaaaacaacatcattggctgggcagacttgcatccgtactcccatcgttgcgcctatgggggggtggcggaactttcggtttatgttcatcgaggatggcgcgccaaaggtgtcgggcaagccctccttagtgcgttggaggctttcgcgcggaagcacgactttcacaagttggttcttgccacgtttccttttaactctgcgggattggcgttataccgcaagatgggctttcgtgaggtgggcgtattcatgaaccatggcaggttagacggaaaatgggttgacgtattgtggatggaaaagctactggatctcaaagttgagtga

SEQ ID NO: 576 - DNA, 507 bp, Artificial
  Alicyclobacillus acidocaldarius mutated SEQ ID NO 563
gtgatggtcactgtccgagtggcgacgcacagagatcttccgtccatcttagccatctacaatcagggtatcgaggaccgggtggccaccctagaacaggatttgaaggatatggactacattacgaactggtttaatgaacacacaaaccgctatccaatttttgtggcggaataccaaaacaacatcattggctgggcagacttgcatccgtactcccatcgttgcgcctatgggggggtggcggaactttcggtttatgttcatcgaggatggcgcgccaaaggtgtcgggcaagccctccttagtgcgttggaggctttcgcgcggaagcacgactttcacaagttggttcttgccacgtttccttttaactctgcgggattggcgttataccgcaagatgggctttcgtgaggtgggcgtattcatgaaccatggcaggttagacggaaaatgggttgacgtattgtggatggaaaagctactggagctcaaagttgagtga

SEQ ID NO: 577 - DNA, 507 bp, Artificial
  Alicyclobacillus acidocaldarius mutated SEQ ID NO 563
gtgatggtcactgtccgagtggcgacgcacagagatcttccgtccatcttagccatctacaatcagggtatcgaggaccgggtggccaccctagaacaggatttgaaggatatggactacattacgaactggtttaatgaacacacaaaccgctatccagtttttgtggcggaataccaaaacaacatcattggctgggcagacttgcatccgtactcccatcgttgcgcctatgggggggtggcggaactttcggtttatgttcatcgaggatggcgcgccaaaggtgtcgggcaagccctccttagtgcgttggaggctttcgcgcggaagcacgaatttcacaagttggttcttgccacgtttccttttaactctgcgggattggcgttataccgcaagatgggctttcgtgaggtgggcgtattcatgaaccatggcaggttagacggaaaatgggttgacgtattgtggatggaaaagctactggagctcaaagttgagtga

SEQ ID NO: 578 - DNA, 507 bp, Artificial
  Alicyclobacillus acidocaldarius mutated SEQ ID NO 563
gtgatggtcactgtccgagtggcgacgcacagagatcttccgtccatcttagccatctacaatcagggtatcgaggaccgggtggccaccctagaacaggatttgaaggatatggactacattacgaactggtttaatgaacacacaaaccgctatccagtttttgtggcggaataccaaaacaacatcattggctgggcagacttgcatccgtactcccatcgttgcgcctatgggggggtggcggaactttcggtttatgttcatcgaggatggcgcgccaaaggtgtcgggcaagccctccttagtgcgttggaggctttcgcgcggcgtcacgactttcacaagttggttcttgccacgtttccttttaactctgcgggattggcgttataccgcaagatgggctttcgtgaggtgggcgtattcatgaaccatggcaggttagacggaaaatgggttgacgtattgtggatggaaaagctactggagctcaaagttgagtga

SEQ ID NO: 579 - protein, 323 aa, Alicyclobacillus acidocaldarius
MQEIMDTNVSSTIHVGLTELSASANKYVLNSKARNTIRAYQSDWRSFCTWCDERHLSSLPAEPKTVALYLSDMADRGYRTSTIGRHMISIGLAHRTKGFPSPTSDETVRAVWRGIRNTLGVAPQGKSPILVEDLRRMLQHVPNDLMGLRDRALLLIGFAGAFRRSEIVALNVEDVEFVREGLVITLRRSKTDQEGEGRKVGIPYGSFIETCPVRALQAWLNATGIDSGPLFRRVTKGHDVRDARLSDKTVARIVKRYVRLIGLDQRHFAGHSLRAGLATSAALAGVSERDIMAQTGHRSPMMVRRYIRDSNLFRSNAAARIGL

SEQ ID NO: 580 - DNA, 972 bp, Alicyclobacillus acidocaldarius
atgcaggaaatcatggatactaacgtatcctccacgatacacgttggattgaccgagttatctgcaagcgccaacaagtatgttctgaactctaaagcacgaaatacgattcgggcctaccaatccgactggcgctcgttctgcacctggtgcgacgaacgccacctctcttccctgcccgccgagccgaagacggtagcgctctacctatccgacatggctgatcgaggctatcgaaccagtaccatcggtcggcatatgatttcgattggcctcgctcatcgaacgaaaggcttcccctcccccacctccgatgagacggtacgggccgtctggcggggcatccgcaatacgcttggcgtagcacctcaggggaaatcacctatattagtggaagacttgcgacgcatgttgcaacacgtgccaaacgacctcatgggcctgcgggaccgcgcacttctgctgatcgggttcgccggcgcattccgacgctcggaaatcgtggctctgaatgttgaggacgtcgagttcgtgcgtgaggggcttgtgatcacgttgcgcaggagcaagactgaccaggagggcgaaggtcggaaagtgggtatcccctacggctcgttcatcgagacctgcccagtgcgcgcgctccaagcgtggttgaacgcgacggggattgattccgggcccctctttcgccgagtgaccaaaggccacgatgtgcgcgacgcgcgactctctgataagaccgtggcacgtatcgtaaagcggtatgtgcgtctaataggccttgaccagcgtcactttgccggccacagcctgcgcgcaggtcttgcaacatcggcggcgctggcgggtgtgtcggaacgagacattatggcgcagacgggtcatagaagcccaatgatggtgcggaggtatatccgagacagcaacttgttcaggtcaaatgcggcggctaggattggattatga

SEQ ID NO: 581 - protein, 304 aa, Gemmata obscuriglobus
DIGSEADRYVEKSRAPNTRRAQRSDWKDFSSWCAKYARSPLPAAPDTVAYYLADRSQELKTSTLQRRLMSISDAHRTAGFDSPTKSAQVKLVWAGIRRDKGVAQNHKKPTLTKHIREMVEHLPQGLLGVRDRALLLLGFAGAMRRSELVGIDATDVALTDEGLVVTIRKSKTDQVQEGRTLGIPYGEHEGTCPVRAVLAWVDQAAILEGPLFRSVNKHGHVMGTRLSDRTVAEVVKRSLVAAGHTARGYAAHSLRAGLITQAAIAGASDRDIQDQSGHKSLLVMRRYIRDGSLFRQNVAAKVGL

SEQ ID NO: 582 - protein, 312 aa, Candidatus Pelagibacter
ITDIKALQEETLLNLQSSKANNTVRAYKSDFNDFGLFCAKNGFKSLPSEPKIVSLYLTHLSTKDVRMSTLKRRLVSIGVIHKLKGHYLDTKHPSIVENIMGIKRRKGSIQRGKKPLLINNLKKIINVIDQQKKEEIKKLRDRSIILIGFSGGFRRNEIVSLDYEDLDFVQEGLKINLRRSKTDQFGEGFVKGLPYFQNPQYCPVISIHKWIEISKIKSGALFRRFIKGSKISDNRLTDQTVALIVKEYLKLAGIDCKNYSGHSLRSGFATSAAESGAEERSIMAMTGHKSTEMVRRYIKEANLFKNNALKNI

SEQ ID NO: 583 - protein, 312 aa, Candidatus Pelagibacter
ITDINALKKETLLNLQSSKSINTARAYKSDFTDFSLFCVKNGFKSLPSEPKIVSLYLTYLSTKEVKMSTLKRRLVSIGVIHKLKGHYLDTKHPAIIENIMGIKRRKGSIQKGKKPLLINNLKQIIDVIDQQKKEEIKKIRDRSIILIGFSGGFRRNEIVSLDFDDLDFVSEGLKINIKRSKTDQFGEGFTKALPYFDSSQYCPVVSLRNWLEISRIKSGSVFRRFIKGSKLSENRLTDQTVALLIKEYLSMLGIDTKNYSGHSLRSGFATSAAESGVEERNIMAMTGHKSTEMVRRYIKDANLFRNNALNKI

SEQ ID NO: 584 - protein, 305 aa, Candidatus Protochlamydia
DLVKTAKEYATFARSFNTNKSYRSDWDDFVFWCQEKNLRPLPALPQTIVVYLISRADNAWINQKGKLQKPLKISSLSRRLTSISQAHKLAKQPFDKNCPEIQEVWKGIKNKLGSAQIRKDPILLDDLRKMIESINNDNSKANSLSGMRDKALLLLGFVGAFRRSELVSLTIDDIKFVREGLQITLRKSKTDQEGKERIIAIPYGSNILTCPVRTLNDWLDCSKISEGLLFRPINRHGQIMDKALTSKSVALIIKRNKHLENQKNSFSGHSLRAGFATTAAIFGVPEHLIMKQTGHKSFDTIRRYI

SEQ ID NO: 585 - protein, 309 aa, Frankia alni
ELAARVGDYARASRSASTWRAYDSDLRQFRAWCARRPAAPSALPATAATVAGYLATLADAGYKPSTIRRRLAAISVAHQLAQHPNPAAAPEVGAVWDGIRRTRGVRPTRKTALDTDLLTRVVAGLRDDDLADIRDRALLLVGFAGCLRRSELVGLDVADLVETADGLILTVRRSKTDQEGEGALVGIAYGSYRPTCPVRAWRAWAQAADLRQGPAFRAVSRHGHVGATRLYPGSVARVVQRRVAAAGLDPADFAGHSLRSGFATAAARAGVADRSIMRQGRWRSSASLDGYVRAGRLFDRDNPSGRVGL

SEQ ID NO: 586 - protein, 323 aa, Artificial
  Alicyclobacillus acidocaldarius mutated SEQ ID NO 579
MQEIMDTNVSSTIHVGLTELSASANKYVLNSKARNTIRAYQSDWRSFCTWCDERHLSSLPAEPKTVALYLSDMADRGYRTSTIGRHMISIGLAHRTKGFPSPTSDETVRAVWRGIRNTLGVAPQGKSPILVEDLRRMLQHVPNDLMGLRDRALLLIGFAGAFRRSEIVALNVEDVEFVREGLVITLRRSKTDQEGEGRKVGIPYGSFIETCPVRALQAWLNATGIDSGPLFRRVTKGHDVRDARLSDKTVARIVKRYVRLIGLDQRHFAGHSLRAGLATSAALAGVSERDIMAQTGHRSPMMVRRYIKDSNLFRSNAAARIGL

SEQ ID NO: 587 - protein, 323 aa, Artificial
  Alicyclobacillus acidocaldarius mutated SEQ ID NO 579
MQEIMDTNVSSTIHIGLTELSASANKYVLNSKARNTIRAYQSDWRSFCTWCDERHLSSLPAEPKTVALYLSDMADRGYRTSTIGRHMISIGLAHRTKGFPSPTSDETVRAVWRGIRNTLGVAPQGKSPILVEDLRRMLQHVPNDLMGLRDRALLLIGFAGAFRRSEIVALNVEDVEFVREGLVITLRRSKTDQEGEGRKVGIPYGSFIETCPVRALQAWLNATGIDSGPLFRRVTKGHDVRDARLSDKTVARIVKRYVRLIGLDQRHFAGHSLRAGLATSAALAGVSERDIMAQTGHRSPMMVRRYIRDSNLFRSNAAARIGL

SEQ ID NO: 588 - protein, 323 aa, Artificial
  Alicyclobacillus acidocaldarius mutated SEQ ID NO 579
MQEIMDTNVSSTIHVGLTELSASANKYVLNSKARNTIRAYQSDWRSFCTWCDERHLSSLPAEPKTVALYLSDMADRGYRTSTIGRHMISIGLAHRTKGFPSPTSDETVRAVWRGIRNTLGVAPQGKSPILVEDLRRMLQHVPNDLMGLRDRALLLIGFAGAFRRSEIVALNVEDVEFVREGLVITLRRSKTDQEGEGRKVGIPYGSFIETCPVRALQAWLNATGIDSGPLFRRVTKGHDVRDARLSDRTVARIVKRYVRLIGLDQRHFAGHSLRAGLATSAALAGVSERDIMAQTGHRSPMMVRRYIRDSNLFRSNAAARIGL

SEQ ID NO: 589 - protein, 323 aa, Artificial
  Alicyclobacillus acidocaldarius mutated SEQ ID NO 579
MQEIMDTNVSSTIHVGLTELSASANKYVLNSKARNTIRAYQSDWRSFCTWCDERHLSSLPAEPKTVALYLSDMADRGYRTSTIGRHMISIGLAHRTKGFPSPTSDETVRAVWRGIRNTLGVAPQGKSPILVEELRRMLQHVPNDLMGLRDRALLLIGFAGAFRRSEIVALNVEDVEFVREGLVITLRRSKTDQEGEGRKVGIPYGSFIETCPVRALQAWLNATGIDSGPLFRRVTKGHDVRDARLSDKTVARIVKRYVRLIGLDQRHFAGHSLRAGLATSAALAGVSERDIMAQTGHRSPMMVRRYIRDSNLFRSNAAARIGL

SEQ ID NO: 590 - protein, 323 aa, Artificial
  Alicyclobacillus acidocaldarius mutated SEQ ID NO 579
MQEIMDTNVSSTLHVGLTELSASANKYVLNSKARNTIRAYQSDWRSFCTWCDERHLSSLPAEPKTVALYLSDMADRGYRTSTIGRHMISIGLAHRTKGFPSPTSDETVRAVWRGIRNTLGVAPQGKSPILVEDLRRMLQHVPNDLMGLRDRALLLIGFAGAFRRSEIVALNVEDVEFVREGLVITLRRSKTDQEGEGRKVGIPYGSFIETCPVRALQAWLNATGIDSGPLFRRVTKGHDVRDARLSDKTVARIVKRYVRLIGLDQRHFAGHSLRAGLATSAALAGVSERDIMAQTGHRSPMMVRRYIRDSNLFRSNAAARIGL

SEQ ID NO: 591 - DNA, 972 bp, Artificial
  Alicyclobacillus acidocaldarius mutated SEQ ID NO 580
atgcaggaaatcatggatactaacgtatcctccacgatacacgttggattgaccgagttatctgcaagcgccaacaagtatgttctgaactctaaagcacgaaatacgattcgggcctaccaatccgactggcgctcgttctgcacctggtgcgacgaacgccacctctcttccctgcccgccgagccgaagacggtagcgctctacctatccgacatggctgatcgaggctatcgaaccagtaccatcggtcggcatatgatttcgattggcctcgctcatcgaacgaaaggcttcccctcccccacctccgatgagacggtacgggccgtctggcggggcatccgcaatacgcttggcgtagcacctcaggggaaatcacctatattagtggaagacttgcgacgcatgttgcaacacgtgccaaacgacctcatgggcctgcgggaccgcgcacttctgctgatcgggttcgccggcgcattccgacgctcggaaatcgtggctctgaatgttgaggacgtcgagttcgtgcgtgaggggcttgtgatcacgttgcgcaggagcaagactgaccaggagggcgaaggtcggaaagtgggtatcccctacggctcgttcatcgagacctgcccagtgcgcgcgctccaagcgtggttgaacgcgacggggattgattccgggcccctctttcgccgagtgaccaaaggccacgatgtgcgcgacgcgcgactctctgataagaccgtggcacgtatcgtaaagcggtatgtgcgtctaataggccttgaccagcgtcactttgccggccacagcctgcgcgcaggtcttgcaacatcggcggcgctggcgggtgtgtcggaacgagacattatggcgcagacgggtcatagaagcccaatgatggtgcggaggtatatcaaagacagcaacttgttcaggtcaaatgcggcggctaggattggattatga

SEQ ID NO: 592 - DNA, 972 bp, Artificial
  Alicyclobacillus acidocaldarius mutated SEQ ID NO 580
atgcaggaaatcatggatactaacgtatcctccacgatacacattggattgaccgagttatctgcaagcgccaacaagtatgttctgaactctaaagcacgaaatacgattcgggcctaccaatccgactggcgctcgttctgcacctggtgcgacgaacgccacctctcttccctgcccgccgagccgaagacggtagcgctctacctatccgacatggctgatcgaggctatcgaaccagtaccatcggtcggcatatgatttcgattggcctcgctcatcgaacgaaaggcttcccctcccccacctccgatgagacggtacgggccgtctggcggggcatccgcaatacgcttggcgtagcacctcaggggaaatcacctatattagtggaagacttgcgacgcatgttgcaacacgtgccaaacgacctcatgggcctgcgggaccgcgcacttctgctgatcgggttcgccggcgcattccgacgctcggaaatcgtggctctgaatgttgaggacgtcgagttcgtgcgtgaggggcttgtgatcacgttgcgcaggagcaagactgaccaggagggcgaaggtcggaaagtgggtatcccctacggctcgttcatcgagacctgcccagtgcgcgcgctccaagcgtggttgaacgcgacggggattgattccgggcccctctttcgccgagtgaccaaaggccacgatgtgcgcgacgcgcgactctctgataagaccgtggcacgtatcgtaaagcggtatgtgcgtctaataggccttgaccagcgtcactttgccggccacagcctgcgcgcaggtcttgcaacatcggcggcgctggcgggtgtgtcggaacgagacattatggcgcagacgggtcatagaagcccaatgatggtgcggaggtatatccgagacagcaacttgttcaggtcaaatgcggcggctaggattggattatga

SEQ ID NO: 593 - DNA, 972 bp, Artificial
  Alicyclobacillus acidocaldarius mutated SEQ ID NO 580
atgcaggaaatcatggatactaacgtatcctccacgatacacgttggattgaccgagttatctgcaagcgccaacaagtatgttctgaactctaaagcacgaaatacgattcgggcctaccaatccgactggcgctcgttctgcacctggtgcgacgaacgccacctctcttccctgcccgccgagccgaagacggtagcgctctacctatccgacatggctgatcgaggctatcgaaccagtaccatcggtcggcatatgatttcgattggcctcgctcatcgaacgaaaggcttcccctcccccacctccgatgagacggtacgggccgtctggcggggcatccgcaatacgcttggcgtagcacctcaggggaaatcacctatattagtggaagacttgcgacgcatgttgcaacacgtgccaaacgacctcatgggcctgcgggaccgcgcacttctgctgatcgggttcgccggcgcattccgacgctcggaaatcgtggctctgaatgttgaggacgtcgagttcgtgcgtgaggggcttgtgatcacgttgcgcaggagcaagactgaccaggagggcgaaggtcggaaagtgggtatcccctacggctcgttcatcgagacctgcccagtgcgcgcgctccaagcgtggttgaacgcgacggggattgattccgggcccctctttcgccgagtgaccaaaggccacgatgtgcgcgacgcgcgactctctgatcgtaccgtggcacgtatcgtaaagcggtatgtgcgtctaataggccttgaccagcgtcactttgccggccacagcctgcgcgcaggtcttgcaacatcggcggcgctggcgggtgtgtcggaacgagacattatggcgcagacgggtcatagaagcccaatgatggtgcggaggtatatccgagacagcaacttgttcaggtcaaatgcggcggctaggattggattatga

SEQ ID NO: 594 - DNA, 972 bp, Artificial
  Alicyclobacillus acidocaldarius mutated SEQ ID NO 580
atgcaggaaatcatggatactaacgtatcctccacgatacacgttggattgaccgagttatctgcaagcgccaacaagtatgttctgaactctaaagcacgaaatacgattcgggcctaccaatccgactggcgctcgttctgcacctggtgcgacgaacgccacctctcttccctgcccgccgagccgaagacggtagcgctctacctatccgacatggctgatcgaggctatcgaaccagtaccatcggtcggcatatgatttcgattggcctcgctcatcgaacgaaaggcttcccctcccccacctccgatgagacggtacgggccgtctggcggggcatccgcaatacgcttggcgtagcacctcaggggaaatcacctatattagtggaagaattgcgacgcatgttgcaacacgtgccaaacgacctcatgggcctgcgggaccgcgcacttctgctgatcgggttcgccggcgcattccgacgctcggaaatcgtggctctgaatgttgaggacgtcgagttcgtgcgtgaggggcttgtgatcacgttgcgcaggagcaagactgaccaggagggcgaaggtcggaaagtgggtatcccctacggctcgttcatcgagacctgcccagtgcgcgcgctccaagcgtggttgaacgcgacggggattgattccgggcccctctttcgccgagtgaccaaaggccacgatgtgcgcgacgcgcgactctctgataagaccgtggcacgtatcgtaaagcggtatgtgcgtctaataggccttgaccagcgtcactttgccggccacagcctgcgcgcaggtcttgcaacatcggcggcgctggcgggtgtgtcggaacgagacattatggcgcagacgggtcatagaagcccaatgatggtgcggaggtatatccgagacagcaacttgttcaggtcaaatgcggcggctaggattggattatga

SEQ ID NO: 595 - DNA, 972 bp, Artificial
  Alicyclobacillus acidocaldarius mutated SEQ ID NO 580
atgcaggaaatcatggatactaacgtatcctccacgttacacgttggattgaccgagttatctgcaagcgccaacaagtatgttctgaactctaaagcacgaaatacgattcgggcctaccaatccgactggcgctcgttctgcacctggtgcgacgaacgccacctctcttccctgcccgccgagccgaagacggtagcgctctacctatccgacatggctgatcgaggctatcgaaccagtaccatcggtcggcatatgatttcgattggcctcgctcatcgaacgaaaggcttcccctcccccacctccgatgagacggtacgggccgtctggcggggcatccgcaatacgcttggcgtagcacctcaggggaaatcacctatattagtggaagacttgcgacgcatgttgcaacacgtgccaaacgacctcatgggcctgcgggaccgcgcacttctgctgatcgggttcgccggcgcattccgacgctcggaaatcgtggctctgaatgttgaggacgtcgagttcgtgcgtgaggggcttgtgatcacgttgcgcaggagcaagactgaccaggagggcgaaggtcggaaagtgggtatcccctacggctcgttcatcgagacctgcccagtgcgcgcgctccaagcgtggttgaacgcgacggggattgattccgggcccctctttcgccgagtgaccaaaggccacgatgtgcgcgacgcgcgactctctgataagaccgtggcacgtatcgtaaagcggtatgtgcgtctaataggccttgaccagcgtcactttgccggccacagcctgcgcgcaggtcttgcaacatcggcggcgctggcgggtgtgtcggaacgagacattatggcgcagacgggtcatagaagcccaatgatggtgcggaggtatatccgagacagcaacttgttcaggtcaaatgcggcggctaggattggattatga

SEQ ID NO: 596 - protein, 135 aa, Alicyclobacillus acidocaldarius
MKSVLLDTNVILRFLLDDHPHHSPAATNLFMKAEQGEIKLVIDPMIVAECCYVLEGKVYQFSKELIASHLIPVLTHEGVQCEALMTVLDGLDIYVEHRLDFADAYLIALARNHRFEVATFDNKMARIENVVFQDL

SEQ ID NO: 597 - DNA, 408 bp, Alicyclobacillus acidocaldarius
gtgaaatccgttttgttagacactaacgtaattctgcgttttctacttgacgaccatccccaccattcgccagcagctacgaacctgttcatgaaagctgaacagggtgaaatcaagttggtcattgatccgatgattgtggcggaatgctgttacgtcctggagggaaaagtctatcagttttcaaaggagctcattgcctctcacctgatccccgtcctgactcacgaaggggtccaatgtgaagccctcatgacggtattagacggtctagacatttacgtcgaacatcgattggattttgccgacgcctacctcattgcgctggctcggaatcaccgttttgaagtcgcgacattcgacaacaagatggctcgaatcgaaaacgtggtttttcaagacctctga

SEQ ID NO: 598 - protein, 119 aa, Bacillus thuringiensis
VVDTNVIVRFLTNDDEEQSKKAFEIFKRAVNQEITLFLTPIVIIECTWVLGMKRYGYSHEEIADNLTTIITSPGVKTLESDVVLKALHEYKTNRIDFADAYLAAVSTKNGVPCLTWNSK

SEQ ID NO: 599 - protein, 122 aa, Sulfurovum  NBC37-1
ILIDTNVVVRFLTRDNEKYFLKSVAIFQDIEDGKMEAMLMDFIVAEIVSVLHRIYKHSKKEIATTLKKLLLYDHLYTENKLITFEALEIYAEKNIDFADAVLYAKQRLEGFEIISFDKDIEK

SEQ ID NO: 600 - protein, 129 aa, Opitutaceae bacterium
MKTWLLDANGILRFLRNDDAVQSPQSKKLLERANAGEVRLLISVLTVAEVFYALRASYKMTRPAAAQVLMRFVLTGVAEVEREDVLLDALQRVVSANVDLGDAVLAVEAVRHGEGVASFDKDFSRFTDV

SEQ ID NO: 601 - protein, 119 aa, Hydroge1ivirga  128-5-R1-1
LIDANVILRYLLRDNKELYAKAEEVFNDMMEGKTKILILESVIAEVVYVLQRIYNVSRKEISEILRKLIELRGVKVHNKGQMLNALEIFSEKKLDFVDCILCAHREENEVITFDKGLRR

SEQ ID NO: 602 - protein, 121 aa, Nitratiruptor  SB155-2
LVDTNVLVRLFTQDNEEMFREAFSFFEKVANFEIQAVISEGVLLESWFVLQKVYEMKKDEIIKRLLTIVTLRNVILEDKLAFIEALHILKERNIDFIDAMLCVKSNIKGYKVFSFDNDIQR

SEQ ID NO: 603 - protein, 135 aa, Artificial
  Alicyclobacillus acidocaldarius mutated SEQ ID NO 596
MKSVLLDTNVILRFLIDDHPHHSPAATNLFMKAEQGEIKLVIDPMIVAECCYVLEGKVYQFSKELIASHLIPVLTHEGVQCEALMTVLDGLDIYVEHRLDFADAYLIALARNHRFEVATFDNKMARIENVVFQDL

SEQ ID NO: 604 - protein, 135 aa, Artificial
  Alicyclobacillus acidocaldarius mutated SEQ ID NO 596
MKSVLLDTNVILRFLLDDHPHHSPAATNLFMKAEQGEIKLVIDPMIVAECCYVLEGKVYQFSKELIASHLIPVLTHDGVQCEALMTVLDGLDIYVEHRLDFADAYLIALARNHRFEVATFDNKMARIENVVFQDL

SEQ ID NO: 605 - protein, 135 aa, Artificial
  Alicyclobacillus acidocaldarius mutated SEQ ID NO 596
MKSVLLDTNVILRFLLDDHPHHSPAATNLFMKAEQGEIRLVIDPMIVAECCYVLEGKVYQFSKELIASHLIPVLTHEGVQCEALMTVLDGLDIYVEHRLDFADAYLIALARNHRFEVATFDNKMARIENVVFQDL

SEQ ID NO: 606 - protein, 135 aa, Artificial
  Alicyclobacillus acidocaldarius mutated SEQ ID NO 596
MKSVLLDTNVILRFLLDDHPHHSPAATNLFMKAEQGEIKLVIDPMIVAECCYVLEGKVYQFSKELIASHLIPVLTHEGVQCEALMTVLDGLDIYVEHRLDFADAYLIALARNHRFEIATFDNKMARIENVVFQDL

SEQ ID NO: 607 - protein, 135 aa, Artificial
  Alicyclobacillus acidocaldarius mutated SEQ ID NO 596
MKSVLLDTNVILRFLLDDHPHHSPAATNLFMKAEQGEIKLVIDPMIVAECCYVLEGKVYQFSKELIASHLIPVLTHEGVQCDALMTVLDGLDIYVEHRLDFADAYLIALARNHRFEVATFDNKMARIENVVFQDL

SEQ ID NO: 608 - DNA, 408 bp, Artificial
  Alicyclobacillus acidocaldarius mutated SEQ ID NO 597
gtgaaatccgttttgttagacactaacgtaattctgcgttttctaattgacgaccatccccaccattcgccagcagctacgaacctgttcatgaaagctgaacagggtgaaatcaagttggtcattgatccgatgattgtggcggaatgctgttacgtcctggagggaaaagtctatcagttttcaaaggagctcattgcctctcacctgatccccgtcctgactcacgaaggggtccaatgtgaagccctcatgacggtattagacggtctagacatttacgtcgaacatcgattggattttgccgacgcctacctcattgcgctggctcggaatcaccgttttgaagtcgcgacattcgacaacaagatggctcgaatcgaaaacgtggtttttcaagacctctga

SEQ ID NO: 609 - DNA, 408 bp, Artificial
  Alicyclobacillus acidocaldarius mutated SEQ ID NO 597
gtgaaatccgttttgttagacactaacgtaattctgcgttttctacttgacgaccatccccaccattcgccagcagctacgaacctgttcatgaaagctgaacagggtgaaatcaagttggtcattgatccgatgattgtggcggaatgctgttacgtcctggagggaaaagtctatcagttttcaaaggagctcattgcctctcacctgatccccgtcctgactcacgatggggtccaatgtgaagccctcatgacggtattagacggtctagacatttacgtcgaacatcgattggattttgccgacgcctacctcattgcgctggctcggaatcaccgttttgaagtcgcgacattcgacaacaagatggctcgaatcgaaaacgtggtttttcaagacctctga

SEQ ID NO: 610 - DNA, 408 bp, Artificial
  Alicyclobacillus acidocaldarius mutated SEQ ID NO 597
gtgaaatccgttttgttagacactaacgtaattctgcgttttctacttgacgaccatccccaccattcgccagcagctacgaacctgttcatgaaagctgaacagggtgaaatccgtttggtcattgatccgatgattgtggcggaatgctgttacgtcctggagggaaaagtctatcagttttcaaaggagctcattgcctctcacctgatccccgtcctgactcacgaaggggtccaatgtgaagccctcatgacggtattagacggtctagacatttacgtcgaacatcgattggattttgccgacgcctacctcattgcgctggctcggaatcaccgttttgaagtcgcgacattcgacaacaagatggctcgaatcgaaaacgtggtttttcaagacctctga

SEQ ID NO: 611 - DNA, 408 bp, Artificial
  Alicyclobacillus acidocaldarius mutated SEQ ID NO 597
gtgaaatccgttttgttagacactaacgtaattctgcgttttctacttgacgaccatccccaccattcgccagcagctacgaacctgttcatgaaagctgaacagggtgaaatcaagttggtcattgatccgatgattgtggcggaatgctgttacgtcctggagggaaaagtctatcagttttcaaaggagctcattgcctctcacctgatccccgtcctgactcacgaaggggtccaatgtgaagccctcatgacggtattagacggtctagacatttacgtcgaacatcgattggattttgccgacgcctacctcattgcgctggctcggaatcaccgttttgaaattgcgacattcgacaacaagatggctcgaatcgaaaacgtggtttttcaagacctctga

SEQ ID NO: 612 - DNA, 408 bp, Artificial
  Alicyclobacillus acidocaldarius mutated SEQ ID NO 597
gtgaaatccgttttgttagacactaacgtaattctgcgttttctacttgacgaccatccccaccattcgccagcagctacgaacctgttcatgaaagctgaacagggtgaaatcaagttggtcattgatccgatgattgtggcggaatgctgttacgtcctggagggaaaagtctatcagttttcaaaggagctcattgcctctcacctgatccccgtcctgactcacgaaggggtccaatgtgatgccctcatgacggtattagacggtctagacatttacgtcgaacatcgattggattttgccgacgcctacctcattgcgctggctcggaatcaccgttttgaagtcgcgacattcgacaacaagatggctcgaatcgaaaacgtggtttttcaagacctctga

SEQ ID NO: 613 - protein, 249 aa, Alicyclobacillus acidocaldarius
MHTSRGVGYMNPDEPVFEILALVWEAKRRLPKVSDYRRIARKRQTESPDHVIQRYGTWSRVLEDFFQAYFTLHGYPTIPDYLFGALFSRAKVVRDKRGRWYLRFVSDDTTQIEILRSFMRRSAATLVNRGKPSLYLRCYDVDLICAYEHACKTEPVFRPTVDFVRGYIDTHSHFRKDPSGRDRLTLTGPLVPECHDFLVALGARNTRVSRVKDSYRMNVHAGSLRRIREALYPPGCVCNPEIRARIFTV

SEQ ID NO: 614 - DNA, 750 bp, Alicyclobacillus acidocaldarius
gtgcacacgtcgcgaggagttggctatatgaatcctgatgaacctgtattcgaaatcttagctcttgtatgggaagcaaagagacgacttcctaaagtgtcggattatcgacggatagctcgaaaacgacaaacggagtcgccggaccatgtgattcagcgctacggaacttggtcgcgggtgctggaggacttcttccaagcgtatttcacgctgcacggttatccgaccatcccggattatctcttcggcgcgctcttctcgcgcgcgaaggtcgtgcgcgacaaacgcgggcgatggtatctgcgctttgtgtcggatgataccacacaaatcgagatcttgcgctcgttcatgcgtcggtctgccgccacgcttgtcaaccgcggcaaaccgagtttgtacttgcgctgctacgacgtagatctcatctgcgcatatgagcatgcctgcaaaacggaacctgtgtttcgaccgacggtcgattttgtacgcgggtacatcgacacgcatagccattttcgcaaggatccatcaggacgggaccggttgacgctcacagggccgctggtgccggaatgtcacgactttctcgttgcgcttggggcgcggaatacacgggtgagtcgagtgaaggattcgtaccgaatgaacgttcatgcgggcagcttgcgacgcattcgtgaagccctgtatccgccgggttgtgtgtgcaatccggagatacgcgcgaggattttcacagtataa

SEQ ID NO: 615 - protein, 131 aa, Brassica rapa
KNMIPKISDFGMARIFARDETEANTKKVVGTYGYMSPEYTMHGIFSEKTDVFSFGVIVLEIVSGKKNKGLYNLSFENNLLSYVWSQWKEGRALEIVDPVIVDSLSSLPSTFQPQEVLKCIQIGLLCVQEHA

SEQ ID NO: 616 - protein, 165 aa, Raphanus sativus
ARGLVYLHQDSRFRIIHRDMKAGNILLDKNMIPKISDFGLARIIARDQTEASTDNPIGTYGYMSPEYAMYGILSEKTDVFSFGVIVLEIVTGKRNRGFYQSTPEDNLVCYAWTHWAQGRALEIVDPVIVDSLSSTFQPKEVLKCIQIGLLCIQERAVHRPTMSSV

SEQ ID NO: 617 - protein, 131 aa, Brassica oleracea
KNMIPKISDFGMARIFARDETEANTKKVVGTYGYMSPEYAMHGIFSEKSDVFSFGVIVLEIVSGKKNRGLYNLSFENNLLSYVWSQWKEGRALEIVDPVIIDSLSSLPSTFQPQEVLKCIQIGLLCVQEHA

SEQ ID NO: 618 - protein, 67 aa, Oryza sativa
TVIMRCTQVALLCAQEDPADRPTMTDVTAMLDSESIMLSDPKEPTELTHGGAPVLTGHRHILVTQAR

SEQ ID NO: 619 - protein, 67 aa, Oryza sativa; identical to SEQ ID NO: 618

SEQ ID NO: 620 - protein, 249 aa, Artificial
  Alicyclobacillus acidocaldarius mutated SEQ ID NO 613
MHTSRGVGYMNPDEPVFEILALVWEAKRRLPKVSDYRRIARKRQTESPDHVIQRYGTWSRVLEDFFQAYFTLHGYPTIPDYLFGALFSRAKVVRDKRGRWYLRFVSDDTTQIEILRSFMRRSAATLVNRGKPSLYLRCYDVELICAYEHACKTEPVFRPTVDFVRGYIDTHSHFRKDPSGRDRLTLTGPLVPECHDFLVALGARNTRVSRVKDSYRMNVHAGSLRRIREALYPPGCVCNPEIRARIFTV

SEQ ID NO: 621 - protein, 249 aa, Artificial
  Alicyclobacillus acidocaldarius mutated SEQ ID NO 613
MHTSRGVGYMNPDEPVFEILALVWEAKRRLPKVSDYRRIARKRQTESPDHVIQRYGTWSRVLEDFFQAYFTLHGYPTIPDYLFGALFSRAKVVRDKRGRWYLRFVSDDTTQIEILRSFMRRSAATLVNRGKPSLYLRCYDVDLICAYEHACKTEPVFRPTVDFVKGYIDTHSHFRKDPSGRDRLTLTGPLVPECHDFLVALGARNTRVSRVKDSYRMNVHAGSLRRIREALYPPGCVCNPEIRARIFTV

SEQ ID NO: 622 - protein, 249 aa, Artificial
  Alicyclobacillus acidocaldarius mutated SEQ ID NO 613
MHTSRGVGYMNPDEPVFEILALVWEAKRRLPKVSDYRRIARKRQTESPDHVIQRYGTWSRVLEDFFQAYFTLHGYPTIPDYLFGALFSRAKVIRDKRGRWYLRFVSDDTTQIEILRSFMRRSAATLVNRGKPSLYLRCYDVDLICAYEHACKTEPVFRPTVDFVRGYIDTHSHFRKDPSGRDRLTLTGPLVPECHDFLVALGARNTRVSRVKDSYRMNVHAGSLRRIREALYPPGCVCNPEIRARIFTV

SEQ ID NO: 623 - protein, 249 aa, Artificial
  Alicyclobacillus acidocaldarius mutated SEQ ID NO 613
MHTSRGVGYMNPDEPVFEILALVWEAKRRIPKVSDYRRIARKRQTESPDHVIQRYGTWSRVLEDFFQAYFTLHGYPTIPDYLFGALFSRAKVVRDKRGRWYLRFVSDDTTQIEILRSFMRRSAATLVNRGKPSLYLRCYDVDLICAYEHACKTEPVFRPTVDFVRGYIDTHSHFRKDPSGRDRLTLTGPLVPECHDFLVALGARNTRVSRVKDSYRMNVHAGSLRRIREALYPPGCVCNPEIRARIFTV

SEQ ID NO: 624 - protein, 249 aa, Artificial
  Alicyclobacillus acidocaldarius mutated SEQ ID NO 613
MHTSRGVGYMNPDEPVFEILALVWEAKRRLPKVSDYRRIARKRQTESPDHVIQRYGTWSRVLEEFFQAYFTLHGYPTIPDYLFGALFSRAKVVRDKRGRWYLRFVSDDTTQIEILRSFMRRSAATLVNRGKPSLYLRCYDVDLICAYEHACKTEPVFRPTVDFVRGYIDTHSHFRKDPSGRDRLTLTGPLVPECHDFLVALGARNTRVSRVKDSYRMNVHAGSLRRIREALYPPGCVCNPEIRARIFTV

SEQ ID NO: 625 - DNA, 750 bp, Artificial
  Alicyclobacillus acidocaldarius mutated SEQ ID NO 614
gtgcacacgtcgcgaggagttggctatatgaatcctgatgaacctgtattcgaaatcttagctcttgtatgggaagcaaagagacgacttcctaaagtgtcggattatcgacggatagctcgaaaacgacaaacggagtcgccggaccatgtgattcagcgctacggaacttggtcgcgggtgctggaggacttcttccaagcgtatttcacgctgcacggttatccgaccatcccggattatctcttcggcgcgctcttctcgcgcgcgaaggtcgtgcgcgacaaacgcgggcgatggtatctgcgctttgtgtcggatgataccacacaaatcgagatcttgcgctcgttcatgcgtcggtctgccgccacgcttgtcaaccgcggcaaaccgagtttgtacttgcgctgctacgacgtagaactcatctgcgcatatgagcatgcctgcaaaacggaacctgtgtttcgaccgacggtcgattttgtacgcgggtacatcgacacgcatagccattttcgcaaggatccatcaggacgggaccggttgacgctcacagggccgctggtgccggaatgtcacgactttctcgttgcgcttggggcgcggaatacacgggtgagtcgagtgaaggattcgtaccgaatgaacgttcatgcgggcagcttgcgacgcattcgtgaagccctgtatccgccgggttgtgtgtgcaatccggagatacgcgcgaggattttcacagtataa

SEQ ID NO: 626 - DNA, 750 bp, Artificial
  Alicyclobacillus acidocaldarius mutated SEQ ID NO 614
gtgcacacgtcgcgaggagttggctatatgaatcctgatgaacctgtattcgaaatcttagctcttgtatgggaagcaaagagacgacttcctaaagtgtcggattatcgacggatagctcgaaaacgacaaacggagtcgccggaccatgtgattcagcgctacggaacttggtcgcgggtgctggaggacttcttccaagcgtatttcacgctgcacggttatccgaccatcccggattatctcttcggcgcgctcttctcgcgcgcgaaggtcgtgcgcgacaaacgcgggcgatggtatctgcgctttgtgtcggatgataccacacaaatcgagatcttgcgctcgttcatgcgtcggtctgccgccacgcttgtcaaccgcggcaaaccgagtttgtacttgcgctgctacgacgtagatctcatctgcgcatatgagcatgcctgcaaaacggaacctgtgtttcgaccgacggtcgattttgtaaaagggtacatcgacacgcatagccattttcgcaaggatccatcaggacgggaccggttgacgctcacagggccgctggtgccggaatgtcacgactttctcgttgcgcttggggcgcggaatacacgggtgagtcgagtgaaggattcgtaccgaatgaacgttcatgcgggcagcttgcgacgcattcgtgaagccctgtatccgccgggttgtgtgtgcaatccggagatacgcgcgaggattttcacagtataa

SEQ ID NO: 627 - DNA, 750 bp, Artificial
  Alicyclobacillus acidocaldarius mutated SEQ ID NO 614
gtgcacacgtcgcgaggagttggctatatgaatcctgatgaacctgtattcgaaatcttagctcttgtatgggaagcaaagagacgacttcctaaagtgtcggattatcgacggatagctcgaaaacgacaaacggagtcgccggaccatgtgattcagcgctacggaacttggtcgcgggtgctggaggacttcttccaagcgtatttcacgctgcacggttatccgaccatcccggattatctcttcggcgcgctcttctcgcgcgcgaaggtcattcgcgacaaacgcgggcgatggtatctgcgctttgtgtcggatgataccacacaaatcgagatcttgcgctcgttcatgcgtcggtctgccgccacgcttgtcaaccgcggcaaaccgagtttgtacttgcgctgctacgacgtagatctcatctgcgcatatgagcatgcctgcaaaacggaacctgtgtttcgaccgacggtcgattttgtacgcgggtacatcgacacgcatagccattttcgcaaggatccatcaggacgggaccggttgacgctcacagggccgctggtgccggaatgtcacgactttctcgttgcgcttggggcgcggaatacacgggtgagtcgagtgaaggattcgtaccgaatgaacgttcatgcgggcagcttgcgacgcattcgtgaagccctgtatccgccgggttgtgtgtgcaatccggagatacgcgcgaggattttcacagtataa

SEQ ID NO: 628 - DNA, 750 bp, Artificial
  Alicyclobacillus acidocaldarius mutated SEQ ID NO 614
gtgcacacgtcgcgaggagttggctatatgaatcctgatgaacctgtattcgaaatcttagctcttgtatgggaagcaaagagacgaattcctaaagtgtcggattatcgacggatagctcgaaaacgacaaacggagtcgccggaccatgtgattcagcgctacggaacttggtcgcgggtgctggaggacttcttccaagcgtatttcacgctgcacggttatccgaccatcccggattatctcttcggcgcgctcttctcgcgcgcgaaggtcgtgcgcgacaaacgcgggcgatggtatctgcgctttgtgtcggatgataccacacaaatcgagatcttgcgctcgttcatgcgtcggtctgccgccacgcttgtcaaccgcggcaaaccgagtttgtacttgcgctgctacgacgtagatctcatctgcgcatatgagcatgcctgcaaaacggaacctgtgtttcgaccgacggtcgattttgtacgcgggtacatcgacacgcatagccattttcgcaaggatccatcaggacgggaccggttgacgctcacagggccgctggtgccggaatgtcacgactttctcgttgcgcttggggcgcggaatacacgggtgagtcgagtgaaggattcgtaccgaatgaacgttcatgcgggcagcttgcgacgcattcgtgaagccctgtatccgccgggttgtgtgtgcaatccggagatacgcgcgaggattttcacagtataa

SEQ ID NO: 629 - DNA, 750 bp, Artificial
  Alicyclobacillus acidocaldarius mutated SEQ ID NO 614
gtgcacacgtcgcgaggagttggctatatgaatcctgatgaacctgtattcgaaatcttagctcttgtatgggaagcaaagagacgacttcctaaagtgtcggattatcgacggatagctcgaaaacgacaaacggagtcgccggaccatgtgattcagcgctacggaacttggtcgcgggtgctggaggaattcttccaagcgtatttcacgctgcacggttatccgaccatcccggattatctcttcggcgcgctcttctcgcgcgcgaaggtcgtgcgcgacaaacgcgggcgatggtatctgcgctttgtgtcggatgataccacacaaatcgagatcttgcgctcgttcatgcgtcggtctgccgccacgcttgtcaaccgcggcaaaccgagtttgtacttgcgctgctacgacgtagatctcatctgcgcatatgagcatgcctgcaaaacggaacctgtgtttcgaccgacggtcgattttgtacgcgggtacatcgacacgcatagccattttcgcaaggatccatcaggacgggaccggttgacgctcacagggccgctggtgccggaatgtcacgactttctcgttgcgcttggggcgcggaatacacgggtgagtcgagtgaaggattcgtaccgaatgaacgttcatgcgggcagcttgcgacgcattcgtgaagccctgtatccgccgggttgtgtgtgcaatccggagatacgcgcgaggattttcacagtataa

SEQ ID NO: 630 - protein, 269 aa, Alicyclobacillus acidocaldarius
MPVQDTLMKALTRSLSGGALDVLGVHGVDLVEPFATELPANTLRMDRVWRTVDGNLFHLEFQTKRESTLHRFLEYDARLANEHRTRIRTVVLYHASVASAPDELDIGTALYRVENVFLRHLDGDQALNEVEHHLRAGQWEPGDRMRLGLALNMRLENQAHAFERVRELIPQVPDETERDLVVSAILVLGDQGLTEEQRALLRKELRNVSKLAEELYEEGREEGRMVGRMEERMEIALNMLRKGMSVEDISDTTGLTKQEIEELARKQSH

SEQ ID NO: 631 - DNA, 810 bp, Alicyclobacillus acidocaldarius
atgccggttcaggatacgttaatgaaggccctcacccgctccttatccggcggcgctctcgatgtattgggcgtgcacggtgtggacctggtggagccttttgcaaccgaacttcccgccaacacgctgcgcatggatcgtgtgtggcggacggtcgacggaaacctgtttcacttggagtttcagacgaagcgcgagtcgacgttgcatcgctttttggaatacgacgcacgcttggcgaacgaacaccggacgaggattcgcacggttgtcttgtaccacgcgagtgtcgcgagcgcgccagatgagctcgacatcgggacagcactctaccgcgtcgagaatgtatttctgcgacacctcgacggtgaccaagcgctgaatgaagtcgagcatcacctgcgtgctggacagtgggagcctggcgaccggatgcgattaggcctagccctcaacatgcgcttggagaatcaggcgcatgcgttcgagcgagtgcgtgaactcattcctcaagtgccggatgagaccgaacgggatttggtcgtgagtgcgattctcgtgcttggcgatcagggtctcaccgaggaacaacgggcactacttcgaaaggagctgagaaacgtgtcgaagctggcggaagagctgtacgaggaaggtcgcgaggaaggtcgcatggtggggcgtatggaagaacgcatggaaatcgctctgaacatgcttcgtaaaggcatgtctgttgaagacatctcggataccacggggctaactaagcaagagatcgaagaacttgcgcggaaacaatcgcattaa

SEQ ID NO: 632 - protein, 266 aa, Desulfitobacterium hafniense
DILMKVLAEQFKNKTLDVFGIKTAKIKDLIPSVHPAVEANETRNDIIFLLEDDTLLHLEFQTTAGEQDLKRFLYYDARLVRRQERKVHTIVIYSGRIEQARERLECGSILYQVENIYMKHYNGDQEYNRLKHKIDNHQLLSETDTLKLIFLPLMKSEQKEEELAIQAAELAKAAPDEKTKLFAIAALIVITDKIMSESNKRKLLEVLKMTQIEQWIREEGRQEGELKGRRDEKRETAQTMLNLGMSPELIAKATKLPLEEILEMAK

SEQ ID NO: 633 - protein, 199 aa, Desulfitobacterium hafniense
YDARLASRQERQIRTFVVYSGHIEQAKERLDCGSILYQVENIYMKDYNGDQEYNRLKAKIESGQLLNETDTLKLIFLPLMKSRQQEEDLAIQAAELAKATDEKTKVFAIAALIVITDKIISESNKRKLLEVLKMTQIEQWIREEGREEGRQEGELKGRQEEKRETARTMLSMGMSPEVIAKATKLSQEEILRIEKEMKN

SEQ ID NO: 634 - protein, 199 aa, Desulfitobacterium hafniense
YDARLASRQERQIRTFVVYSGHIEQAKERLDCGSILYQVENIYMKDYNGDQEYNRLKAKIESGQLLNETDTLKLIFLPLMKSRQQEEDLAIQAAELAKATDEKTKVFAIAALIVITDKIMSESNKRKLLEVLKMTQIEQWIREEGREEGRQEGELKGRQEEKRETARTMLSMGMSPEVIAKATKLSQEEILRIEKEMKN

SEQ ID NO: 635 - protein, 270 aa, Clostridium botulinum
KDVLFKTLSEMFKDKALIMYGLDYPKIVEMLPNEFPEVKADERRADSIFLLEDGSILLLEYESNNRITENMYKYIDYVLRISRKYYEENKSIKKINVAVIYASNIERAEDHFNIGSVGIDVKSVFMKNYDGDTIYKEVEQKIKNGINLKDIDLMNLILLPLMKSIKDKHELIKDTIELAKEVKDEKNQYFIIAGVLTSTDKFIDEKYANTVRSWLRMTKVEKIFEKEKEEAMNQAEKSKAIEIAKNLMDILSVEMIAKKTGLSIEEVEKL

SEQ ID NO: 636 - protein, 180 aa, Petrotoga mobilis
DFVFELEDNSLLHLEFQTTWKKADLLRFAQYDIALYQKERRRINTVVMYSGKYESAESELDMGSNKYKVQQIFMIKYDGIKRYEEIKEKIEKEEELTDKDLMDLVFLPLMRNEKSEEEVTKDVFELAIKIPDEDKKEAVIGSLLGFSDNYVRDEYINELKEVIRMTKIGTSLFEEGVEEG

SEQ ID NO: 637 - protein, 269 aa, Artificial
  Alicyclobacillus acidocaldarius mutated SEQ ID NO 630
MPVQDTLMKALTRSLSGGALDVLGVHGVDLVEPFATELPANTLRMDRVWRTVDGNLFHLEFQTKRESTLHRFLEYDARLANEHRTRIRTVVLYHASVASAPDELDIGTALYRVENVFLRHLDGDQALNEVEHHLRAGQWEPGDRMRLGLALNMRLENQAHAFERVRELIPQVPDETERDLVVSAILVLGDQGLTEEQRALLRKELRNVSKLAEELYEEGREEGRMVGRMDERMEIALNMLRKGMSVEDISDTTGLTKQEIEELARKQSH

SEQ ID NO: 638 - protein, 269 aa, Artificial
  Alicyclobacillus acidocaldarius mutated SEQ ID NO 630
MPVQDTLMKALTRSLSGGALDVLGVHGVDLVEPFATELPANTLRMDRVWRTVDGNLFHLEFQTKRESTLHRFLEYDARLANEHRTRIRTVVLYHASVASAPDELDIGTALYRVENVFLRHLDGDQALNEVEHHLRAGQWEPGDRMRLGLALNMRLENQAHAFERVRELIPQVPDETERDLVVSAILVLGDQGLTEEQRALLRKELRNVSKLAEELYEEGREEGRMVGRMEERMEIALNMLRKGMSVEDISDTTGLTKQEIEELARKNSH

SEQ ID NO: 639 - protein, 269 aa, Artificial
  Alicyclobacillus acidocaldarius mutated SEQ ID NO 630
MPVQDTLMKALTRSLSGGALDVLGVHGVDLVEPFATELPANTLRMDRVWRTVDGNLFHLEFQTKRESTLHRFLEYDARLANEHRTRIRTVVLYHASVASAPDELDIGTALYRVENVFLRHLDGDQALNEVEHHLRAGQWEPGDRMRLGLALNMRLENQAHAFERVRELIPQVPDETERDLVVSAILVLGDQGLTEEQRALLRKELRNVSKLAEELYEEGREEGRMVGRMEERMEIALNMLRKGMSVEDISDTTGLTKQEIEELAKKQSH

SEQ ID NO: 640 - protein, 269 aa, Artificial
  Alicyclobacillus acidocaldarius mutated SEQ ID NO 630
MPVQDTLMKALTRSLSGGALDVLGVHGVDLVEPFATELPANTLRMDRVWRTVDGNLFHLEFQTKRESTLHRFLEYEARLANEHRTRIRTVVLYHASVASAPDELDIGTALYRVENVFLRHLDGDQALNEVEHHLRAGQWEPGDRMRLGLALNMRLENQAHAFERVRELIPQVPDETERDLVVSAILVLGDQGLTEEQRALLRKELRNVSKLAEELYEEGREEGRMVGRMEERMEIALNMLRKGMSVEDISDTTGLTKQEIEELARKQSH

SEQ ID NO: 641 - protein, 269 aa, Artificial
  Alicyclobacillus acidocaldarius mutated SEQ ID NO 630
MPVQDTLMKALTRSLSGGALDVLGVHGVDLIEPFATELPANTLRMDRVWRTVDGNLFHLEFQTKRESTLHRFLEYDARLANEHRTRIRTVVLYHASVASAPDELDIGTALYRVENVFLRHLDGDQALNEVEHHLRAGQWEPGDRMRLGLALNMRLENQAHAFERVRELIPQVPDETERDLVVSAILVLGDQGLTEEQRALLRKELRNVSKLAEELYEEGREEGRMVGRMEERMEIALNMLRKGMSVEDISDTTGLTKQEIEELARKQSH

SEQ ID NO: 642 - DNA, 810 bp, Artificial
  Alicyclobacillus acidocaldarius mutated SEQ ID NO 631
atgccggttcaggatacgttaatgaaggccctcacccgctccttatccggcggcgctctcgatgtattgggcgtgcacggtgtggacctggtggagccttttgcaaccgaacttcccgccaacacgctgcgcatggatcgtgtgtggcggacggtcgacggaaacctgtttcacttggagtttcagacgaagcgcgagtcgacgttgcatcgctttttggaatacgacgcacgcttggcgaacgaacaccggacgaggattcgcacggttgtcttgtaccacgcgagtgtcgcgagcgcgccagatgagctcgacatcgggacagcactctaccgcgtcgagaatgtatttctgcgacacctcgacggtgaccaagcgctgaatgaagtcgagcatcacctgcgtgctggacagtgggagcctggcgaccggatgcgattaggcctagccctcaacatgcgcttggagaatcaggcgcatgcgttcgagcgagtgcgtgaactcattcctcaagtgccggatgagaccgaacgggatttggtcgtgagtgcgattctcgtgcttggcgatcagggtctcaccgaggaacaacgggcactacttcgaaaggagctgagaaacgtgtcgaagctggcggaagagctgtacgaggaaggtcgcgaggaaggtcgcatggtggggcgtatggatgaacgcatggaaatcgctctgaacatgcttcgtaaaggcatgtctgttgaagacatctcggataccacggggctaactaagcaagagatcgaagaacttgcgcggaaacaatcgcattaa

SEQ ID NO: 643 - DNA, 810 bp, Artificial
  Alicyclobacillus acidocaldarius mutated SEQ ID NO 631
atgccggttcaggatacgttaatgaaggccctcacccgctccttatccggcggcgctctcgatgtattgggcgtgcacggtgtggacctggtggagccttttgcaaccgaacttcccgccaacacgctgcgcatggatcgtgtgtggcggacggtcgacggaaacctgtttcacttggagtttcagacgaagcgcgagtcgacgttgcatcgctttttggaatacgacgcacgcttggcgaacgaacaccggacgaggattcgcacggttgtcttgtaccacgcgagtgtcgcgagcgcgccagatgagctcgacatcgggacagcactctaccgcgtcgagaatgtatttctgcgacacctcgacggtgaccaagcgctgaatgaagtcgagcatcacctgcgtgctggacagtgggagcctggcgaccggatgcgattaggcctagccctcaacatgcgcttggagaatcaggcgcatgcgttcgagcgagtgcgtgaactcattcctcaagtgccggatgagaccgaacgggatttggtcgtgagtgcgattctcgtgcttggcgatcagggtctcaccgaggaacaacgggcactacttcgaaaggagctgagaaacgtgtcgaagctggcggaagagctgtacgaggaaggtcgcgaggaaggtcgcatggtggggcgtatggaagaacgcatggaaatcgctctgaacatgcttcgtaaaggcatgtctgttgaagacatctcggataccacggggctaactaagcaagagatcgaagaacttgcgcggaaaaattcgcattaa

SEQ ID NO: 644 - DNA, 810 bp, Artificial
  Alicyclobacillus acidocaldarius mutated SEQ ID NO 631
atgccggttcaggatacgttaatgaaggccctcacccgctccttatccggcggcgctctcgatgtattgggcgtgcacggtgtggacctggtggagccttttgcaaccgaacttcccgccaacacgctgcgcatggatcgtgtgtggcggacggtcgacggaaacctgtttcacttggagtttcagacgaagcgcgagtcgacgttgcatcgctttttggaatacgacgcacgcttggcgaacgaacaccggacgaggattcgcacggttgtcttgtaccacgcgagtgtcgcgagcgcgccagatgagctcgacatcgggacagcactctaccgcgtcgagaatgtatttctgcgacacctcgacggtgaccaagcgctgaatgaagtcgagcatcacctgcgtgctggacagtgggagcctggcgaccggatgcgattaggcctagccctcaacatgcgcttggagaatcaggcgcatgcgttcgagcgagtgcgtgaactcattcctcaagtgccggatgagaccgaacgggatttggtcgtgagtgcgattctcgtgcttggcgatcagggtctcaccgaggaacaacgggcactacttcgaaaggagctgagaaacgtgtcgaagctggcggaagagctgtacgaggaaggtcgcgaggaaggtcgcatggtggggcgtatggaagaacgcatggaaatcgctctgaacatgcttcgtaaaggcatgtctgttgaagacatctcggataccacggggctaactaagcaagagatcgaagaacttgcgaaaaaacaatcgcattaa

SEQ ID NO: 645 - DNA, 810 bp, Artificial
  Alicyclobacillus acidocaldarius mutated SEQ ID NO 631
atgccggttcaggatacgttaatgaaggccctcacccgctccttatccggcggcgctctcgatgtattgggcgtgcacggtgtggacctggtggagccttttgcaaccgaacttcccgccaacacgctgcgcatggatcgtgtgtggcggacggtcgacggaaacctgtttcacttggagtttcagacgaagcgcgagtcgacgttgcatcgctttttggaatacgaagcacgcttggcgaacgaacaccggacgaggattcgcacggttgtcttgtaccacgcgagtgtcgcgagcgcgccagatgagctcgacatcgggacagcactctaccgcgtcgagaatgtatttctgcgacacctcgacggtgaccaagcgctgaatgaagtcgagcatcacctgcgtgctggacagtgggagcctggcgaccggatgcgattaggcctagccctcaacatgcgcttggagaatcaggcgcatgcgttcgagcgagtgcgtgaactcattcctcaagtgccggatgagaccgaacgggatttggtcgtgagtgcgattctcgtgcttggcgatcagggtctcaccgaggaacaacgggcactacttcgaaaggagctgagaaacgtgtcgaagctggcggaagagctgtacgaggaaggtcgcgaggaaggtcgcatggtggggcgtatggaagaacgcatggaaatcgctctgaacatgcttcgtaaaggcatgtctgttgaagacatctcggataccacggggctaactaagcaagagatcgaagaacttgcgcggaaacaatcgcattaa

SEQ ID NO: 646 - DNA, 810 bp, Artificial
  Alicyclobacillus acidocaldarius mutated SEQ ID NO 631
atgccggttcaggatacgttaatgaaggccctcacccgctccttatccggcggcgctctcgatgtattgggcgtgcacggtgtggacctgattgagccttttgcaaccgaacttcccgccaacacgctgcgcatggatcgtgtgtggcggacggtcgacggaaacctgtttcacttggagtttcagacgaagcgcgagtcgacgttgcatcgctttttggaatacgacgcacgcttggcgaacgaacaccggacgaggattcgcacggttgtcttgtaccacgcgagtgtcgcgagcgcgccagatgagctcgacatcgggacagcactctaccgcgtcgagaatgtatttctgcgacacctcgacggtgaccaagcgctgaatgaagtcgagcatcacctgcgtgctggacagtgggagcctggcgaccggatgcgattaggcctagccctcaacatgcgcttggagaatcaggcgcatgcgttcgagcgagtgcgtgaactcattcctcaagtgccggatgagaccgaacgggatttggtcgtgagtgcgattctcgtgcttggcgatcagggtctcaccgaggaacaacgggcactacttcgaaaggagctgagaaacgtgtcgaagctggcggaagagctgtacgaggaaggtcgcgaggaaggtcgcatggtggggcgtatggaagaacgcatggaaatcgctctgaacatgcttcgtaaaggcatgtctgttgaagacatctcggataccacggggctaactaagcaagagatcgaagaacttgcgcggaaacaatcgcattaa

SEQ ID NO: 647 - protein, 223 aa, Alicyclobacillus acidocaldarius
MSQFGQYLRKLRKERNLTINQLALYSGVSSALISRIENGQRGRPKPDTLKKLASALKVPYEDLLLHAGVLNEQISRTSESRDLKPVDPSWYKRQVPIPVLGSIRAGTPVEMLALNSSEFVLVDSDLLGNHEGFALEVVGDSMIGDYIFPGDLVIVKYTSNFSPQDICVVAINGEEATLKRVKCQGDICILTPSNPSMEPMVYNSVDVHVIGVVVEVRRRLRNK

SEQ ID NO: 648 - DNA, 672 bp, Alicyclobacillus acidocaldarius
gtgtctcaatttggtcagtatctccgaaaactccgtaaggaacgtaacttgacgataaatcaattagcgttgtactcaggcgtgagttcggcattaatctctcgaattgaaaacggccaaaggggtaggcctaagcctgatacactgaagaagctagcttctgccttgaaagttccttacgaggatttgttattacacgcaggtgtcctgaatgagcaaatcagtcgcacgtctgaatctcgtgatctaaagcctgttgacccgtcttggtataaacgtcaagtgcccatccctgttctcggttccatccgcgctggcacacccgtggagatgttggccctcaacagttcggaatttgtactagttgattcggacctccttggaaatcatgaggggtttgcgctcgaagtcgtcggcgacagcatgattggggactacatctttccaggggacttggtcatcgtcaagtatacgtccaacttctcaccacaagacatctgtgttgtagctatcaatggggaagaagccacgctcaaacgcgtcaagtgccaaggagacatttgtatcctgacaccaagcaatccctcaatggaaccgatggtctacaattctgtcgatgttcatgtcataggagtcgttgtcgaagtcagaagacgattacgtaacaaataa

SEQ ID NO: 649 - protein, 83 aa, Bacillus subtilis
MSPFGQQLRELRRARKLTVNQLAVYSGISSATISKIENGKRGTPKPATIKKLAAVLKVPYENLMAAAGHIRAFPEEIREASES

SEQ ID NO: 650 - protein, 83 aa, Bacillus amyloliquefaciens
MNTFGKQLRELRRARKLTVNQLAVYSGVSSATISRIENGHRGIPKPATIRKLADTLKIPYEELMARAGHIKAFQEEIRETSES

SEQ ID NO: 651 - protein, 82 aa, Bacillus subtilis
MSPFGQQLRELRRARKLTVNQLAVYSGISSATISKIENGKRGTPKPATIKKLAAVLKVPYENLMAAAGHIQAFPEEIREASE

SEQ ID NO: 652 - protein, 80 aa, Bacillus licheniformis
MTNFGHHLRQLRERKKLTVNQLAMYSGVSSAGISRIENGKRGVPKPATIRKLADALKVPYEELMASAGYISASTVQEARS

SEQ ID NO: 653 - protein, 72 aa, Bacillus subtilis
MESFGEQLRALREERKLTVNQLATYSGVSAAGISRIENGKRGVPKPATIKKLAEALKIPYEGLMYKAGYIEE

SEQ ID NO: 654 - protein, 223 aa, Artificial
  Alicyclobacillus acidocaldarius mutated SEQ ID NO 647
MSQFGQYLRKLRKERNLTINQLALYSGVSSAIISRIENGQRGRPKPDTLKKLASALKVPYEDLLLHAGVLNEQISRTSESRDLKPVDPSWYKRQVPIPVLGSIRAGTPVEMLALNSSEFVLVDSDLLGNHEGFALEVVGDSMIGDYIFPGDLVIVKYTSNFSPQDICVVAINGEEATLKRVKCQGDICILTPSNPSMEPMVYNSVDVHVIGVVVEVRRRLRNK

SEQ ID NO: 655 - protein, 223 aa, Artificial
  Alicyclobacillus acidocaldarius mutated SEQ ID NO 647
MSQFGQYLRKLRKERNLTINQLALYSGVSSALISRIENGQRGRPKPDTLKKLASALKVPYEDLLLHAGVLNEQISRTSESRDLKPVDPSWYKRQVPIPVLGSIRAGTPVEMLALNSSEFVLVDSDLLGNHEGFALEVVGDSMIGEYIFPGDLVIVKYTSNFSPQDICVVAINGEEATLKRVKCQGDICILTPSNPSMEPMVYNSVDVHVIGVVVEVRRRLRNK

SEQ ID NO: 656 - protein, 223 aa, Artificial
  Alicyclobacillus acidocaldarius mutated SEQ ID NO 647
MSQFGQYLRKLRKERNLTINQLALYSGVSSALISRIENGQRGRPKPDTLKKLASALKVPYEDLLLHAGVLNEQISKTSESRDLKPVDPSWYKRQVPIPVLGSIRAGTPVEMLALNSSEFVLVDSDLLGNHEGFALEVVGDSMIGDYIFPGDLVIVKYTSNFSPQDICVVAINGEEATLKRVKCQGDICILTPSNPSMEPMVYNSVDVHVIGVVVEVRRRLRNK

SEQ ID NO: 657 - protein, 223 aa, Artificial
  Alicyclobacillus acidocaldarius mutated SEQ ID NO 647
MSQFGQYLRKLRKERNLTINQLALYSGVSSALISRIENGQRGRPKPDTLKKLASALKVPYEDLLLHAGVLNEQISRTSESRDLKPVDPSWYKRQVPIPVLGSIRAGTPVEMLALNSSEFVLVDSDLLGNHEGFALEIVGDSMIGDYIFPGDLVIVKYTSNFSPQDICVVAINGEEATLKRVKCQGDICILTPSNPSMEPMVYNSVDVHVIGVVVEVRRRLRNK

SEQ ID NO: 658 - protein, 223 aa, Artificial
  Alicyclobacillus acidocaldarius mutated SEQ ID NO 647
MSQFGQYLRKLRKERNLTINQLALYSGVSSALISRIENGQRGRPKPDTLKKLASALKVPYEDLLLHAGVLNEQISRTSESRDLKPVDPSWYKRQVPIPVLGSIRAGTPVEMLALNSSEFVLVDSDLLGNHEGFALEVVGDSMIGDYIFPGDLVIVKYTSNFSPQDICVVAINGEEATLKRVKCQGDICILTPSNPSMEPMVYNSVDIHVIGVVVEVRRRLRNK

SEQ ID NO: 659 - DNA, 672 bp, Artificial
  Alicyclobacillus acidocaldarius mutated SEQ ID NO 648
gtgtctcaatttggtcagtatctccgaaaactccgtaaggaacgtaacttgacgataaatcaattagcgttgtactcaggcgtgagttcggcaattatctctcgaattgaaaacggccaaaggggtaggcctaagcctgatacactgaagaagctagcttctgccttgaaagttccttacgaggatttgttattacacgcaggtgtcctgaatgagcaaatcagtcgcacgtctgaatctcgtgatctaaagcctgttgacccgtcttggtataaacgtcaagtgcccatccctgttctcggttccatccgcgctggcacacccgtggagatgttggccctcaacagttcggaatttgtactagttgattcggacctccttggaaatcatgaggggtttgcgctcgaagtcgtcggcgacagcatgattggggactacatctttccaggggacttggtcatcgtcaagtatacgtccaacttctcaccacaagacatctgtgttgtagctatcaatggggaagaagccacgctcaaacgcgtcaagtgccaaggagacatttgtatcctgacaccaagcaatccctcaatggaaccgatggtctacaattctgtcgatgttcatgtcataggagtcgttgtcgaagtcagaagacgattacgtaacaaataa

SEQ ID NO: 660 - DNA, 672 bp, Artificial
  Alicyclobacillus acidocaldarius mutated SEQ ID NO 648
gtgtctcaatttggtcagtatctccgaaaactccgtaaggaacgtaacttgacgataaatcaattagcgttgtactcaggcgtgagttcggcattaatctctcgaattgaaaacggccaaaggggtaggcctaagcctgatacactgaagaagctagcttctgccttgaaagttccttacgaggatttgttattacacgcaggtgtcctgaatgagcaaatcagtcgcacgtctgaatctcgtgatctaaagcctgttgacccgtcttggtataaacgtcaagtgcccatccctgttctcggttccatccgcgctggcacacccgtggagatgttggccctcaacagttcggaatttgtactagttgattcggacctccttggaaatcatgaggggtttgcgctcgaagtcgtcggcgacagcatgattggggaatacatctttccaggggacttggtcatcgtcaagtatacgtccaacttctcaccacaagacatctgtgttgtagctatcaatggggaagaagccacgctcaaacgcgtcaagtgccaaggagacatttgtatcctgacaccaagcaatccctcaatggaaccgatggtctacaattctgtcgatgttcatgtcataggagtcgttgtcgaagtcagaagacgattacgtaacaaataa

SEQ ID NO: 661 - DNA, 672 bp, Artificial
  Alicyclobacillus acidocaldarius mutated SEQ ID NO 648
gtgtctcaatttggtcagtatctccgaaaactccgtaaggaacgtaacttgacgataaatcaattagcgttgtactcaggcgtgagttcggcattaatctctcgaattgaaaacggccaaaggggtaggcctaagcctgatacactgaagaagctagcttctgccttgaaagttccttacgaggatttgttattacacgcaggtgtcctgaatgagcaaatcagtaaaacgtctgaatctcgtgatctaaagcctgttgacccgtcttggtataaacgtcaagtgcccatccctgttctcggttccatccgcgctggcacacccgtggagatgttggccctcaacagttcggaatttgtactagttgattcggacctccttggaaatcatgaggggtttgcgctcgaagtcgtcggcgacagcatgattggggactacatctttccaggggacttggtcatcgtcaagtatacgtccaacttctcaccacaagacatctgtgttgtagctatcaatggggaagaagccacgctcaaacgcgtcaagtgccaaggagacatttgtatcctgacaccaagcaatccctcaatggaaccgatggtctacaattctgtcgatgttcatgtcataggagtcgttgtcgaagtcagaagacgattacgtaacaaataa

SEQ ID NO: 662 - DNA, 672 bp, Artificial
  Alicyclobacillus acidocaldarius mutated SEQ ID NO 648
gtgtctcaatttggtcagtatctccgaaaactccgtaaggaacgtaacttgacgataaatcaattagcgttgtactcaggcgtgagttcggcattaatctctcgaattgaaaacggccaaaggggtaggcctaagcctgatacactgaagaagctagcttctgccttgaaagttccttacgaggatttgttattacacgcaggtgtcctgaatgagcaaatcagtcgcacgtctgaatctcgtgatctaaagcctgttgacccgtcttggtataaacgtcaagtgcccatccctgttctcggttccatccgcgctggcacacccgtggagatgttggccctcaacagttcggaatttgtactagttgattcggacctccttggaaatcatgaggggtttgcgctcgaaattgtcggcgacagcatgattggggactacatctttccaggggacttggtcatcgtcaagtatacgtccaacttctcaccacaagacatctgtgttgtagctatcaatggggaagaagccacgctcaaacgcgtcaagtgccaaggagacatttgtatcctgacaccaagcaatccctcaatggaaccgatggtctacaattctgtcgatgttcatgtcataggagtcgttgtcgaagtcagaagacgattacgtaacaaataa

SEQ ID NO: 663 - DNA, 672 bp, Artificial
  Alicyclobacillus acidocaldarius mutated SEQ ID NO 648
gtgtctcaatttggtcagtatctccgaaaactccgtaaggaacgtaacttgacgataaatcaattagcgttgtactcaggcgtgagttcggcattaatctctcgaattgaaaacggccaaaggggtaggcctaagcctgatacactgaagaagctagcttctgccttgaaagttccttacgaggatttgttattacacgcaggtgtcctgaatgagcaaatcagtcgcacgtctgaatctcgtgatctaaagcctgttgacccgtcttggtataaacgtcaagtgcccatccctgttctcggttccatccgcgctggcacacccgtggagatgttggccctcaacagttcggaatttgtactagttgattcggacctccttggaaatcatgaggggtttgcgctcgaagtcgtcggcgacagcatgattggggactacatctttccaggggacttggtcatcgtcaagtatacgtccaacttctcaccacaagacatctgtgttgtagctatcaatggggaagaagccacgctcaaacgcgtcaagtgccaaggagacatttgtatcctgacaccaagcaatccctcaatggaaccgatggtctacaattctgtcgatattcatgtcataggagtcgttgtcgaagtcagaagacgattacgtaacaaataa

SEQ ID NO: 664 - protein, 508 aa, Alicyclobacillus acidocaldarius
MSHDFFAHFPTEPSAALIEYARDVAFLRSRYLFVWRDGKVQMAYCTHCRETYPLGSDKDTYRHNEQATCRQCGSTCVVKHRGRGRRHLIDTAYIVWYEKSMVDAQTVVATWYYAWRDYSGDFHDVETQFQPRARYVFVPGRGGSMMRLDWSGEWQPRRNVHPLPVGMMGWRTVDVWCSHESIQTAVAGTPLQYSGWETYCDQYNTLLTFFDLASRYPCVEYLTKLGFSRLVMAKLDGLRTFGAIHWRGRTMEQVLRMPRADVHAFRKLADVIEPLSLRSYQTWRRLGWKVSPEEAHLLRELLIPHHWREIQVRASLASEVEIAKYLLKQLRKGEYRSISYALIEWIDYLRFCSELGIPLNTTRNVFPSNLREMHDEMMRRVRIKRDERLNAQIQARLAELEPFGYTDEHFMIRPARSVQELFDEGQALHHCVGSYAAKYASGETNLFLMRRVSAPDTPYCTVEMRDSALIQARGERNRLLREDEQTFVDQFVRHVARMHKRAQRRKAS

SEQ ID NO: 665 - DNA, 1527 bp, Alicyclobacillus acidocaldarius
gtgagccacgacttcttcgcgcattttccgacggaacccagcgcagcgctgatcgagtacgcacgagacgtcgcgttcctcaggagtcgctacctgtttgtctggcgcgacggaaaggttcagatggcgtactgcacgcattgccgcgaaacctatccgctcggttcggacaaggacacctatcggcataacgaacaagcgacgtgtcgccaatgtggatcgacgtgcgtagtcaaacatcgcggccgcgggcgtagacacttgatcgataccgcctacatcgtgtggtacgagaagtcgatggtcgatgcccaaacggtggtcgcgacctggtactacgcctggcgggactactctggcgatttccacgacgtcgagacacaattccagccacgcgcccggtacgtgtttgtgccggggcgcggcggcagcatgatgcgcttggactggtccggcgagtggcaaccgcgccggaacgttcatccgctgcccgttggcatgatgggctggcgcaccgtcgacgtctggtgttcgcacgagagcatccaaaccgcagtggccggaacacctcttcagtacagcggctgggagacgtattgcgatcagtacaacacactcctcaccttcttcgacctggccagcagatacccgtgcgtcgagtatctgaccaaactcggcttttcgagattggtgatggcaaagttggacggtctccgcacgttcggggccattcactggcgcggcagaacgatggaacaggtccttcgcatgccacgcgcggatgtccacgccttccgcaagctggcggacgtcatcgagccgctgtcgctccgaagctaccagacgtggagacgcctggggtggaaggtgtcaccggaagaagcccatcttctgcgcgaactgctgatccctcatcactggagagagatccaggttcgagcatcactcgcgtccgaagtcgagatcgcaaagtaccttctcaagcaactccgcaaaggcgagtaccgttcgatcagctatgcgctcatcgagtggatcgactacctccgtttttgttcggaactcgggattccgctcaacacgacgaggaacgtgttcccgtcgaacctccgcgaaatgcacgatgagatgatgcgacgtgtgcgtatcaaacgggacgaacgccttaacgcgcaaattcaagcccgcttggccgagttggagccgttcggttacacggacgaacatttcatgattcggccggcgcgcagtgtgcaggagctcttcgacgaaggacaagctcttcaccactgcgtcggtagctatgcggcgaagtacgcttcaggagagaccaacctgttcttgatgcgacgagtctccgccccggatacgccgtactgtaccgtggaaatgagagacagtgcgctcatccaagcgcgtggcgaacgcaatcgcctgcttcgagaggacgaacagacctttgtcgatcaatttgtccgccacgtggcccgtatgcacaaacgggcacagcgtcgaaaagcaagctaa

SEQ ID NO: 666 - protein, 499 aa, Lysinibacillus sphaericus
AHFPAEVPEHVQFEADEKALLLSRYIFVSSGKNRTGYCTHCRNTFPIENPIKQNGKGECPACFSKCRYKKAWLGRKALIDTACILHCQKSVLNPSVVTVEWLYASRDYRESFENVSTEYAAVARYVFDYDRKVCQKIEGGSGCRWWTESGFSTPSFLQNRSFMSRNIMHGTFEDGISGTPFQYSGWQRYDYEDVLKYLPLVAKYPSVEILTKAGLDSFVKAKIYGYKTYSAVNWSKSKLHHIFKMSKQDLQMLREKNFVSSVYYVGDFLFNAWVVQQWRKEKSKMNIDELQKNMQIFSVKDDLKTFKFIRRFTSLHRLFNYANKQFEKDEKHFIRRHQVLITWSDYLNDCQKLKIHIDEAIIFPKNLRKAHEETIKRVKHYEDELMRKKAKERYEKIKHYEFELGQLKIVVPYTPKEIIDEGNKLSHCVGGYAERHADGQTTILFVRNIKEPDESFYTVEVKNEKVLQVRGIKNKPATEDVQTFIDEFKKQKLTKKARK

SEQ ID NO: 667 - protein, 519 aa, Clostridium butyricum
MYEEYLKHFDLHVSDDIKNFVEETLKDKEYLFVRNEYEPEPISNLKVKVQYGYCSHCRKEFKTGEYLKHNEVIICPNCGAEIMVKNIGRGKKCLMNDFCFYWFDKSVLDPEIVTCKGYYFSKKYDEDYKNPKYEYNLNSLYVFNTKDNTSKMFKRNWYTVESWEERSSIFDFNINWLGNKLCYCSFESLDEAVKDTIFQYSNYKRRCGYKSIVRYLDAFNKYQWIEQLEKMGFDRLVETLENRWTTDYSINYRGKDIFKKLKLNRGEVKQLTNEQKRELDSFVLRIYQLNRDNGFNPSFVEAYEVYEMCRYSDSSGLNNLIKIVGTNKVIKYCEKQYNSFNESNSYYNKASVISKWNDYLKNCEKLNWSIRDKSILLPKNLVKAHNHTTSLINAEKNKEADQKIKRRLPGLKKKYFFKDKDFFIRPAESSEDLINEGGTLNHCVAVHYMKPYANKETDILMIRRIDNPTVPLVTMEIKNGQVKQAYGKNDTIPKKDVEKFIEKFKTEILEKINSSKKNK

SEQ ID NO: 668 - protein, 160 aa, Streptococcus pyogenes
YIDYLSMLDELGIEIDTDNLIMPKDLVKAHDNVVKLVNQKKSEIEKRKFKNRLKSLSKYEQTIGDYCFRAPVDSGELIREGKTLSHCVGSARYTQAHASGKTTIIFIRRKSDSDKPFYTMEYKAGHIVQVRGKHNQSATEEVQKVVDQWLAIVNKNYKHA

SEQ ID NO: 669 - protein, 177 aa, Enterococcus faecalis
APMINEIEKYVHYSQIKQLPKEVNLTKFQKWFIRKGERFDYYMDYLHMLEELNTPLNNDSVLYPENLQVAHDNAMNTLNLLKSEIEEKQYQERKNQIKALEAEIDDLLFLTPHSLQEIIQEGSILRHCVGSQHYIERHTQGKTTIVFIRRKEKPDMPYFTLEYRNQQVIQIQGKCNR

SEQ ID NO: 670 - protein, 177 aa, Enterococcus faecalis; identical to SEQ ID NO: 669

SEQ ID NO: 671 - protein, 508 aa, Artificial
  Alicyclobacillus acidocaldarius mutated SEQ ID NO 664
MSHDFFAHFPTEPSAALIEYARDVAFLRSRYLFVWRDGKVQMAYCTHCRETYPLGSDKDTYRHNEQATCRQCGSTCVVKHRGRGRRHLIETAYIVWYEKSMVDAQTVVATWYYAWRDYSGDFHDVETQFQPRARYVFVPGRGGSMMRLDWSGEWQPRRNVHPLPVGMMGWRTVDVWCSHESIQTAVAGTPLQYSGWETYCDQYNTLLTFFDLASRYPCVEYLTKLGFSRLVMAKLDGLRTFGAIHWRGRTMEQVLRMPRADVHAFRKLADVIEPLSLRSYQTWRRLGWKVSPEEAHLLRELLIPHHWREIQVRASLASEVEIAKYLLKQLRKGEYRSISYALIEWIDYLRFCSELGIPLNTTRNVFPSNLREMHDEMMRRVRIKRDERLNAQIQARLAELEPFGYTDEHFMIRPARSVQELFDEGQALHHCVGSYAAKYASGETNLFLMRRVSAPDTPYCTVEMRDSALIQARGERNRLLREDEQTFVDQFVRHVARMHKRAQRRKAS

SEQ ID NO: 672 - protein, 508 aa, Artificial
  Alicyclobacillus acidocaldarius mutated SEQ ID NO 664
MSHDFFAHFPTEPSAALIEYARDVAFLRSRYLFVWRDGKVQMAYCTHCRETYPLGSDKDTYRHNEQATCRQCGSTCVVKHRGRGRRHLIDTAYIVWYEKSMVDAQTVVATWYYAWRDYSGDFHDVETQFQPRARYVFVPGRGGSMMRLDWSGEWQPRRNVHPLPVGMMGWRTVDVWCSHESIQTAVAGTPLQYSGWETYCDQYNTLLTFFDLASRYPCVEYLTKLGFSRLVMAKLDGLRTFGAIHWRGRTMEQVLRMPRADVHAFKKLADVIEPLSLRSYQTWRRLGWKVSPEEAHLLRELLIPHHWREIQVRASLASEVEIAKYLLKQLRKGEYRSISYALIEWIDYLRFCSELGIPLNTTRNVFPSNLREMHDEMMRRVRIKRDERLNAQIQARLAELEPFGYTDEHFMIRPARSVQELFDEGQALHHCVGSYAAKYASGETNLFLMRRVSAPDTPYCTVEMRDSALIQARGERNRLLREDEQTFVDQFVRHVARMHKRAQRRKAS

SEQ ID NO: 673 - protein, 508 aa, Artificial
  Alicyclobacillus acidocaldarius mutated SEQ ID NO 664
MSHDFFAHFPTEPSAALIEYARDVAFLRSRYLFVWRDGKVQMAYCTHCRETYPLGSDKDTYRHNEQATCRQCGSTCVVKHRGRGRRHLIDTAYIVWYEKSMVDAQTVVATWYYAWRDYSGDFHDVETQFQPRARYVFVPGRGGSMMRLEWSGEWQPRRNVHPLPVGMMGWRTVDVWCSHESIQTAVAGTPLQYSGWETYCDQYNTLLTFFDLASRYPCVEYLTKLGFSRLVMAKLDGLRTFGAIHWRGRTMEQVLRMPRADVHAFRKLADVIEPLSLRSYQTWRRLGWKVSPEEAHLLRELLIPHHWREIQVRASLASEVEIAKYLLKQLRKGEYRSISYALIEWIDYLRFCSELGIPLNTTRNVFPSNLREMHDEMMRRVRIKRDERLNAQIQARLAELEPFGYTDEHFMIRPARSVQELFDEGQALHHCVGSYAAKYASGETNLFLMRRVSAPDTPYCTVEMRDSALIQARGERNRLLREDEQTFVDQFVRHVARMHKRAQRRKAS

SEQ ID NO: 674 - protein, 508 aa, Artificial
  Alicyclobacillus acidocaldarius mutated SEQ ID NO 664
MSHDFFAHFPTEPSAALIEYARDVAFIRSRYLFVWRDGKVQMAYCTHCRETYPLGSDKDTYRHNEQATCRQCGSTCVVKHRGRGRRHLIDTAYIVWYEKSMVDAQTVVATWYYAWRDYSGDFHDVETQFQPRARYVFVPGRGGSMMRLDWSGEWQPRRNVHPLPVGMMGWRTVDVWCSHESIQTAVAGTPLQYSGWETYCDQYNTLLTFFDLASRYPCVEYLTKLGFSRLVMAKLDGLRTFGAIHWRGRTMEQVLRMPRADVHAFRKLADVIEPLSLRSYQTWRRLGWKVSPEEAHLLRELLIPHHWREIQVRASLASEVEIAKYLLKQLRKGEYRSISYALIEWIDYLRFCSELGIPLNTTRNVFPSNLREMHDEMMRRVRIKRDERLNAQIQARLAELEPFGYTDEHFMIRPARSVQELFDEGQALHHCVGSYAAKYASGETNLFLMRRVSAPDTPYCTVEMRDSALIQARGERNRLLREDEQTFVDQFVRHVARMHKRAQRRKAS

SEQ ID NO: 675 - protein, 508 aa, Artificial
  Alicyclobacillus acidocaldarius mutated SEQ ID NO 664
MSHDFFAHFPTEPSAALIEYARDVAFLRSRYLFVWRDGKVQMAYCTHCRETYPLGSDKDTYRHNEQATCRQCGSTCVVKHRGRGRRHLIDTAYIVWYEKSMVDAQTVVATWYYAWRDYSGDFHDVETQFQPRARYVFVPGRGGSMMRLDWSGEWQPRRNVHPLPVGMMGWRTVDVWCSHESIQTAVAGTPLQYSGWETYCDQYNTLLTFFDLASRYPCVEYLTKLGFSRLVMAKLDGLRTFGAIHWRGRTMEQVLRMPRADVHAFRKLADVIEPLSLRSYQTWRRLGWKVSPEEAHLLRELLIPHHWREIQVRASLASEVEIAKYLLKQLRKGEYRSISYALIEWIDYLRFCSELGIPLNTTRNVFPSNLREMHDEMMKRVRIKRDERLNAQIQARLAELEPFGYTDEHFMIRPARSVQELFDEGQALHHCVGSYAAKYASGETNLFLMRRVSAPDTPYCTVEMRDSALIQARGERNRLLREDEQTFVDQFVRHVARMHKRAQRRKAS

SEQ ID NO: 676 - DNA, 1527 bp, Artificial
  Alicyclobacillus acidocaldarius mutated SEQ ID NO 665
gtgagccacgacttcttcgcgcattttccgacggaacccagcgcagcgctgatcgagtacgcacgagacgtcgcgttcctcaggagtcgctacctgtttgtctggcgcgacggaaaggttcagatggcgtactgcacgcattgccgcgaaacctatccgctcggttcggacaaggacacctatcggcataacgaacaagcgacgtgtcgccaatgtggatcgacgtgcgtagtcaaacatcgcggccgcgggcgtagacacttgatcgaaaccgcctacatcgtgtggtacgagaagtcgatggtcgatgcccaaacggtggtcgcgacctggtactacgcctggcgggactactctggcgatttccacgacgtcgagacacaattccagccacgcgcccggtacgtgtttgtgccggggcgcggcggcagcatgatgcgcttggactggtccggcgagtggcaaccgcgccggaacgttcatccgctgcccgttggcatgatgggctggcgcaccgtcgacgtctggtgttcgcacgagagcatccaaaccgcagtggccggaacacctcttcagtacagcggctgggagacgtattgcgatcagtacaacacactcctcaccttcttcgacctggccagcagatacccgtgcgtcgagtatctgaccaaactcggcttttcgagattggtgatggcaaagttggacggtctccgcacgttcggggccattcactggcgcggcagaacgatggaacaggtccttcgcatgccacgcgcggatgtccacgccttccgcaagctggcggacgtcatcgagccgctgtcgctccgaagctaccagacgtggagacgcctggggtggaaggtgtcaccggaagaagcccatcttctgcgcgaactgctgatccctcatcactggagagagatccaggttcgagcatcactcgcgtccgaagtcgagatcgcaaagtaccttctcaagcaactccgcaaaggcgagtaccgttcgatcagctatgcgctcatcgagtggatcgactacctccgtttttgttcggaactcgggattccgctcaacacgacgaggaacgtgttcccgtcgaacctccgcgaaatgcacgatgagatgatgcgacgtgtgcgtatcaaacgggacgaacgccttaacgcgcaaattcaagcccgcttggccgagttggagccgttcggttacacggacgaacatttcatgattcggccggcgcgcagtgtgcaggagctcttcgacgaaggacaagctcttcaccactgcgtcggtagctatgcggcgaagtacgcttcaggagagaccaacctgttcttgatgcgacgagtctccgccccggatacgccgtactgtaccgtggaaatgagagacagtgcgctcatccaagcgcgtggcgaacgcaatcgcctgcttcgagaggacgaacagacctttgtcgatcaatttgtccgccacgtggcccgtatgcacaaacgggcacagcgtcgaaaagcaagctaa

SEQ ID NO: 677 - DNA, 1527 bp, Artificial
  Alicyclobacillus acidocaldarius mutated SEQ ID NO 665
gtgagccacgacttcttcgcgcattttccgacggaacccagcgcagcgctgatcgagtacgcacgagacgtcgcgttcctcaggagtcgctacctgtttgtctggcgcgacggaaaggttcagatggcgtactgcacgcattgccgcgaaacctatccgctcggttcggacaaggacacctatcggcataacgaacaagcgacgtgtcgccaatgtggatcgacgtgcgtagtcaaacatcgcggccgcgggcgtagacacttgatcgataccgcctacatcgtgtggtacgagaagtcgatggtcgatgcccaaacggtggtcgcgacctggtactacgcctggcgggactactctggcgatttccacgacgtcgagacacaattccagccacgcgcccggtacgtgtttgtgccggggcgcggcggcagcatgatgcgcttggactggtccggcgagtggcaaccgcgccggaacgttcatccgctgcccgttggcatgatgggctggcgcaccgtcgacgtctggtgttcgcacgagagcatccaaaccgcagtggccggaacacctcttcagtacagcggctgggagacgtattgcgatcagtacaacacactcctcaccttcttcgacctggccagcagatacccgtgcgtcgagtatctgaccaaactcggcttttcgagattggtgatggcaaagttggacggtctccgcacgttcggggccattcactggcgcggcagaacgatggaacaggtccttcgcatgccacgcgcggatgtccacgccttcaaaaagctggcggacgtcatcgagccgctgtcgctccgaagctaccagacgtggagacgcctggggtggaaggtgtcaccggaagaagcccatcttctgcgcgaactgctgatccctcatcactggagagagatccaggttcgagcatcactcgcgtccgaagtcgagatcgcaaagtaccttctcaagcaactccgcaaaggcgagtaccgttcgatcagctatgcgctcatcgagtggatcgactacctccgtttttgttcggaactcgggattccgctcaacacgacgaggaacgtgttcccgtcgaacctccgcgaaatgcacgatgagatgatgcgacgtgtgcgtatcaaacgggacgaacgccttaacgcgcaaattcaagcccgcttggccgagttggagccgttcggttacacggacgaacatttcatgattcggccggcgcgcagtgtgcaggagctcttcgacgaaggacaagctcttcaccactgcgtcggtagctatgcggcgaagtacgcttcaggagagaccaacctgttcttgatgcgacgagtctccgccccggatacgccgtactgtaccgtggaaatgagagacagtgcgctcatccaagcgcgtggcgaacgcaatcgcctgcttcgagaggacgaacagacctttgtcgatcaatttgtccgccacgtggcccgtatgcacaaacgggcacagcgtcgaaaagcaagctaa

SEQ ID NO: 678 - DNA, 1527 bp, Artificial
  Alicyclobacillus acidocaldarius mutated SEQ ID NO 665
gtgagccacgacttcttcgcgcattttccgacggaacccagcgcagcgctgatcgagtacgcacgagacgtcgcgttcctcaggagtcgctacctgtttgtctggcgcgacggaaaggttcagatggcgtactgcacgcattgccgcgaaacctatccgctcggttcggacaaggacacctatcggcataacgaacaagcgacgtgtcgccaatgtggatcgacgtgcgtagtcaaacatcgcggccgcgggcgtagacacttgatcgataccgcctacatcgtgtggtacgagaagtcgatggtcgatgcccaaacggtggtcgcgacctggtactacgcctggcgggactactctggcgatttccacgacgtcgagacacaattccagccacgcgcccggtacgtgtttgtgccggggcgcggcggcagcatgatgcgcttggaatggtccggcgagtggcaaccgcgccggaacgttcatccgctgcccgttggcatgatgggctggcgcaccgtcgacgtctggtgttcgcacgagagcatccaaaccgcagtggccggaacacctcttcagtacagcggctgggagacgtattgcgatcagtacaacacactcctcaccttcttcgacctggccagcagatacccgtgcgtcgagtatctgaccaaactcggcttttcgagattggtgatggcaaagttggacggtctccgcacgttcggggccattcactggcgcggcagaacgatggaacaggtccttcgcatgccacgcgcggatgtccacgccttccgcaagctggcggacgtcatcgagccgctgtcgctccgaagctaccagacgtggagacgcctggggtggaaggtgtcaccggaagaagcccatcttctgcgcgaactgctgatccctcatcactggagagagatccaggttcgagcatcactcgcgtccgaagtcgagatcgcaaagtaccttctcaagcaactccgcaaaggcgagtaccgttcgatcagctatgcgctcatcgagtggatcgactacctccgtttttgttcggaactcgggattccgctcaacacgacgaggaacgtgttcccgtcgaacctccgcgaaatgcacgatgagatgatgcgacgtgtgcgtatcaaacgggacgaacgccttaacgcgcaaattcaagcccgcttggccgagttggagccgttcggttacacggacgaacatttcatgattcggccggcgcgcagtgtgcaggagctcttcgacgaaggacaagctcttcaccactgcgtcggtagctatgcggcgaagtacgcttcaggagagaccaacctgttcttgatgcgacgagtctccgccccggatacgccgtactgtaccgtggaaatgagagacagtgcgctcatccaagcgcgtggcgaacgcaatcgcctgcttcgagaggacgaacagacctttgtcgatcaatttgtccgccacgtggcccgtatgcacaaacgggcacagcgtcgaaaagcaagctaa

SEQ ID NO: 679 - DNA, 1527 bp, Artificial
  Alicyclobacillus acidocaldarius mutated SEQ ID NO 665
gtgagccacgacttcttcgcgcattttccgacggaacccagcgcagcgctgatcgagtacgcacgagacgtcgcgttcattaggagtcgctacctgtttgtctggcgcgacggaaaggttcagatggcgtactgcacgcattgccgcgaaacctatccgctcggttcggacaaggacacctatcggcataacgaacaagcgacgtgtcgccaatgtggatcgacgtgcgtagtcaaacatcgcggccgcgggcgtagacacttgatcgataccgcctacatcgtgtggtacgagaagtcgatggtcgatgcccaaacggtggtcgcgacctggtactacgcctggcgggactactctggcgatttccacgacgtcgagacacaattccagccacgcgcccggtacgtgtttgtgccggggcgcggcggcagcatgatgcgcttggactggtccggcgagtggcaaccgcgccggaacgttcatccgctgcccgttggcatgatgggctggcgcaccgtcgacgtctggtgttcgcacgagagcatccaaaccgcagtggccggaacacctcttcagtacagcggctgggagacgtattgcgatcagtacaacacactcctcaccttcttcgacctggccagcagatacccgtgcgtcgagtatctgaccaaactcggcttttcgagattggtgatggcaaagttggacggtctccgcacgttcggggccattcactggcgcggcagaacgatggaacaggtccttcgcatgccacgcgcggatgtccacgccttccgcaagctggcggacgtcatcgagccgctgtcgctccgaagctaccagacgtggagacgcctggggtggaaggtgtcaccggaagaagcccatcttctgcgcgaactgctgatccctcatcactggagagagatccaggttcgagcatcactcgcgtccgaagtcgagatcgcaaagtaccttctcaagcaactccgcaaaggcgagtaccgttcgatcagctatgcgctcatcgagtggatcgactacctccgtttttgttcggaactcgggattccgctcaacacgacgaggaacgtgttcccgtcgaacctccgcgaaatgcacgatgagatgatgcgacgtgtgcgtatcaaacgggacgaacgccttaacgcgcaaattcaagcccgcttggccgagttggagccgttcggttacacggacgaacatttcatgattcggccggcgcgcagtgtgcaggagctcttcgacgaaggacaagctcttcaccactgcgtcggtagctatgcggcgaagtacgcttcaggagagaccaacctgttcttgatgcgacgagtctccgccccggatacgccgtactgtaccgtggaaatgagagacagtgcgctcatccaagcgcgtggcgaacgcaatcgcctgcttcgagaggacgaacagacctttgtcgatcaatttgtccgccacgtggcccgtatgcacaaacgggcacagcgtcgaaaagcaagctaa

SEQ ID NO: 680 - DNA, 1527 bp, Artificial
  Alicyclobacillus acidocaldarius mutated SEQ ID NO 665
gtgagccacgacttcttcgcgcattttccgacggaacccagcgcagcgctgatcgagtacgcacgagacgtcgcgttcctcaggagtcgctacctgtttgtctggcgcgacggaaaggttcagatggcgtactgcacgcattgccgcgaaacctatccgctcggttcggacaaggacacctatcggcataacgaacaagcgacgtgtcgccaatgtggatcgacgtgcgtagtcaaacatcgcggccgcgggcgtagacacttgatcgataccgcctacatcgtgtggtacgagaagtcgatggtcgatgcccaaacggtggtcgcgacctggtactacgcctggcgggactactctggcgatttccacgacgtcgagacacaattccagccacgcgcccggtacgtgtttgtgccggggcgcggcggcagcatgatgcgcttggactggtccggcgagtggcaaccgcgccggaacgttcatccgctgcccgttggcatgatgggctggcgcaccgtcgacgtctggtgttcgcacgagagcatccaaaccgcagtggccggaacacctcttcagtacagcggctgggagacgtattgcgatcagtacaacacactcctcaccttcttcgacctggccagcagatacccgtgcgtcgagtatctgaccaaactcggcttttcgagattggtgatggcaaagttggacggtctccgcacgttcggggccattcactggcgcggcagaacgatggaacaggtccttcgcatgccacgcgcggatgtccacgccttccgcaagctggcggacgtcatcgagccgctgtcgctccgaagctaccagacgtggagacgcctggggtggaaggtgtcaccggaagaagcccatcttctgcgcgaactgctgatccctcatcactggagagagatccaggttcgagcatcactcgcgtccgaagtcgagatcgcaaagtaccttctcaagcaactccgcaaaggcgagtaccgttcgatcagctatgcgctcatcgagtggatcgactacctccgtttttgttcggaactcgggattccgctcaacacgacgaggaacgtgttcccgtcgaacctccgcgaaatgcacgatgagatgatgaaacgtgtgcgtatcaaacgggacgaacgccttaacgcgcaaattcaagcccgcttggccgagttggagccgttcggttacacggacgaacatttcatgattcggccggcgcgcagtgtgcaggagctcttcgacgaaggacaagctcttcaccactgcgtcggtagctatgcggcgaagtacgcttcaggagagaccaacctgttcttgatgcgacgagtctccgccccggatacgccgtactgtaccgtggaaatgagagacagtgcgctcatccaagcgcgtggcgaacgcaatcgcctgcttcgagaggacgaacagacctttgtcgatcaatttgtccgccacgtggcccgtatgcacaaacgggcacagcgtcgaaaagcaagctaa

SEQ ID NO: 681 - protein, 143 aa, Alicyclobacillus acidocaldarius
MYEKAVEKITLEMSANEHHPYVQVIGRFLLVHLEQHPEHAKNLLEEEKTILKSLDTMRRYAETQRVGNVAVISDADGFGIVLQYFDCWDGKPFEIPPEPQPPARVAAPTRVTSAKSAQASKKSTAPALTQLSLFDDAEGGEAL

SEQ ID NO: 682 - DNA, 432 bp, Alicyclobacillus acidocaldarius
atgtacgaaaaggctgttgagaaaatcacactggagatgagcgccaacgagcatcatccgtatgtccaggtgatcggacgctttttgttggtgcacctcgaacagcacccggaacacgcgaagaacctcctcgaggaagagaaaaccatcctcaaaagccttgacaccatgcgacgttacgcggaaacgcagcgtgtgggcaatgtggccgtaatttcagacgcggacggattcggcatcgtcctccaatattttgattgttgggacggcaagcccttcgagattccgcccgagccacaaccgcccgcccgagtcgccgcaccgacacgcgtaacgtcggccaaatcagcccaagcgtccaagaagtcgacggcgccagctttaacccaactttcgctcttcgacgatgcggaaggaggcgaggccctgtga

SEQ ID NO: 683 - protein, 58 aa, Lysinibacillus sphaericus
MVEQAMAKLSAELRVERVNPYVAAVGNFLMDFLEDNPSSAEKFLAEGKTIIGSMKEVR

SEQ ID NO: 684 - protein, 81 aa, Clostridium butyricum
AVEKIKEEMSKESNPYIAYIGNYVLENIEVNKPAAEKIAVGSKTISESFKKVQGEARKIAQNGIAMLAEREVISIVTKYFE

SEQ ID NO: 685 - protein, 122 aa, Streptococcus pyogenes
EKALSKMLDEMNKKHSAAEDAIHNWLSDQDDEELFKGILDDKKSIKDAMKYCINQAQKQKTGNCAMVDDKTVFGWVRVYFTGKTKKIEPVQATVTVSQENTKVIPKKNKKSKGVVEGQLDLF

SEQ ID NO: 686 - protein, 80 aa, Chlamydomonas reinhardtii
DMAARYLSTQEALLVATMSIHNGYGIRLTWTQRPPRPQPPNRLAPGAGTIGSSGASPQASPRASGTVPSAGTTAAASDAD

SEQ ID NO: 687 - protein, 107 aa, Homo sapiens
VLGFLQEHGGKVRNSELLSRFKPLLDAGDPRGRAARRDRFKQFVNNVAVVKELDGVKFVVLRKKPRPPEPEPAPFGPPGAAAQPSKPTSTVLPRSASAPGAPPLVRV

SEQ ID NO: 688 - protein, 143 aa, Artificial
  Alicyclobacillus acidocaldarius mutated SEQ ID NO 681
MYEKAVEKITLEMSANEHHPYVQVIGRFLLVHLEQHPEHAKNLLEEEKTILKSLDTMRRYAETQRVGNVAVISDADGFGLVLQYFDCWDGKPFEIPPEPQPPARVAAPTRVTSAKSAQASKKSTAPALTQLSLFDDAEGGEAL

SEQ ID NO: 689 - protein, 143 aa, Artificial
  Alicyclobacillus acidocaldarius mutated SEQ ID NO 681
MYEKAVEKITLEMSANEHHPYVQVIGRFLLVHLEQHPEHAKNLLEEEKTILKSIDTMRRYAETQRVGNVAVISDADGFGIVLQYFDCWDGKPFEIPPEPQPPARVAAPTRVTSAKSAQASKKSTAPALTQLSLFDDAEGGEAL

SEQ ID NO: 690 - protein, 143 aa, Artificial
  Alicyclobacillus acidocaldarius mutated SEQ ID NO 681
MYEKAVEKITLEMSANEHHPYVQVIGRFLLVHLEQHPEHAKNLLEEEKTILKSLDTMRRYAETQRVGNVAVISDAEGFGIVLQYFDCWDGKPFEIPPEPQPPARVAAPTRVTSAKSAQASKKSTAPALTQLSLFDDAEGGEAL

SEQ ID NO: 691 - protein, 143 aa, Artificial
  Alicyclobacillus acidocaldarius mutated SEQ ID NO 681
MYEKAVEKITLEMSANEHHPYVQVIGRFLLVHLEQHPEHAKNLLEEDKTILKSLDTMRRYAETQRVGNVAVISDADGFGIVLQYFDCWDGKPFEIPPEPQPPARVAAPTRVTSAKSAQASKKSTAPALTQLSLFDDAEGGEAL

SEQ ID NO: 692 - protein, 143 aa, Artificial
  Alicyclobacillus acidocaldarius mutated SEQ ID NO 681
MYEKAVEKITLEMSANEHHPYVQVIGRFLLVHLEQHPEHAKNLLEEEKTILKSLDTMRRYAETQRVGNVAIISDADGFGIVLQYFDCWDGKPFEIPPEPQPPARVAAPTRVTSAKSAQASKKSTAPALTQLSLFDDAEGGEAL

SEQ ID NO: 693 - DNA, 432 bp, Artificial
  Alicyclobacillus acidocaldarius mutated SEQ ID NO 682
atgtacgaaaaggctgttgagaaaatcacactggagatgagcgccaacgagcatcatccgtatgtccaggtgatcggacgctttttgttggtgcacctcgaacagcacccggaacacgcgaagaacctcctcgaggaagagaaaaccatcctcaaaagccttgacaccatgcgacgttacgcggaaacgcagcgtgtgggcaatgtggccgtaatttcagacgcggacggattcggcttagtcctccaatattttgattgttgggacggcaagcccttcgagattccgcccgagccacaaccgcccgcccgagtcgccgcaccgacacgcgtaacgtcggccaaatcagcccaagcgtccaagaagtcgacggcgccagctttaacccaactttcgctcttcgacgatgcggaaggaggcgaggccctgtga

SEQ ID NO: 694 - DNA, 432 bp, Artificial
  Alicyclobacillus acidocaldarius mutated SEQ ID NO 682
atgtacgaaaaggctgttgagaaaatcacactggagatgagcgccaacgagcatcatccgtatgtccaggtgatcggacgctttttgttggtgcacctcgaacagcacccggaacacgcgaagaacctcctcgaggaagagaaaaccatcctcaaaagcattgacaccatgcgacgttacgcggaaacgcagcgtgtgggcaatgtggccgtaatttcagacgcggacggattcggcatcgtcctccaatattttgattgttgggacggcaagcccttcgagattccgcccgagccacaaccgcccgcccgagtcgccgcaccgacacgcgtaacgtcggccaaatcagcccaagcgtccaagaagtcgacggcgccagctttaacccaactttcgctcttcgacgatgcggaaggaggcgaggccctgtga

SEQ ID NO: 695 - DNA, 432 bp, Artificial
  Alicyclobacillus acidocaldarius mutated SEQ ID NO 682
atgtacgaaaaggctgttgagaaaatcacactggagatgagcgccaacgagcatcatccgtatgtccaggtgatcggacgctttttgttggtgcacctcgaacagcacccggaacacgcgaagaacctcctcgaggaagagaaaaccatcctcaaaagccttgacaccatgcgacgttacgcggaaacgcagcgtgtgggcaatgtggccgtaatttcagacgcggaaggattcggcatcgtcctccaatattttgattgttgggacggcaagcccttcgagattccgcccgagccacaaccgcccgcccgagtcgccgcaccgacacgcgtaacgtcggccaaatcagcccaagcgtccaagaagtcgacggcgccagctttaacccaactttcgctcttcgacgatgcggaaggaggcgaggccctgtga

SEQ ID NO: 696 - DNA, 432 bp, Artificial
  Alicyclobacillus acidocaldarius mutated SEQ ID NO 682
atgtacgaaaaggctgttgagaaaatcacactggagatgagcgccaacgagcatcatccgtatgtccaggtgatcggacgctttttgttggtgcacctcgaacagcacccggaacacgcgaagaacctcctcgaggaagataaaaccatcctcaaaagccttgacaccatgcgacgttacgcggaaacgcagcgtgtgggcaatgtggccgtaatttcagacgcggacggattcggcatcgtcctccaatattttgattgttgggacggcaagcccttcgagattccgcccgagccacaaccgcccgcccgagtcgccgcaccgacacgcgtaacgtcggccaaatcagcccaagcgtccaagaagtcgacggcgccagctttaacccaactttcgctcttcgacgatgcggaaggaggcgaggccctgtga

SEQ ID NO: 697 - DNA, 432 bp, Artificial
  Alicyclobacillus acidocaldarius mutated SEQ ID NO 682
atgtacgaaaaggctgttgagaaaatcacactggagatgagcgccaacgagcatcatccgtatgtccaggtgatcggacgctttttgttggtgcacctcgaacagcacccggaacacgcgaagaacctcctcgaggaagagaaaaccatcctcaaaagccttgacaccatgcgacgttacgcggaaacgcagcgtgtgggcaatgtggccattatttcagacgcggacggattcggcatcgtcctccaatattttgattgttgggacggcaagcccttcgagattccgcccgagccacaaccgcccgcccgagtcgccgcaccgacacgcgtaacgtcggccaaatcagcccaagcgtccaagaagtcgacggcgccagctttaacccaactttcgctcttcgacgatgcggaaggaggcgaggccctgtga

SEQ ID NO: 698 - protein, 119 aa, Alicyclobacillus acidocaldarius
MKMKHKIVLIPFPFDDLQSHKVRPALCLTDPISAHDHVVVAFISSQVPTHLLPTDIVLRAGTDAFAPTGLKVSSVIRLHRMVSMTTRIIRYELGHIADETRDLVESKLIQLFNLQHRLR

SEQ ID NO: 699 - DNA, 360 bp, Alicyclobacillus acidocaldarius
atgaagatgaagcataaaatcgtgctcatcccatttccgtttgatgacctacagtcgcacaaggtgagaccagccctgtgtctcaccgatccaatcagtgcccatgaccatgtagtggttgcgttcattagcagtcaagtgccgacgcatctacttccaacagacatcgtcttacgggcgggcacggatgcgtttgcaccaacgggtttgaaagtctcgtccgtgattcggttacatcgaatggtaagcatgacaacgagaatcatccggtatgagttaggacacatcgcagacgaaactcgtgatcttgtagagagtaaactcatccagctgtttaaccttcaacatcgtttgcgataa

SEQ ID NO: 700 - protein, 112 aa, Unknown
  uncultured archaeon
IKGKVVLIPFPFDDLSAEKVRPAVCLTEPIGPHHHVILAFITSQIPQKLLETDLVLDAGQPDFALVGLNVSSTLRLHRLMTVTTSLILRELGELPFDMKTEVDKRLRKLFGV

SEQ ID NO: 701 - protein, 107 aa, Candidatus Kuenenia
KVVLVNFPFDDLSTSKVRPAVCLTNPIGSHSHVILAFISSRIPSDLLETDLIIDTSHEGFSGTGLKVASTLRLHRLMTVTTSLCQRELGELSPKFLSEVNNKLKKLF

SEQ ID NO: 702 - protein, 110 aa, Crocosphaera watsonii
KGDIVLVPFPFTDLSTTKLRPAVVLWVDLSGIDVTVCFISSQNVNHVTPEEFVIETTNSEFSKTGLKVTSKVRVSRMVTIERNLITRRLGKLDISLLNKLNDCLKRVFQL

SEQ ID NO: 703 - protein, 110 aa, Anabaena variabilis
KGDIVLVPFPFTDLTGTKLRPGLILWVDNSGNDITLCFISSQDVTNLTSGEFVLDPSDAEFAGTGLKLISKVRVTRLVTLERRLITRRIGKLGVNQIQQLNLLMIQAFQL

SEQ ID NO: 704 - protein, 105 aa, Thermococcus kodakarensis
MNLKGKFVLVPFPFTNLKATKLRPALVLYEGKEDVVVAFVSSRIDTFDPGTDVRIETSHPQFRGIGLKVPSIIKLTKIATLHKGLLIGVLGELPEDLVQEVNSKL

SEQ ID NO: 705 - protein, 119 aa, Artificial
  Alicyclobacillus acidocaldarius mutated SEQ ID NO 698
MKMKHKIVLIPFPFDDLQSHKVRPALCLTDPISAHDHVVVAFISSQVPTHLLPTDIVLRAGTDAFAPTGLKVSSVIRLHRMVSMTTRILRYELGHIADETRDLVESKLIQLFNLQHRLR

SEQ ID NO: 706 - protein, 119 aa, Artificial
  Alicyclobacillus acidocaldarius mutated SEQ ID NO 698
MKMKHKIVLIPFPFDDLQSHKVRPALCLTDPISAHDHVVVAFISSQVPTHILPTDIVLRAGTDAFAPTGLKVSSVIRLHRMVSMTTRIIRYELGHIADETRDLVESKLIQLFNLQHRLR

SEQ ID NO: 707 - protein, 119 aa, Artificial
  Alicyclobacillus acidocaldarius mutated SEQ ID NO 698
MKMKHKIVLIPFPFDDLQSHKVRPALCLTDPISAHDHVVVAFISSQVPTHLLPTDIVLRAGTDAFAPTGLKVSSVIRLHRMVSMTTRIIRYELGHIADETKDLVESKLIQLFNLQHRLR

SEQ ID NO: 708 - protein, 119 aa, Artificial
  Alicyclobacillus acidocaldarius mutated SEQ ID NO 698
MKMKHKIVLIPFPFDDLQSHKVRPALCLTDPISAHDHVVVAFISSQVPTHLLPTDIVLRAGTDAFAPTGLKVSSVIRLHRMVSMTTKIIRYELGHIADETRDLVESKLIQLFNLQHRLR

SEQ ID NO: 709 - protein, 119 aa, Artificial
  Alicyclobacillus acidocaldarius mutated SEQ ID NO 698
MKMKHKIVLIPFPFDDLQSHKVRPALCLTDPISAHDHVVVAFISSQVPTHLIPTDIVLRAGTDAFAPTGLKVSSVIRLHRMVSMTTRIIRYELGHIADETRDLVESKLIQLFNLQHRLR

SEQ ID NO: 710 - DNA, 360 bp, Artificial
  Alicyclobacillus acidocaldarius mutated SEQ ID NO 699
atgaagatgaagcataaaatcgtgctcatcccatttccgtttgatgacctacagtcgcacaaggtgagaccagccctgtgtctcaccgatccaatcagtgcccatgaccatgtagtggttgcgttcattagcagtcaagtgccgacgcatctacttccaacagacatcgtcttacgggcgggcacggatgcgtttgcaccaacgggtttgaaagtctcgtccgtgattcggttacatcgaatggtaagcatgacaacgagaatcttacggtatgagttaggacacatcgcagacgaaactcgtgatcttgtagagagtaaactcatccagctgtttaaccttcaacatcgtttgcgataa

SEQ ID NO: 711 - DNA, 360 bp, Artificial
  Alicyclobacillus acidocaldarius mutated SEQ ID NO 699
atgaagatgaagcataaaatcgtgctcatcccatttccgtttgatgacctacagtcgcacaaggtgagaccagccctgtgtctcaccgatccaatcagtgcccatgaccatgtagtggttgcgttcattagcagtcaagtgccgacgcatattcttccaacagacatcgtcttacgggcgggcacggatgcgtttgcaccaacgggtttgaaagtctcgtccgtgattcggttacatcgaatggtaagcatgacaacgagaatcatccggtatgagttaggacacatcgcagacgaaactcgtgatcttgtagagagtaaactcatccagctgtttaaccttcaacatcgtttgcgataa

SEQ ID NO: 712 - DNA, 360 bp, Artificial
  Alicyclobacillus acidocaldarius mutated SEQ ID NO 699
atgaagatgaagcataaaatcgtgctcatcccatttccgtttgatgacctacagtcgcacaaggtgagaccagccctgtgtctcaccgatccaatcagtgcccatgaccatgtagtggttgcgttcattagcagtcaagtgccgacgcatctacttccaacagacatcgtcttacgggcgggcacggatgcgtttgcaccaacgggtttgaaagtctcgtccgtgattcggttacatcgaatggtaagcatgacaacgagaatcatccggtatgagttaggacacatcgcagacgaaactaaagatcttgtagagagtaaactcatccagctgtttaaccttcaacatcgtttgcgataa

SEQ ID NO: 713 - DNA, 360 bp, Artificial
  Alicyclobacillus acidocaldarius mutated SEQ ID NO 699
atgaagatgaagcataaaatcgtgctcatcccatttccgtttgatgacctacagtcgcacaaggtgagaccagccctgtgtctcaccgatccaatcagtgcccatgaccatgtagtggttgcgttcattagcagtcaagtgccgacgcatctacttccaacagacatcgtcttacgggcgggcacggatgcgtttgcaccaacgggtttgaaagtctcgtccgtgattcggttacatcgaatggtaagcatgacaacgaaaatcatccggtatgagttaggacacatcgcagacgaaactcgtgatcttgtagagagtaaactcatccagctgtttaaccttcaacatcgtttgcgataa

SEQ ID NO: 714 - DNA, 360 bp, Artificial
  Alicyclobacillus acidocaldarius mutated SEQ ID NO 699
atgaagatgaagcataaaatcgtgctcatcccatttccgtttgatgacctacagtcgcacaaggtgagaccagccctgtgtctcaccgatccaatcagtgcccatgaccatgtagtggttgcgttcattagcagtcaagtgccgacgcatctaattccaacagacatcgtcttacgggcgggcacggatgcgtttgcaccaacgggtttgaaagtctcgtccgtgattcggttacatcgaatggtaagcatgacaacgagaatcatccggtatgagttaggacacatcgcagacgaaactcgtgatcttgtagagagtaaactcatccagctgtttaaccttcaacatcgtttgcgataa

SEQ ID NO: 715 - protein, 282 aa, Alicyclobacillus acidocaldarius
MNEKVKAAMERLEHGLETLLSTEEWRKFLQFQAAFHHYSFSNTLLIMCQKPDATYVAGYNTWRELGRYVKKGEHGIEIFAPLLKKKSNKADIPREESEETSQEEENKRIIYGYRIVYVFDVSQTDGKPLPTVESPQIISGDSDLYEKLLQVCPYPVSEVVSLGSARGEFDLETNQIKIVQTLPEAHKAKTLIHEWAHGLLHTNGPLNPAHKPLIELEAESTAFVVSHALGLDTTDYSFAYIAGWSGKEAVNALKACGTRIQQAANSILLALEDQAQDFKTAM

SEQ ID NO: 716 - DNA, 849 bp, Alicyclobacillus acidocaldarius
atgaatgaaaaggtgaaagcagccatggagcgcttggagcatggcctagaaacactcctcagtacagaggaatggcgcaagtttcttcagttccaagcagcatttcaccattacagcttctcgaatacgctgctcatcatgtgtcagaagcccgatgcaacctatgtagcgggatacaatacgtggagggagctgggccgctacgtcaaaaaaggcgagcacggcattgaaatattcgcgccgttgctcaagaaaaaatcaaacaaggcggatatacctagagaggaatccgaagaaacgtcacaggaggaagagaacaagcgtatcatctacggctaccgcatcgtgtacgtgtttgacgtgtcgcagacggatggcaagccgttgccaaccgtggagagcccgcaaattatctcgggtgacagcgacctgtacgaaaagctgcttcaagtctgtccctatccggtttctgaggtcgtgtctctcggaagtgcaaggggagaattcgatttggagacaaatcaaatcaagattgtccagacactaccggaggcacacaaagcgaaaacgttgatacatgaatgggctcatggccttttgcacaccaacggtccattaaatccagcacacaagccactgatcgagctcgaagcggaatcgaccgcattcgtggtttctcatgcgctgggactcgataccacagactactcgttcgcttacatcgccggatggagcgggaaagaggccgtgaatgctctcaaggcgtgcggcacgaggatacagcaagccgcgaacagtatcttactggcgttggaagatcaagcgcaggatttcaaaaccgccatgtaa

SEQ ID NO: 717 - protein, 265 aa, Cyanothece  CCY0110
KTALAFQQLEQGLAELLESGDWQRYLKVQSEFHNYSFNNVLLILSQFPEASRVAGYQHWQELGRQVKKGSKSIKILAPLKCKIEKENDNGELEAKTGIFGFRTVNIFDISQTQGEDLPERTSPLTGDDDGLIDRLMAFSLNNNVPVFFKGLLGNANGCCRYDALSGHPIEIVVDPLLPKQHQAKTLCHEIGHSLLHSRTQYNNHIPRSKAELEAESVAFIVLNYFGIDSRDYSFPYVAGWQQGEDALENLRQSGMRIQKAANKVI

SEQ ID NO: 718 - protein, 297 aa, Clostridium scindens
EKLKEITDRLEQGITELFDSERYKEYLRVMSKFHNYSFNNTLLIAMQKPDASLIAGFNAWKNNFGRNVMKGQKGIKILAPSPFKIKKEMEKIDPQTQKPVIGKDGKPVTEEKEITIPAFKMVSVFDVSQTEGKEIPNIAVDSLTGDVERYKDVFAALEKTSPVPVGFEKIEGGAHGYYHLEDKRIALDEGMSELQTLKTLIHEIAHAKLHDIDLNAPLEDLENRPDRRTREVQAESIAYTVCQHYGLDTSDYSFGYVAGWSAGRELAELKSSLETIRSTAAEIINSIDEHIAELQKA

SEQ ID NO: 719 - protein, 297 aa, Clostridium scindens
EKLKEITDRLEQGIAELFDSERYREYLKVMSKFHNYSFRNTVLIAMQKPDASLVAGFSAWKNNFERNVMKGQKGIKIIAPSPYKIKQEMQKIDPHTQKPVIGKDGKPVTEEKEVTIPAYKVVSVFDVSQTEGKELPDIAVDELTGDVDRYKDFFAALEKTSPVPIAFENIEGGSHGYYHLEDKRIAINEGMSELQTLKTAIHEIAHAKLHDIDLNAPKDEQQPHVDRRTREVEAESVAYTVCQHYGLDTSDYSFGYVAGWSSGRELSELKSSLETIRSAAAEIINSIDENLAELQKA

SEQ ID NO: 720 - protein, 297 aa, Clostridium bolteae; identical to SEQ ID NO: 719

SEQ ID NO: 721 - protein, 297 aa, Coprococcus eutactus
EKLKEITDRLEQGIAELFDSERYKEYLKVMSKFHNYSFRNTVLIAMQKPDASLVAGFSAWKNNFERNVMKGQKGIKIIAPSPYKIKQEMQKIDPHTQKPIIGKDGKPVTEEKEVTIPAYKVVSVFDVSQTEGKELPDIAIDELPGDVDRYKDFFAALEKTSPVPIAFENIEGGSHGYYHLEDKRIAINEGMSELQTLKTAIHEIAHAKLHDIDLNAPKDEQQPHIDRRTREVEAESVAYTVCQHYGLDTSDYSFGYVAGWSSGRELSELKSSLETIRSAAAEIINSIDENLAELQKA

SEQ ID NO: 722 - protein, 282 aa, Artificial
  Alicyclobacillus acidocaldarius mutated SEQ ID NO 715
MNEKVKAAMERLEHGLETLLSTEEWRKFLQFQAAFHHYSFSNTLLIMCQKPDATYVAGYNTWRELGRYVKKGEHGIEIFAPLLKKKSNKADIPREESEETSQEEENKRIIYGYRIVYVFDVSQTDGKPLPTVESPNIISGDSDLYEKLLQVCPYPVSEVVSLGSARGEFDLETNQIKIVQTLPEAHKAKTLIHEWAHGLLHTNGPLNPAHKPLIELEAESTAFVVSHALGLDTTDYSFAYIAGWSGKEAVNALKACGTRIQQAANSILLALEDQAQDFKTAM

SEQ ID NO: 723 - protein, 282 aa, Artificial
  Alicyclobacillus acidocaldarius mutated SEQ ID NO 715
MNEKVKAAMERLEHGLETLLSTEEWRKFLQFQAAFHHYSFSNTLLIMCQKPDATYVAGYNTWRELGRYVRKGEHGIEIFAPLLKKKSNKADIPREESEETSQEEENKRIIYGYRIVYVFDVSQTDGKPLPTVESPQIISGDSDLYEKLLQVCPYPVSEVVSLGSARGEFDLETNQIKIVQTLPEAHKAKTLIHEWAHGLLHTNGPLNPAHKPLIELEAESTAFVVSHALGLDTTDYSFAYIAGWSGKEAVNALKACGTRIQQAANSILLALEDQAQDFKTAM

SEQ ID NO: 724 - protein, 282 aa, Artificial
  Alicyclobacillus acidocaldarius mutated SEQ ID NO 715
MNEKVKAAMERLEHGLETLLSTEEWRKFLQFQAAFHHYSFSNTLLIMCQKPDATYVAGYNTWRELGRYVKKGEHGIEIFAPLLRKKSNKADIPREESEETSQEEENKRIIYGYRIVYVFDVSQTDGKPLPTVESPQIISGDSDLYEKLLQVCPYPVSEVVSLGSARGEFDLETNQIKIVQTLPEAHKAKTLIHEWAHGLLHTNGPLNPAHKPLIELEAESTAFVVSHALGLDTTDYSFAYIAGWSGKEAVNALKACGTRIQQAANSILLALEDQAQDFKTAM

SEQ ID NO: 725 - protein, 282 aa, Artificial
  Alicyclobacillus acidocaldarius mutated SEQ ID NO 715
MNEKVKAAMERLEHGLETLLSTEEWRKFLQFQAAFHHYSFSNTLLIMCQKPDATYVAGYNTWRELGRYVKKGEHGIEIFAPLLKKKSNKADIPREESEETSQEEENKRIIYGYRIVYVFDVSQTDGKPLPTVESPQIISGDSDLYEKLLQVCPYPVSEVVSLGSARGEFDLETNQIKIVQTLPEAHKAKTLIHEWAHGLLHTNGPLNPAHKPLIELEAESTAFVVSHALGLDTTDYSFAYIAGWSGKEAVNALKACGTRIQQAANSILLALEDQAQDFRTAM

SEQ ID NO: 726 - protein, 282 aa, Artificial
  Alicyclobacillus acidocaldarius mutated SEQ ID NO 715
MNEKVKAAMERLEHGLETLLSTEEWRKFLQFQAAFHHYSFSNTLLIMCQKPDATYVAGYNTWRELGRYVKKGEHGIEIFAPLLKKKSNKADIPREESEETSQEEENKRIIYGYRIVYVFDVSQTDGKPLPTVESPQIISGDSDLYEKLLQVCPYPVSEVVSLGSARGEFDLETNQIKIVQTLPEAHKAKTLIHEWAHGLLHTNGPLNPAHKPLIELEAESTAFVVSHAIGLDTTDYSFAYIAGWSGKEAVNALKACGTRIQQAANSILLALEDQAQDFKTAM

SEQ ID NO: 727 - DNA, 849 bp, Artificial
  Alicyclobacillus acidocaldarius mutated SEQ ID NO 716
atgaatgaaaaggtgaaagcagccatggagcgcttggagcatggcctagaaacactcctcagtacagaggaatggcgcaagtttcttcagttccaagcagcatttcaccattacagcttctcgaatacgctgctcatcatgtgtcagaagcccgatgcaacctatgtagcgggatacaatacgtggagggagctgggccgctacgtcaaaaaaggcgagcacggcattgaaatattcgcgccgttgctcaagaaaaaatcaaacaaggcggatatacctagagaggaatccgaagaaacgtcacaggaggaagagaacaagcgtatcatctacggctaccgcatcgtgtacgtgtttgacgtgtcgcagacggatggcaagccgttgccaaccgtggagagcccgaatattatctcgggtgacagcgacctgtacgaaaagctgcttcaagtctgtccctatccggtttctgaggtcgtgtctctcggaagtgcaaggggagaattcgatttggagacaaatcaaatcaagattgtccagacactaccggaggcacacaaagcgaaaacgttgatacatgaatgggctcatggccttttgcacaccaacggtccattaaatccagcacacaagccactgatcgagctcgaagcggaatcgaccgcattcgtggtttctcatgcgctgggactcgataccacagactactcgttcgcttacatcgccggatggagcgggaaagaggccgtgaatgctctcaaggcgtgcggcacgaggatacagcaagccgcgaacagtatcttactggcgttggaagatcaagcgcaggatttcaaaaccgccatgtaa

SEQ ID NO: 728 - DNA, 849 bp, Artificial
  Alicyclobacillus acidocaldarius mutated SEQ ID NO 716
atgaatgaaaaggtgaaagcagccatggagcgcttggagcatggcctagaaacactcctcagtacagaggaatggcgcaagtttcttcagttccaagcagcatttcaccattacagcttctcgaatacgctgctcatcatgtgtcagaagcccgatgcaacctatgtagcgggatacaatacgtggagggagctgggccgctacgtccgtaaaggcgagcacggcattgaaatattcgcgccgttgctcaagaaaaaatcaaacaaggcggatatacctagagaggaatccgaagaaacgtcacaggaggaagagaacaagcgtatcatctacggctaccgcatcgtgtacgtgtttgacgtgtcgcagacggatggcaagccgttgccaaccgtggagagcccgcaaattatctcgggtgacagcgacctgtacgaaaagctgcttcaagtctgtccctatccggtttctgaggtcgtgtctctcggaagtgcaaggggagaattcgatttggagacaaatcaaatcaagattgtccagacactaccggaggcacacaaagcgaaaacgttgatacatgaatgggctcatggccttttgcacaccaacggtccattaaatccagcacacaagccactgatcgagctcgaagcggaatcgaccgcattcgtggtttctcatgcgctgggactcgataccacagactactcgttcgcttacatcgccggatggagcgggaaagaggccgtgaatgctctcaaggcgtgcggcacgaggatacagcaagccgcgaacagtatcttactggcgttggaagatcaagcgcaggatttcaaaaccgccatgtaa

SEQ ID NO: 729 - DNA, 849 bp, Artificial
  Alicyclobacillus acidocaldarius mutated SEQ ID NO 716
atgaatgaaaaggtgaaagcagccatggagcgcttggagcatggcctagaaacactcctcagtacagaggaatggcgcaagtttcttcagttccaagcagcatttcaccattacagcttctcgaatacgctgctcatcatgtgtcagaagcccgatgcaacctatgtagcgggatacaatacgtggagggagctgggccgctacgtcaaaaaaggcgagcacggcattgaaatattcgcgccgttgctccgtaaaaaatcaaacaaggcggatatacctagagaggaatccgaagaaacgtcacaggaggaagagaacaagcgtatcatctacggctaccgcatcgtgtacgtgtttgacgtgtcgcagacggatggcaagccgttgccaaccgtggagagcccgcaaattatctcgggtgacagcgacctgtacgaaaagctgcttcaagtctgtccctatccggtttctgaggtcgtgtctctcggaagtgcaaggggagaattcgatttggagacaaatcaaatcaagattgtccagacactaccggaggcacacaaagcgaaaacgttgatacatgaatgggctcatggccttttgcacaccaacggtccattaaatccagcacacaagccactgatcgagctcgaagcggaatcgaccgcattcgtggtttctcatgcgctgggactcgataccacagactactcgttcgcttacatcgccggatggagcgggaaagaggccgtgaatgctctcaaggcgtgcggcacgaggatacagcaagccgcgaacagtatcttactggcgttggaagatcaagcgcaggatttcaaaaccgccatgtaa

SEQ ID NO: 730 - DNA, 849 bp, Artificial
  Alicyclobacillus acidocaldarius mutated SEQ ID NO 716
atgaatgaaaaggtgaaagcagccatggagcgcttggagcatggcctagaaacactcctcagtacagaggaatggcgcaagtttcttcagttccaagcagcatttcaccattacagcttctcgaatacgctgctcatcatgtgtcagaagcccgatgcaacctatgtagcgggatacaatacgtggagggagctgggccgctacgtcaaaaaaggcgagcacggcattgaaatattcgcgccgttgctcaagaaaaaatcaaacaaggcggatatacctagagaggaatccgaagaaacgtcacaggaggaagagaacaagcgtatcatctacggctaccgcatcgtgtacgtgtttgacgtgtcgcagacggatggcaagccgttgccaaccgtggagagcccgcaaattatctcgggtgacagcgacctgtacgaaaagctgcttcaagtctgtccctatccggtttctgaggtcgtgtctctcggaagtgcaaggggagaattcgatttggagacaaatcaaatcaagattgtccagacactaccggaggcacacaaagcgaaaacgttgatacatgaatgggctcatggccttttgcacaccaacggtccattaaatccagcacacaagccactgatcgagctcgaagcggaatcgaccgcattcgtggtttctcatgcgctgggactcgataccacagactactcgttcgcttacatcgccggatggagcgggaaagaggccgtgaatgctctcaaggcgtgcggcacgaggatacagcaagccgcgaacagtatcttactggcgttggaagatcaagcgcaggatttccgtaccgccatgtaa

SEQ ID NO: 731 - DNA, 849 bp, Artificial
  Alicyclobacillus acidocaldarius mutated SEQ ID NO 716
atgaatgaaaaggtgaaagcagccatggagcgcttggagcatggcctagaaacactcctcagtacagaggaatggcgcaagtttcttcagttccaagcagcatttcaccattacagcttctcgaatacgctgctcatcatgtgtcagaagcccgatgcaacctatgtagcgggatacaatacgtggagggagctgggccgctacgtcaaaaaaggcgagcacggcattgaaatattcgcgccgttgctcaagaaaaaatcaaacaaggcggatatacctagagaggaatccgaagaaacgtcacaggaggaagagaacaagcgtatcatctacggctaccgcatcgtgtacgtgtttgacgtgtcgcagacggatggcaagccgttgccaaccgtggagagcccgcaaattatctcgggtgacagcgacctgtacgaaaagctgcttcaagtctgtccctatccggtttctgaggtcgtgtctctcggaagtgcaaggggagaattcgatttggagacaaatcaaatcaagattgtccagacactaccggaggcacacaaagcgaaaacgttgatacatgaatgggctcatggccttttgcacaccaacggtccattaaatccagcacacaagccactgatcgagctcgaagcggaatcgaccgcattcgtggtttctcatgcgattggactcgataccacagactactcgttcgcttacatcgccggatggagcgggaaagaggccgtgaatgctctcaaggcgtgcggcacgaggatacagcaagccgcgaacagtatcttactggcgttggaagatcaagcgcaggatttcaaaaccgccatgtaa

SEQ ID NO: 732 - protein, 155 aa, Alicyclobacillus acidocaldarius
MEVGRKSNMSSITVVRVELVKERSLEYEGSRLIRCAEDAANILRGYIGNADREMFVVMVLSAKHIVNAINTVSLGILDSSIVHPREVFKPAILSNAASVIVGHNHPSGDPEPSPEDVAVTRRLVDAGKILGIDVLDHIVIGDEGRFVSLKARELL

SEQ ID NO: 733 - DNA, 468 bp, Alicyclobacillus acidocaldarius
gtggaggtcgggaggaaatcaaacatgtcatccatcaccgtcgtccgggtagaactcgtcaaggaacgatcacttgaatatgaaggttcgcggctaatccggtgcgccgaagacgcagcaaacatccttcgaggttacatcggcaacgcggatcgtgaaatgttcgtagtgatggtcttatcagccaagcacatcgtcaacgcgatcaacaccgttagtctcgggatacttgactcctctatcgtgcatccacgggaagtatttaaacccgcgattctgagcaatgctgcatcggtgatcgtgggacacaatcatccaagcggggatcccgagccaagtccagaagacgtggcagtgacgcgccgacttgtggatgcgggaaaaattctaggcattgatgttttggatcacattgtcatcggagacgaaggacggttcgtcagtctcaaggcaagagaattgctctga

SEQ ID NO: 734 - protein, 139 aa, Bacillus cereus
VDIVKLKMIKESSLLYKERRVKSPEDASLLFRQFLDGADREYFIVLCLDIKNQPTTINVCHIGSLNSSIVHPREVLKPAIISNAASIIVAHNHPSNDPTPSSEDLEVTKRLIEAGKVVGIEVLDHLIVCEESFVSLKEK

SEQ ID NO: 735 - protein, 140 aa, Clostridium perfringens
MKKIDVVKVYVKKEQSLQIEKDIIKKPEQVFEVVKNFLGEVDREYLIVIVLDVKNKINSISVASVGTLNSSIVHPREVFKTAILANGASIILAHNHPSGDTSPSKDDINITTRIKECGVLMGIELLDHVILGDEKFISLK

SEQ ID NO: 736 - protein, 140 aa, Listeria monocytogenes
LEVVRIEQIIREAEEGVDYIIRSPEDGAKIASRFIGRDDREVFFVMCLNTKNNVVAVHRCHVGSLNSSIVHPREVFKSAILNNVASVILAHQHPSGDIKPSMEDINVTKRLVEAGKLLGIEVLDHLIVNSDNSFTSLKER

SEQ ID NO: 737 - protein, 138 aa, Pelotomaculum thermopropionicum
LKIVKEASVLYAARRISSPDDAAGFVRDFIEDADREKFLIICLNTRNEPTAVHTVAVGTLNSSQVHPREVFKVALLANSAGIILAHNHPSGDPAPSREDIEITRRLKECGDLLGISVLDHIVIGSGGQYTSLLQKLLI

SEQ ID NO: 738 - protein, 123 aa, Desulfotomaculum reducens
IIRCPEDVCGLVMEDLRDLDREHFLALLLNTKNQVLARETISIGTLNSSVVHPRELFKVAIRRSAASMILVHNHPSGDPTPSREDIVLTKRLIEAGEIIGIDVLDHIIIGDNKFTSLKSKGLI

SEQ ID NO: 739 - protein, 155 aa, Artificial
  Alicyclobacillus acidocaldarius mutated SEQ ID NO 732
MEVGRKSNMSSITVVRVELVKERSIEYEGSRLIRCAEDAANILRGYIGNADREMFVVMVLSAKHIVNAINTVSLGILDSSIVHPREVFKPAILSNAASVIVGHNHPSGDPEPSPEDVAVTRRLVDAGKILGIDVLDHIVIGDEGRFVSLKARELL

SEQ ID NO: 740 - protein, 155 aa, Artificial
  Alicyclobacillus acidocaldarius mutated SEQ ID NO 732
MEVGRKSNMSSITVVRVELVKERSLEYEGSRLIRCAEDAANILRGYIGNADREMFVVMVLSAKHIVQAINTVSLGILDSSIVHPREVFKPAILSNAASVIVGHNHPSGDPEPSPEDVAVTRRLVDAGKILGIDVLDHIVIGDEGRFVSLKARELL

SEQ ID NO: 741 - protein, 155 aa, Artificial
  Alicyclobacillus acidocaldarius mutated SEQ ID NO 732
MEVGRKSNMSSITVVRVELVKERSLEYEGSRLIRCAEDAANILRGYIGNADREMFVVMVLSAKHIVNAINTVSLGILDSSIVHPREVFKPAILSNAASVIVGHNHPSGDPEPSPEDVAVTRRLVDAGKILGIDVLDHIVIGEEGRFVSLKARELL

SEQ ID NO: 742 - protein, 155 aa, Artificial
  Alicyclobacillus acidocaldarius mutated SEQ ID NO 732
MEVGRKSNMSSITVVRVELVKERSLEYEGSRLIRCAEDAANIIRGYIGNADREMFVVMVLSAKHIVNAINTVSLGILDSSIVHPREVFKPAILSNAASVIVGHNHPSGDPEPSPEDVAVTRRLVDAGKILGIDVLDHIVIGDEGRFVSLKARELL

SEQ ID NO: 743 - protein, 155 aa, Artificial
  Alicyclobacillus acidocaldarius mutated SEQ ID NO 732
MEVGRKSNMSSITVVRVELVKDRSLEYEGSRLIRCAEDAANILRGYIGNADREMFVVMVLSAKHIVNAINTVSLGILDSSIVHPREVFKPAILSNAASVIVGHNHPSGDPEPSPEDVAVTRRLVDAGKILGIDVLDHIVIGDEGRFVSLKARELL

SEQ ID NO: 744 - DNA, 468 bp, Artificial
  Alicyclobacillus acidocaldarius mutated SEQ ID NO 733
gtggaggtcgggaggaaatcaaacatgtcatccatcaccgtcgtccgggtagaactcgtcaaggaacgatcaattgaatatgaaggttcgcggctaatccggtgcgccgaagacgcagcaaacatccttcgaggttacatcggcaacgcggatcgtgaaatgttcgtagtgatggtcttatcagccaagcacatcgtcaacgcgatcaacaccgttagtctcgggatacttgactcctctatcgtgcatccacgggaagtatttaaacccgcgattctgagcaatgctgcatcggtgatcgtgggacacaatcatccaagcggggatcccgagccaagtccagaagacgtggcagtgacgcgccgacttgtggatgcgggaaaaattctaggcattgatgttttggatcacattgtcatcggagacgaaggacggttcgtcagtctcaaggcaagagaattgctctga

SEQ ID NO: 745 - DNA, 468 bp, Artificial
  Alicyclobacillus acidocaldarius mutated SEQ ID NO 733
gtggaggtcgggaggaaatcaaacatgtcatccatcaccgtcgtccgggtagaactcgtcaaggaacgatcacttgaatatgaaggttcgcggctaatccggtgcgccgaagacgcagcaaacatccttcgaggttacatcggcaacgcggatcgtgaaatgttcgtagtgatggtcttatcagccaagcacatcgtccaagcgatcaacaccgttagtctcgggatacttgactcctctatcgtgcatccacgggaagtatttaaacccgcgattctgagcaatgctgcatcggtgatcgtgggacacaatcatccaagcggggatcccgagccaagtccagaagacgtggcagtgacgcgccgacttgtggatgcgggaaaaattctaggcattgatgttttggatcacattgtcatcggagacgaaggacggttcgtcagtctcaaggcaagagaattgctctga

SEQ ID NO: 746 - DNA, 468 bp, Artificial
  Alicyclobacillus acidocaldarius mutated SEQ ID NO 733
gtggaggtcgggaggaaatcaaacatgtcatccatcaccgtcgtccgggtagaactcgtcaaggaacgatcacttgaatatgaaggttcgcggctaatccggtgcgccgaagacgcagcaaacatccttcgaggttacatcggcaacgcggatcgtgaaatgttcgtagtgatggtcttatcagccaagcacatcgtcaacgcgatcaacaccgttagtctcgggatacttgactcctctatcgtgcatccacgggaagtatttaaacccgcgattctgagcaatgctgcatcggtgatcgtgggacacaatcatccaagcggggatcccgagccaagtccagaagacgtggcagtgacgcgccgacttgtggatgcgggaaaaattctaggcattgatgttttggatcacattgtcatcggagaagaaggacggttcgtcagtctcaaggcaagagaattgctctga

SEQ ID NO: 747 - DNA, 468 bp, Artificial
  Alicyclobacillus acidocaldarius mutated SEQ ID NO 733
gtggaggtcgggaggaaatcaaacatgtcatccatcaccgtcgtccgggtagaactcgtcaaggaacgatcacttgaatatgaaggttcgcggctaatccggtgcgccgaagacgcagcaaacatcattcgaggttacatcggcaacgcggatcgtgaaatgttcgtagtgatggtcttatcagccaagcacatcgtcaacgcgatcaacaccgttagtctcgggatacttgactcctctatcgtgcatccacgggaagtatttaaacccgcgattctgagcaatgctgcatcggtgatcgtgggacacaatcatccaagcggggatcccgagccaagtccagaagacgtggcagtgacgcgccgacttgtggatgcgggaaaaattctaggcattgatgttttggatcacattgtcatcggagacgaaggacggttcgtcagtctcaaggcaagagaattgctctga

SEQ ID NO: 748 - DNA, 468 bp, Artificial
  Alicyclobacillus acidocaldarius mutated SEQ ID NO 733
gtggaggtcgggaggaaatcaaacatgtcatccatcaccgtcgtccgggtagaactcgtcaaggatcgatcacttgaatatgaaggttcgcggctaatccggtgcgccgaagacgcagcaaacatccttcgaggttacatcggcaacgcggatcgtgaaatgttcgtagtgatggtcttatcagccaagcacatcgtcaacgcgatcaacaccgttagtctcgggatacttgactcctctatcgtgcatccacgggaagtatttaaacccgcgattctgagcaatgctgcatcggtgatcgtgggacacaatcatccaagcggggatcccgagccaagtccagaagacgtggcagtgacgcgccgacttgtggatgcgggaaaaattctaggcattgatgttttggatcacattgtcatcggagacgaaggacggttcgtcagtctcaaggcaagagaattgctctga

SEQ ID NO: 749 - protein, 391 aa, Alicyclobacillus acidocaldarius
MKATFRHGDLEKILRQLLRVVPNSTNKAVLKHVLIEAKREEDRVDFYASSEDMSLRRTLCVEATDSSVEIARSGSCLLPAKELYEVIKRANGPITVETTTDRTVITFGKTKFELVGLQPRLFQPYGDADDEVTTATVLAPHLYRLIRRTSYAAGKSQTRPILTGVQLTLADGHLSAVATDALRLAQYTVSCEDVNGEDRQLVIPAVLLDTLATALPASDDDEEVTFTLGTSSCTVSWGDDAFHMALRGLEGTYPDTARLIPERTAHRVVVERQALLTACERVAILSEADHQRAEFRFTMSGLTVSATSTQYGHAEETLETIQGTKDDVELLCNVHYWIAALKALDGIAQVEIGLNGPLQPCLLRPVGEEGVGLIATVARSSAPTETKRQAS

SEQ ID NO: 750 - DNA, 1176 bp, Alicyclobacillus acidocaldarius
atgaaagcgacctttcgccatggagatctcgagaaaattctgcgccagctgcttcgcgtggtgccgaattcgacgaacaaggccgtcctcaagcacgtgctgattgaggccaagcgagaggaagatcgcgtggatttctacgcttccagcgaggacatgtcccttcgacgcacgctctgcgtcgaagcgacggactcgagcgtagagattgcgcggtctggttcgtgtttgctcccagcgaaggagctgtacgaggtaatcaaacgggctaatggccctatcacagtagagaccactacagaccgcacggtcatcacgtttggcaagaccaagttcgagcttgtgggtttgcagccacgtctctttcagccttacggtgatgcagatgacgaggtgaccaccgccacggtgctcgcaccgcatctgtatcgactgattcgacgaacgagctacgctgcaggcaaaagtcagacacgacccattctcacgggcgtgcagcttaccttggcggacggacatctgtcggcggtggcgaccgacgcgcttcgcttggcgcaatacaccgtgtcttgcgaagacgtgaacggcgaggaccgacagctggtgatcccagcggtcttgctcgacacactggccacggcgttgcccgcatcggatgacgatgaagaagtcaccttcacccttggcacctcgtcatgcacggtgtcgtggggagatgatgcctttcacatggcgcttcgaggcttggaaggcacgtatccagataccgcgcgactgattccagagcgcacagcccatcgcgtggtggtcgagcgccaggcgcttcttacggcttgtgaacgtgtggcgattctgtccgaagcggaccatcagcgagccgagtttcggtttacgatgtccggcctcactgtgtccgccacgtcgacgcaatacggtcacgccgaggaaaccctggagacgatccaaggcacgaaggacgatgtggagctcctgtgcaacgtgcactattggatcgcggcgctcaaggcgttagacgggatcgcacaggttgaaatcgggctcaacgggccgttacagccgtgtcttctgcgtcctgtcggtgaagaaggggtaggccttatcgcaacagtggcccgctcctcggcgcctacggaaaccaagcgccaagctagctaa

SEQ ID NO: 751 - protein, 373 aa, Lactobacillus plantarum
MKFTINRSAFIKELNNVQRAISSKTTIPILTGLKLDVNTDAITLTGSDADISIETTIPASDDNNTLVVEDAGSIVLPARFFSEIVKKLPEDTMTVNVVDGFQTQITSGAASFTINGLDPENYPHLPEIDTTNTITLAGDVLKELIGQTVIAVSNQESRPILTGVHFILANGEFLAVATDSHRLSQRRIKLPEANNANYDVIIPGKSLTELSRMIGDNNPDVQMRLSENQVLFVLGNTSFYSRLLEGNYPDTSRLIPKESNTTVEISAPALSAAIERASLLSHESRNNVVRFSVNPTDKTITIFGNSPDVGEVTEQLQPTDLSGDELEISFNPDYMKEALRSFGQAMIKISFTMALRPFTLVPTEEGENFIQLI

SEQ ID NO: 752 - protein, 366 aa, Lactobacillus casei
MKFTITRSTFLKTLNDVSRAISTKTTIPILTGLKIVLNDSGLILTGSDADISIESRINATDENNDLQIGSTGEIVLPARFFSEIVKRLPESTMTLEVKDNFQTVITSGASEFTINGLDANNYPRLPEITADAALSVSADVLRQLINQTVIAVSNQESRPILTGVHLTITGDQLVAVATDSHRLAQRSLTLPTASASDYDIIIPGKSLTELSRMLSDDVEKIEIRIAENQVLFVFGQTAFYSRLLEGNYPDTSRLIPTSSNTQAEFDAPALLASIQRASLLSHESSNNVVRLVLNIADQKATIYGNSPDVGNVEEVLSFNKLSGEDLEISFNPDYMKDALQGFGQTAIEVDFTAPLRPFTLVPTEDK

SEQ ID NO: 753 - protein, 354 aa, Lactobacillus reuteri
LNNVLRAISSKTTIPILTGLKMVVNEDNIVLTGSNSDITIESVINANDADNDLTIEDTGAIVLPARFFSDIVKKLPDKKVTIEVTSGFQADITSGSAKFQINGQDAENFPHLPEIETNKSVTLPNDILKEVIRQTVIAVSKQESRPILAGVHMTLKDGILTAVATDSHRLAQRKVVLENIDNGIDFDVIIPGKSMEELSGMISDVHEDVQMQVTENQVLFIFGNTHFYSRLLEGNYPETSQLIPQTADTTVELEAGTFLSSIERASLLSHESRNDVVKLSLKPSENLVRISGDSPDIGTVEEEVVTSALDGNDLEISFNPNYMKDALRSFGQATIKISFTSPLRPFTLVPTEDQ

SEQ ID NO: 754 - protein, 366 aa, Pediococcus pentosaceus
MKFTIARNTFIKKLNAVQRAISSKTTIPILTGLKIEAEEDRLILTGSNTDISIETTISTNDEEAHLNIESTGAVVLTARFFGDIVKKLPDNTMLLEVKDGFQTTITSGASEFKINGLDANNFPHLPEVDSQTTITLKADVFSEMINETVIAVSNQESRPILTGIHFTIEGNKLSAVATDSHRLSQRVINLPEPIKMPEDIIIPGKSLLELSRMLDDEIDTITLQISENQALFTFDETLFYSRLLEGLYPDTSRLIPKESSTEMEFEAPELLASIERASLLSHAGRNNVVKLTINAANKQAIISGDSPEVGNVEEEVVTKDIVGEDLEISFNPDYLKDALRSFGHTSIKMAFTSALRPFTLVPTEDQ

SEQ ID NO: 755 - protein, 354 aa, Lactobacillus reuteri
LNNVLRAISSKTTIPILTGLKMVVNEDNIVLTGSNSDITIESVINANDADNDLTIEETGAIVLPARFFSDIVKKLPDKKVTIEVTSGFQADITSGSAKFQINGQDAENFPHLPEIETNKSVTLPNDILKEVIRQTVIAVSKQESRPILAGVHMMLKDGVLTAVATDSHRLAQRKVVLENIDNGIDFDVIIPGKSMEELSGMISDVHEDVQMQVTENQVLFIFGNTHFYSRLLEGNYPETSQLIPQTADTTVELEAGTFLSSIERASLLSHESRNDVVKLSLKPSENLVRISGDSPDIGTVEEEVVTSALDGNDLEISFNPNYMKDALRSFGQATIKISFTSPLRPFTLVPTEDQ

SEQ ID NO: 756 - protein, 391 aa, Artificial
  Alicyclobacillus acidocaldarius mutated SEQ ID NO 749
MKATFRHGDLEKILRQLLRVVPNSTNKAVLKHVLIEAKREEDRVDFYASSEDMSLRRTLCVEATDSSVEIARSGSCLLPAKELYEVIKRANGPITVETTTDRTVITFGKTKFELVGLQPRLFQPYGDAEDEVTTATVLAPHLYRLIRRTSYAAGKSQTRPILTGVQLTLADGHLSAVATDALRLAQYTVSCEDVNGEDRQLVIPAVLLDTLATALPASDDDEEVTFTLGTSSCTVSWGDDAFHMALRGLEGTYPDTARLIPERTAHRVVVERQALLTACERVAILSEADHQRAEFRFTMSGLTVSATSTQYGHAEETLETIQGTKDDVELLCNVHYWIAALKALDGIAQVEIGLNGPLQPCLLRPVGEEGVGLIATVARSSAPTETKRQAS

SEQ ID NO: 757 - protein, 391 aa, Artificial
  Alicyclobacillus acidocaldarius mutated SEQ ID NO 749
MKATFRHGDLEKILRQLLRVVPNSTNKAVLKHVLIEAKREEDRVDFYASSEDMSLRRTLCVEATDSSVEIARSGSCLLPAKELYEVIKRANGPITVETTTDRTVITFGKTKFELVGLQPRLFQPYGDADDEVTTATVLAPHLYRLIRRTSYAAGKSQTRPILTGVQLTLADGHLSAVATDALRLAQYTVSCEDVNGEDRQLVIPAVLLDTLATALPASDDDEEVTFTLGTSSCTVSWGDDAFHMALRGLEGTYPDTARLIPERTAHRVVVERQALLTACERVAILSEADHQRAEFRFTMSGLTVSATSTQYGHAEETLETIQGTKDDVELLCNVHYWIAALKALDGIAQVEIGLNGPLQPCLLRPVGEEGVGLIATVARSSAPTETKRNAS

SEQ ID NO: 758 - protein, 391 aa, Artificial
  Alicyclobacillus acidocaldarius mutated SEQ ID NO 749
MKATFRHGDLERILRQLLRVVPNSTNKAVLKHVLIEAKREEDRVDFYASSEDMSLRRTLCVEATDSSVEIARSGSCLLPAKELYEVIKRANGPITVETTTDRTVITFGKTKFELVGLQPRLFQPYGDADDEVTTATVLAPHLYRLIRRTSYAAGKSQTRPILTGVQLTLADGHLSAVATDALRLAQYTVSCEDVNGEDRQLVIPAVLLDTLATALPASDDDEEVTFTLGTSSCTVSWGDDAFHMALRGLEGTYPDTARLIPERTAHRVVVERQALLTACERVAILSEADHQRAEFRFTMSGLTVSATSTQYGHAEETLETIQGTKDDVELLCNVHYWIAALKALDGIAQVEIGLNGPLQPCLLRPVGEEGVGLIATVARSSAPTETKRQAS

SEQ ID NO: 759 - protein, 391 aa, Artificial
  Alicyclobacillus acidocaldarius mutated SEQ ID NO 749
MKATFRHGDLEKILRQLLRVVPNSTNKAVLKHVLIEAKREEDRVDFYASSEDMSLRRTLCVEATDSSVEIARSGSCLLPAKELYEVIKRANGPITVETTTDRTVITFGKTKFELVGLQPRLFQPYGDADDEVTTATVLAPHLYRLIRRTSYAAGKSQTRPILTGVQLTLADGHLSAVATDALRLAQYTVSCEDVNGEDRQLVIPAVLLDTLATALPASDDDEEVTFTLGTSSCTVSWGDDAFHMALRGLEGTYPDTARLIPERTAHRVVVERQALLTACERVAILSEADHQRAEFRFTMSGLTVSATSTQYGHAEETLETIQGTKDDVELICNVHYWIAALKALDGIAQVEIGLNGPLQPCLLRPVGEEGVGLIATVARSSAPTETKRQAS

SEQ ID NO: 760 - protein, 391 aa, Artificial
  Alicyclobacillus acidocaldarius mutated SEQ ID NO 749
MKATFRHGDLEKILRQLLRVVPNSTNKAVLKHVLIEAKREEDRVDFYASSEDMSLRRTLCVEATDSSVEIARSGSCLLPAKELYEVIKRANGPITVETTTDRTVITFGKTKFELVGLQPRLFQPYGDADDEVTTATVLAPHLYRLIRRTSYAAGKSQTRPILTGVQLTLADGHLSAVATDALRLAQYTVSCEDVQGEDRQLVIPAVLLDTLATALPASDDDEEVTFTLGTSSCTVSWGDDAFHMALRGLEGTYPDTARLIPERTAHRVVVERQALLTACERVAILSEADHQRAEFRFTMSGLTVSATSTQYGHAEETLETIQGTKDDVELLCNVHYWIAALKALDGIAQVEIGLNGPLQPCLLRPVGEEGVGLIATVARSSAPTETKRQAS

SEQ ID NO: 761 - DNA, 1176 bp, Artificial
  Alicyclobacillus acidocaldarius mutated SEQ ID NO 750
atgaaagcgacctttcgccatggagatctcgagaaaattctgcgccagctgcttcgcgtggtgccgaattcgacgaacaaggccgtcctcaagcacgtgctgattgaggccaagcgagaggaagatcgcgtggatttctacgcttccagcgaggacatgtcccttcgacgcacgctctgcgtcgaagcgacggactcgagcgtagagattgcgcggtctggttcgtgtttgctcccagcgaaggagctgtacgaggtaatcaaacgggctaatggccctatcacagtagagaccactacagaccgcacggtcatcacgtttggcaagaccaagttcgagcttgtgggtttgcagccacgtctctttcagccttacggtgatgcagaagacgaggtgaccaccgccacggtgctcgcaccgcatctgtatcgactgattcgacgaacgagctacgctgcaggcaaaagtcagacacgacccattctcacgggcgtgcagcttaccttggcggacggacatctgtcggcggtggcgaccgacgcgcttcgcttggcgcaatacaccgtgtcttgcgaagacgtgaacggcgaggaccgacagctggtgatcccagcggtcttgctcgacacactggccacggcgttgcccgcatcggatgacgatgaagaagtcaccttcacccttggcacctcgtcatgcacggtgtcgtggggagatgatgcctttcacatggcgcttcgaggcttggaaggcacgtatccagataccgcgcgactgattccagagcgcacagcccatcgcgtggtggtcgagcgccaggcgcttcttacggcttgtgaacgtgtggcgattctgtccgaagcggaccatcagcgagccgagtttcggtttacgatgtccggcctcactgtgtccgccacgtcgacgcaatacggtcacgccgaggaaaccctggagacgatccaaggcacgaaggacgatgtggagctcctgtgcaacgtgcactattggatcgcggcgctcaaggcgttagacgggatcgcacaggttgaaatcgggctcaacgggccgttacagccgtgtcttctgcgtcctgtcggtgaagaaggggtaggccttatcgcaacagtggcccgctcctcggcgcctacggaaaccaagcgccaagctagctaa

SEQ ID NO: 762 - DNA, 1176 bp, Artificial
  Alicyclobacillus acidocaldarius mutated SEQ ID NO 750
atgaaagcgacctttcgccatggagatctcgagaaaattctgcgccagctgcttcgcgtggtgccgaattcgacgaacaaggccgtcctcaagcacgtgctgattgaggccaagcgagaggaagatcgcgtggatttctacgcttccagcgaggacatgtcccttcgacgcacgctctgcgtcgaagcgacggactcgagcgtagagattgcgcggtctggttcgtgtttgctcccagcgaaggagctgtacgaggtaatcaaacgggctaatggccctatcacagtagagaccactacagaccgcacggtcatcacgtttggcaagaccaagttcgagcttgtgggtttgcagccacgtctctttcagccttacggtgatgcagatgacgaggtgaccaccgccacggtgctcgcaccgcatctgtatcgactgattcgacgaacgagctacgctgcaggcaaaagtcagacacgacccattctcacgggcgtgcagcttaccttggcggacggacatctgtcggcggtggcgaccgacgcgcttcgcttggcgcaatacaccgtgtcttgcgaagacgtgaacggcgaggaccgacagctggtgatcccagcggtcttgctcgacacactggccacggcgttgcccgcatcggatgacgatgaagaagtcaccttcacccttggcacctcgtcatgcacggtgtcgtggggagatgatgcctttcacatggcgcttcgaggcttggaaggcacgtatccagataccgcgcgactgattccagagcgcacagcccatcgcgtggtggtcgagcgccaggcgcttcttacggcttgtgaacgtgtggcgattctgtccgaagcggaccatcagcgagccgagtttcggtttacgatgtccggcctcactgtgtccgccacgtcgacgcaatacggtcacgccgaggaaaccctggagacgatccaaggcacgaaggacgatgtggagctcctgtgcaacgtgcactattggatcgcggcgctcaaggcgttagacgggatcgcacaggttgaaatcgggctcaacgggccgttacagccgtgtcttctgcgtcctgtcggtgaagaaggggtaggccttatcgcaacagtggcccgctcctcggcgcctacggaaaccaagcgcaatgctagctaa

SEQ ID NO: 763 - DNA, 1176 bp, Artificial
  Alicyclobacillus acidocaldarius mutated SEQ ID NO 750
atgaaagcgacctttcgccatggagatctcgagcgtattctgcgccagctgcttcgcgtggtgccgaattcgacgaacaaggccgtcctcaagcacgtgctgattgaggccaagcgagaggaagatcgcgtggatttctacgcttccagcgaggacatgtcccttcgacgcacgctctgcgtcgaagcgacggactcgagcgtagagattgcgcggtctggttcgtgtttgctcccagcgaaggagctgtacgaggtaatcaaacgggctaatggccctatcacagtagagaccactacagaccgcacggtcatcacgtttggcaagaccaagttcgagcttgtgggtttgcagccacgtctctttcagccttacggtgatgcagatgacgaggtgaccaccgccacggtgctcgcaccgcatctgtatcgactgattcgacgaacgagctacgctgcaggcaaaagtcagacacgacccattctcacgggcgtgcagcttaccttggcggacggacatctgtcggcggtggcgaccgacgcgcttcgcttggcgcaatacaccgtgtcttgcgaagacgtgaacggcgaggaccgacagctggtgatcccagcggtcttgctcgacacactggccacggcgttgcccgcatcggatgacgatgaagaagtcaccttcacccttggcacctcgtcatgcacggtgtcgtggggagatgatgcctttcacatggcgcttcgaggcttggaaggcacgtatccagataccgcgcgactgattccagagcgcacagcccatcgcgtggtggtcgagcgccaggcgcttcttacggcttgtgaacgtgtggcgattctgtccgaagcggaccatcagcgagccgagtttcggtttacgatgtccggcctcactgtgtccgccacgtcgacgcaatacggtcacgccgaggaaaccctggagacgatccaaggcacgaaggacgatgtggagctcctgtgcaacgtgcactattggatcgcggcgctcaaggcgttagacgggatcgcacaggttgaaatcgggctcaacgggccgttacagccgtgtcttctgcgtcctgtcggtgaagaaggggtaggccttatcgcaacagtggcccgctcctcggcgcctacggaaaccaagcgccaagctagctaa

SEQ ID NO: 764 - DNA, 1176 bp, Artificial
  Alicyclobacillus acidocaldarius mutated SEQ ID NO 750
atgaaagcgacctttcgccatggagatctcgagaaaattctgcgccagctgcttcgcgtggtgccgaattcgacgaacaaggccgtcctcaagcacgtgctgattgaggccaagcgagaggaagatcgcgtggatttctacgcttccagcgaggacatgtcccttcgacgcacgctctgcgtcgaagcgacggactcgagcgtagagattgcgcggtctggttcgtgtttgctcccagcgaaggagctgtacgaggtaatcaaacgggctaatggccctatcacagtagagaccactacagaccgcacggtcatcacgtttggcaagaccaagttcgagcttgtgggtttgcagccacgtctctttcagccttacggtgatgcagatgacgaggtgaccaccgccacggtgctcgcaccgcatctgtatcgactgattcgacgaacgagctacgctgcaggcaaaagtcagacacgacccattctcacgggcgtgcagcttaccttggcggacggacatctgtcggcggtggcgaccgacgcgcttcgcttggcgcaatacaccgtgtcttgcgaagacgtgaacggcgaggaccgacagctggtgatcccagcggtcttgctcgacacactggccacggcgttgcccgcatcggatgacgatgaagaagtcaccttcacccttggcacctcgtcatgcacggtgtcgtggggagatgatgcctttcacatggcgcttcgaggcttggaaggcacgtatccagataccgcgcgactgattccagagcgcacagcccatcgcgtggtggtcgagcgccaggcgcttcttacggcttgtgaacgtgtggcgattctgtccgaagcggaccatcagcgagccgagtttcggtttacgatgtccggcctcactgtgtccgccacgtcgacgcaatacggtcacgccgaggaaaccctggagacgatccaaggcacgaaggacgatgtggagctcatttgcaacgtgcactattggatcgcggcgctcaaggcgttagacgggatcgcacaggttgaaatcgggctcaacgggccgttacagccgtgtcttctgcgtcctgtcggtgaagaaggggtaggccttatcgcaacagtggcccgctcctcggcgcctacggaaaccaagcgccaagctagctaa

SEQ ID NO: 765 - DNA, 1176 bp, Artificial
  Alicyclobacillus acidocaldarius mutated SEQ ID NO 750
atgaaagcgacctttcgccatggagatctcgagaaaattctgcgccagctgcttcgcgtggtgccgaattcgacgaacaaggccgtcctcaagcacgtgctgattgaggccaagcgagaggaagatcgcgtggatttctacgcttccagcgaggacatgtcccttcgacgcacgctctgcgtcgaagcgacggactcgagcgtagagattgcgcggtctggttcgtgtttgctcccagcgaaggagctgtacgaggtaatcaaacgggctaatggccctatcacagtagagaccactacagaccgcacggtcatcacgtttggcaagaccaagttcgagcttgtgggtttgcagccacgtctctttcagccttacggtgatgcagatgacgaggtgaccaccgccacggtgctcgcaccgcatctgtatcgactgattcgacgaacgagctacgctgcaggcaaaagtcagacacgacccattctcacgggcgtgcagcttaccttggcggacggacatctgtcggcggtggcgaccgacgcgcttcgcttggcgcaatacaccgtgtcttgcgaagacgtgcaaggcgaggaccgacagctggtgatcccagcggtcttgctcgacacactggccacggcgttgcccgcatcggatgacgatgaagaagtcaccttcacccttggcacctcgtcatgcacggtgtcgtggggagatgatgcctttcacatggcgcttcgaggcttggaaggcacgtatccagataccgcgcgactgattccagagcgcacagcccatcgcgtggtggtcgagcgccaggcgcttcttacggcttgtgaacgtgtggcgattctgtccgaagcggaccatcagcgagccgagtttcggtttacgatgtccggcctcactgtgtccgccacgtcgacgcaatacggtcacgccgaggaaaccctggagacgatccaaggcacgaaggacgatgtggagctcctgtgcaacgtgcactattggatcgcggcgctcaaggcgttagacgggatcgcacaggttgaaatcgggctcaacgggccgttacagccgtgtcttctgcgtcctgtcggtgaagaaggggtaggccttatcgcaacagtggcccgctcctcggcgcctacggaaaccaagcgccaagctagctaa

SEQ ID NO: 766 - protein, 163 aa, Alicyclobacillus acidocaldarius
MKWILMALSLVVLQFWTHEQVLNLEMETVVYHRIVNAMVLASQDAVEDVIPSSTANGEPIFDQTEAAQTFRMTLANNLGLDPNTLQPLSNSTFHVAPKILDEEFYDWSNTTFPYHYVNSAYGINETLDAPSMVVVVQFTMPSYAANVPPFTITVPMVQSYAGS

SEQ ID NO: 767 - DNA, 492 bp, Alicyclobacillus acidocaldarius
atgaagtggatcttgatggccttatcccttgtcgtgttgcagttttggacgcatgagcaggtgctgaacttggagatggagacggtggtgtatcaccgcatcgtgaatgcgatggtgctcgcgagtcaggacgcggtggaggacgtgattccgtccagcacggcaaatggtgaaccgatatttgaccagaccgaggcagcccagacgttccggatgacgcttgcgaacaaccttggcctggatccaaacacgctccagccattgtcgaattcgacgttccatgttgcgccgaagatcctggacgaggagttctacgactggagcaatacgacgttcccgtaccactacgtcaacagcgcgtatgggatcaacgagacgctagacgcgccttcgatggtcgtggtggtgcagttcacgatgccgagttacgcggcgaatgttccaccattcacgattacggtgccaatggtgcagagttatgctggctcgtag

SEQ ID NO: 768 - protein, 122 aa, Bacillus  NRRL B-14911
LNFTFDSTATRGLRDSLELATHDAGLQIYNEELVNGNIVFDQSEARRVLEESLKKNLLLDASLQPKPDSFFQDTVQIKFVDYLDDNNTPEFPTNYINEQYDIVDTVDGPAIVVVLETTGPRY

SEQ ID NO: 769 - protein, 115 aa, Bacillus cereus
LTLNMNIATYAKSSKYLKEDLEVAVHDASLELKKDELANGKLVFDPIKAKQTFKESLKDNTGFQEGTDYKILEFQVLDQSNSKFPVKYKANTLKFQDTFQNPTLVAIIETTTKKY

SEQ ID NO: 770 - protein, 64 aa, Moorella thermoacetica
VQRALEMAVRAAAMQVTPDSQAAGHPRINIVAANIAFRRELASNLGLDANTLAPLKGSAMKTRP

SEQ ID NO: 771 - protein, 51 aa, Desulfotomaculum reducens
AAKSAVMQVTKESQADGRPRINTTNAQAVFQQQLAKNLGLDETTLNPLSGS

SEQ ID NO: 772 - protein, 55 aa, Desulfotomaculum reducens
ALALAARSAAGQVVPVSNASNNPRVHADNAHSTFKKILAKNLGLDEVTLNPLPGS

SEQ ID NO: 773 - protein, 163 aa, Artificial
  Alicyclobacillus acidocaldarius mutated SEQ ID NO 766
MKWILMALSLVVLQFWTHEQVLNLEMETVVYHRIVNAMVLASQDAVEDVIPSSTANGEPIFDQTEAAQTFRMTLANNLGLDPNTLQPLSNSTFHVAPKILDEEFYDWSNTTFPYHYVNSAYGINETLDAPSMVIVVQFTMPSYAANVPPFTITVPMVQSYAGS

SEQ ID NO: 774 - protein, 163 aa, Artificial
  Alicyclobacillus acidocaldarius mutated SEQ ID NO 766
MKWILMALSLVVLQFWTHEQVLNIEMETVVYHRIVNAMVLASQDAVEDVIPSSTANGEPIFDQTEAAQTFRMTLANNLGLDPNTLQPLSNSTFHVAPKILDEEFYDWSNTTFPYHYVNSAYGINETLDAPSMVVVVQFTMPSYAANVPPFTITVPMVQSYAGS

SEQ ID NO: 775 - protein, 163 aa, Artificial
  Alicyclobacillus acidocaldarius mutated SEQ ID NO 766
MKWILMALSLVVLQFWTHEQVLNLEMETVVYHRIVNAMVLASQDAVEDVIPSSTANGEPIFDQTEAAQTFRMTLANNLGLDPNTLQPLSNSTFHVAPKILDEEFYEWSNTTFPYHYVNSAYGINETLDAPSMVVVVQFTMPSYAANVPPFTITVPMVQSYAGS

SEQ ID NO: 776 - protein, 163 aa, Artificial
  Alicyclobacillus acidocaldarius mutated SEQ ID NO 766
MKWILMALSLVVLQFWTHEQVLNLEMETVVYHKIVNAMVLASQDAVEDVIPSSTANGEPIFDQTEAAQTFRMTLANNLGLDPNTLQPLSNSTFHVAPKILDEEFYDWSNTTFPYHYVNSAYGINETLDAPSMVVVVQFTMPSYAANVPPFTITVPMVQSYAGS

SEQ ID NO: 777 - protein, 163 aa, Artificial
  Alicyclobacillus acidocaldarius mutated SEQ ID NO 766
MKWILMALSLVVLQFWTHEQVLNLEMETVVYHRIVNAMVLASQDAVEDVIPSSTANGEPIFDQTEAAQTFRMTLANNLGLDPNTLQPLSNSTFHVAPKILDEEFYDWSNTTFPYHYINSAYGINETLDAPSMVVVVQFTMPSYAANVPPFTITVPMVQSYAGS

SEQ ID NO: 778 - DNA, 492 bp, Artificial
  Alicyclobacillus acidocaldarius mutated SEQ ID NO 767
atgaagtggatcttgatggccttatcccttgtcgtgttgcagttttggacgcatgagcaggtgctgaacttggagatggagacggtggtgtatcaccgcatcgtgaatgcgatggtgctcgcgagtcaggacgcggtggaggacgtgattccgtccagcacggcaaatggtgaaccgatatttgaccagaccgaggcagcccagacgttccggatgacgcttgcgaacaaccttggcctggatccaaacacgctccagccattgtcgaattcgacgttccatgttgcgccgaagatcctggacgaggagttctacgactggagcaatacgacgttcccgtaccactacgtcaacagcgcgtatgggatcaacgagacgctagacgcgccttcgatggtcattgtggtgcagttcacgatgccgagttacgcggcgaatgttccaccattcacgattacggtgccaatggtgcagagttatgctggctcgtag

SEQ ID NO: 779 - DNA, 492 bp, Artificial
  Alicyclobacillus acidocaldarius mutated SEQ ID NO 767
atgaagtggatcttgatggccttatcccttgtcgtgttgcagttttggacgcatgagcaggtgctgaacattgagatggagacggtggtgtatcaccgcatcgtgaatgcgatggtgctcgcgagtcaggacgcggtggaggacgtgattccgtccagcacggcaaatggtgaaccgatatttgaccagaccgaggcagcccagacgttccggatgacgcttgcgaacaaccttggcctggatccaaacacgctccagccattgtcgaattcgacgttccatgttgcgccgaagatcctggacgaggagttctacgactggagcaatacgacgttcccgtaccactacgtcaacagcgcgtatgggatcaacgagacgctagacgcgccttcgatggtcgtggtggtgcagttcacgatgccgagttacgcggcgaatgttccaccattcacgattacggtgccaatggtgcagagttatgctggctcgtag

SEQ ID NO: 780 - DNA, 492 bp, Artificial
  Alicyclobacillus acidocaldarius mutated SEQ ID NO 767
atgaagtggatcttgatggccttatcccttgtcgtgttgcagttttggacgcatgagcaggtgctgaacttggagatggagacggtggtgtatcaccgcatcgtgaatgcgatggtgctcgcgagtcaggacgcggtggaggacgtgattccgtccagcacggcaaatggtgaaccgatatttgaccagaccgaggcagcccagacgttccggatgacgcttgcgaacaaccttggcctggatccaaacacgctccagccattgtcgaattcgacgttccatgttgcgccgaagatcctggacgaggagttctacgaatggagcaatacgacgttcccgtaccactacgtcaacagcgcgtatgggatcaacgagacgctagacgcgccttcgatggtcgtggtggtgcagttcacgatgccgagttacgcggcgaatgttccaccattcacgattacggtgccaatggtgcagagttatgctggctcgtag

SEQ ID NO: 781 - DNA, 492 bp, Artificial
  Alicyclobacillus acidocaldarius mutated SEQ ID NO 767
atgaagtggatcttgatggccttatcccttgtcgtgttgcagttttggacgcatgagcaggtgctgaacttggagatggagacggtggtgtatcacaaaatcgtgaatgcgatggtgctcgcgagtcaggacgcggtggaggacgtgattccgtccagcacggcaaatggtgaaccgatatttgaccagaccgaggcagcccagacgttccggatgacgcttgcgaacaaccttggcctggatccaaacacgctccagccattgtcgaattcgacgttccatgttgcgccgaagatcctggacgaggagttctacgactggagcaatacgacgttcccgtaccactacgtcaacagcgcgtatgggatcaacgagacgctagacgcgccttcgatggtcgtggtggtgcagttcacgatgccgagttacgcggcgaatgttccaccattcacgattacggtgccaatggtgcagagttatgctggctcgtag

SEQ ID NO: 782 - DNA, 492 bp, Artificial
  Alicyclobacillus acidocaldarius mutated SEQ ID NO 767
atgaagtggatcttgatggccttatcccttgtcgtgttgcagttttggacgcatgagcaggtgctgaacttggagatggagacggtggtgtatcaccgcatcgtgaatgcgatggtgctcgcgagtcaggacgcggtggaggacgtgattccgtccagcacggcaaatggtgaaccgatatttgaccagaccgaggcagcccagacgttccggatgacgcttgcgaacaaccttggcctggatccaaacacgctccagccattgtcgaattcgacgttccatgttgcgccgaagatcctggacgaggagttctacgactggagcaatacgacgttcccgtaccactacattaacagcgcgtatgggatcaacgagacgctagacgcgccttcgatggtcgtggtggtgcagttcacgatgccgagttacgcggcgaatgttccaccattcacgattacggtgccaatggtgcagagttatgctggctcgtag

SEQ ID NO: 783 - protein, 514 aa, Alicyclobacillus acidocaldarius
MKILSIQLENFRSFTEASFQFHDITVISGHNGAGKSTLAEAVVWCLFGTDIAGRQKQDEKLMRLGEKRMAVTVTWLIHGKSVVISRTRASRQGSTLLVNGKRAQPGQIEGWFGTVQEFLSVFVPGYFSSLEPKEAKTVLSRCVPDIPKEDVLARMTSVHASMLARDQFVMGLDSIEFAMQKVRDEIKECEAERLRLEGQCQAYQAVLRRGEPQPYVPSVTDEERARYEAAKRELMELEASQGNRKERLRDLYARRDSLGRAFRALRDSLPQADTHCHTCGQPLPEDQAARILQEIAQKRKASLAKMKELYDEGNQVQAEIAKLEAMPDYDAPHPELVEFVQTMEARLKDEHYREVAYAAQLRAYEQAKGHFTQAQEDLQATAEHLEGLKQRLQALQEFRFEYLRAQHEQLNGLFRHVAIHLMDVNKETGEVREAFRIEWKGRPYRLLSYSEKIRCDIEIGRALAQAKGEAMPVYVDNAESVQRLMDETFSGQVIAAYVADGPLTVSKMPEAQGA

SEQ ID NO: 784 - DNA, 1545 bp, Alicyclobacillus acidocaldarius
atgaaaatcctcagcattcaactggagaacttccgctcgtttacggaggcctcgttccagttccacgacatcaccgtcatttccggccacaacggcgccgggaaatccacccttgcagaagccgtcgtctggtgtctttttggaaccgatatcgccggcaggcagaaacaagatgaaaagctcatgcgcttgggcgaaaagcggatggcagtcactgtcacgtggctcattcacggcaagtccgttgtcatctcgcgcacgcgcgcatctcgacagggctcgacgctcctcgtgaacggcaaacgcgcacagcccggccaaatcgaaggatggttcggcaccgtgcaggaattcctgtcggtgttcgtccccggctacttcagctccctggagccgaaggaagcgaagaccgtgctttcgcgctgcgtgccagacatcccgaaagaagatgtgctggctcgcatgacgtccgtacacgcgtcgatgcttgcgcgcgatcagtttgtcatggggctcgactcgattgagtttgccatgcagaaggtgcgcgatgagatcaaggaatgcgaagcggaacgcttgcgacttgaagggcaatgccaagcgtatcaggcggttctgcgtcgcggcgaaccgcaaccgtacgtgccaagcgtgacggatgaggaacgcgctcgatatgaggccgcgaaacgggaactcatggagctcgaagcctcgcaggggaaccgaaaggagcgcctgcgcgacctgtacgctcgccgtgactcgcttgggcgagcgtttcgagcacttcgcgatagcctcccacaggcggatacgcactgccatacctgtggtcagccgctcccggaagatcaggcggctcgcatcttgcaagagatcgcgcaaaagcgcaaagcttcgcttgccaagatgaaggagctctacgacgaggggaaccaagtccaggctgagattgcgaagctcgaggctatgccggactacgacgctccacatccggaactcgtggaattcgtgcaaaccatggaagcgcgcctcaaggatgaacactaccgcgaagtggcctatgcggcgcagcttcgcgcgtatgagcaggcgaaggggcacttcacccaagcgcaagaagacttgcaggcgaccgcggagcacctcgaaggtctcaaacagcggcttcaggcactccaagagtttcgcttcgagtacctgcgcgcccaacatgagcagctgaacggcctgttccgccatgttgctatccacctgatggacgtgaacaaggaaacaggcgaggttcgcgaggcgtttcggattgagtggaagggtcggccctatcggctcttgtcctactcggagaagattcgttgcgacatcgagatcggacgcgccctggctcaagccaagggtgaagcgatgcccgtctacgtcgataacgccgaatctgtgcaacgcctgatggacgagacgttcagcggccaggtgatcgcggcgtacgtcgccgacggtccgctcaccgtgtccaagatgccagaagcacagggagcataa

SEQ ID NO: 785 - protein, 520 aa, Thermoanaerobacter tengcongensis
MIIKSITLKNFKSHKNTIINFNDKNTVIYGDNGTGKTSIGEAIAWCLTGANLFGTENVTNKLVTIGKNEMSVTLVIEKDGKEYEITRSKKKNEIEITINGVKSTQIDLYTQFVQDKDIFFTVFNPLYFTTLAPRDAKAILYKVLPEVSNEEVFEKLSPEVAETLKKNGFNNANTFIEKQREILKDWEDGLLKSEGNIEILRQIINAKIPEMKSFDETQLKELEKKLMEFQKNQNIEIEKELAILKEQYKNPPIEKPQLKDTSILQKTREELLQEYKQIQEQIKNLKPQYITCNKCGNKIDVTAKEKQLLLAKLQEIKEKGTKTAAELKAVIEENEKAEKEFKEKVNKYRKALEIKIKRLENALNTNANKEQIQQIMQQIERLRFEEREVISHNESVKALLRQKEEAKKKLKEVEEDIKLAEQQINEVKTLIEYAKAFNAKKLELEATEINKYLNKVSLQLWKIVQSTGEIKDDFKILYDGKEFNILSYSERIKAGLEIANLIMGLTKIKFPIFIDNAESI

SEQ ID NO: 786 - protein, 501 aa, Listeria monocytogenes
MKIVFKQLTLENFKNHKNLVVDYEQVTQISGKNGFGKTSIGEAVTWLLYGTDLLGTKIEPQPLGTEEEVHVSLLINADGKDLLLTKKQKKTAKYAINEVPRKATEFADMIDSLFEKNLFYSLYSPGYFFSQHWQTQREQLLSYVTEPGEKEVLEEMNEIDRTLLSTELNKHLLDDLEAVNRETFKNSDKQYERASERVLTLKEQLSNASEVNMDIKEITEQKDALIAERTAIELKEDKNVQLRNDYADAEQKINALKERILRKREEALNVREQKIEENCEYCGQTLQGDSIEHAIQYRKEHYNRLVTAGKIMVEELEASKARLAKLENPEKNFDRVKYKEIDEKILELSGYIQSVGQTEKLHKQIADAELEQQRIRKQRNKSQSIVEAIKRFKAKRSDLMVGKVNGLFENITIKLYEVLKNGTEKPTFEVEWQQKPYSKLSTAEKIIAGIEFANALSLKAETIIPLFADNAESVIELPKPTGQLITATVKKTKFTVKGVSE

SEQ ID NO: 787 - protein, 490 aa, Paenibacillus larvae
IKFKTLFLHNFKSHRDLEINFGELTKITGENTKGKSSILEAIPWLFYSVDMLGSKSDPTPINYEYDHTLVKLHFAVDGKDILLGRGIEKGKATYYINEVPAKAKEYEELVKSLFDKDLFLSLYNPSYYFTLKWNEQRELLLRYVSAPANKEVFAQLPKQQAEKLGELVKKHSLADLEKIHRDNKNKKDKAYIAAQSRTKTLIEQLQLLPQSPPNLKNIQDDYDRFLAEIKVIDSMLPKADENNGKIIKLESQIEHLKEQRDQIKEQIRELHNEPIDDRCRACGQTLQGEAKAAAEADKQRRVDQLIEEFNNVITKRKELEAHLTQIEHIDVSKQREEVRELEVRLDQLDEVISNHKSREQLQGQIDHAETDEAAILTSLNESIFIIDAIKAFAAKEAEMMADKVQALFTTLSLRLFKTNKTDGEIKPDFEIEMDGKPYRKLSLSESIRAGLELRDVLSQQSGIIAPCMVDNAESITQFKQPNGQLIVSRV

SEQ ID NO: 788 - protein, 588 aa, Clostridium leptum
MKIKGVTFTDFRNHKAPQSYTFGDISYITGHNGTGKTTMAHGICYALYGVSYYGEQKIERLMNEKATGTQVQLDFTDQNGTTHTLIRNRSGDKTALLLDGYTVRQGDIDRIFCDKETFLSMFNPTYLTERLGEKGRPLILKYLQPVSANAVLEQMSETYREYLDGIDLNTFPPEAKLKEFRGAVRQAEEQEAYLQGNIDSFEEASRTAEQKLSELYADKAAIEKKRKVLSDKQFEGIEVEDLSIQRNMLLEKLSSVPKGENPKVTQLQEKIEELRHKPYVSKYTQAMAENAAEVKNLSERYKALVNRVKGLRPGAQCPACLMRITEQNLPEVRNRMLAELKSLAEQGKERVAQGKELAGMDYQSKTVFEQFKADDLKKLYEELKGLKTEAAGKTDGEELRAALDKVEELQKYGNLDEDEYTELNCLSAELAGIEAQIQAVQDMCDERKLEDAYAQQEVCKGQILKYKNVISALGEFICKRTEIAVSSLQMPNVKIKLFDVVRSTGEVINVFKFTYKGRDYSTLSLSEKTLAGIEITAMIRKITGIDCPICVDNTESIAAFNSVSMPSQTLLLRFVKGQPLTVQSRNRA

SEQ ID NO: 789 - protein, 477 aa, Paenibacillus  JDR-2
IRLIQEQLINYAGIKDRTITFGNVTNLSGKNGEGKSSIGGAPIWILFGKDLYGNDYTKDKYSPRPSNYKYDRVYASILLSIDGTEYKFAREIDEKKKNNFYVNDIPKSATDFSAAVVALITQDEFMSLYFPAYFFGLKWTEQRELLMKGATAPLTKAVLKEIEKLYADKLEPLLKKNSLSDLESKHKQDKTRLEKAHTEAGGATKKLREMLERMPAVEGELTELETQAEALRVEIAKEDAIVAAAWQTNTSYRELESALFYTQHEVDSSKAAWPALKDEAINDTCRTCAQPLQEDAIKAVIADKEKRIAAYRSKHSNLQSIRDEAKAALAAAKWVDVTERQANVRALEDQRDLITEKIRAHKDRARFEVELQQSEETEATTLISLRESTLILDAIKAYKAKEAELQAAEIQSNFTRLSVRLFKYVKSNDAYEPDFSIQMDGKDYAFLSTGEKIAAGLELAEVLHKQSGIIAPVFIDN

SEQ ID NO: 790 - protein, 514 aa, Artificial
  Alicyclobacillus acidocaldarius mutated SEQ ID NO 783
MKILSIQLENFRSFTEASFQFHDITVISGHNGAGKSTLAEAVVWCLFGTDIAGRQKQDEKLMRLGEKRMAVTVTWLIHGKSVVISRTRASRQGSTLLVNGKRAQPGQIEGWFGTVQEFLSVFVPGYFSSLEPKEAKTVLSRCVPDLPKEDVLARMTSVHASMLARDQFVMGLDSIEFAMQKVRDEIKECEAERLRLEGQCQAYQAVLRRGEPQPYVPSVTDEERARYEAAKRELMELEASQGNRKERLRDLYARRDSLGRAFRALRDSLPQADTHCHTCGQPLPEDQAARILQEIAQKRKASLAKMKELYDEGNQVQAEIAKLEAMPDYDAPHPELVEFVQTMEARLKDEHYREVAYAAQLRAYEQAKGHFTQAQEDLQATAEHLEGLKQRLQALQEFRFEYLRAQHEQLNGLFRHVAIHLMDVNKETGEVREAFRIEWKGRPYRLLSYSEKIRCDIEIGRALAQAKGEAMPVYVDNAESVQRLMDETFSGQVIAAYVADGPLTVSKMPEAQGA

SEQ ID NO: 791 - protein, 514 aa, Artificial
  Alicyclobacillus acidocaldarius mutated SEQ ID NO 783
MKILSIQLENFRSFTEASFQFHDITVISGHNGAGKSTLAEAVVWCLFGTDIAGRQKQDEKLMRLGEKRMAVTVTWLIHGKSVVISRTRASRQGSTLLVNGKRAQPGQIEGWFGTVQEFLSVFVPGYFSSLEPKEAKTVLSRCVPDIPKEDVLARMTSVHASMLARDQFVMGLDSIEFAMQKIRDEIKECEAERLRLEGQCQAYQAVLRRGEPQPYVPSVTDEERARYEAAKRELMELEASQGNRKERLRDLYARRDSLGRAFRALRDSLPQADTHCHTCGQPLPEDQAARILQEIAQKRKASLAKMKELYDEGNQVQAEIAKLEAMPDYDAPHPELVEFVQTMEARLKDEHYREVAYAAQLRAYEQAKGHFTQAQEDLQATAEHLEGLKQRLQALQEFRFEYLRAQHEQLNGLFRHVAIHLMDVNKETGEVREAFRIEWKGRPYRLLSYSEKIRCDIEIGRALAQAKGEAMPVYVDNAESVQRLMDETFSGQVIAAYVADGPLTVSKMPEAQGA

SEQ ID NO: 792 - protein, 514 aa, Artificial
  Alicyclobacillus acidocaldarius mutated SEQ ID NO 783
MKILSIQLENFRSFTEASFQFHDITVISGHNGAGKSTLAEAVVWCLFGTDIAGRQKQDEKLMRLGEKRMAVTVTWLIHGKSVVISRTRASRQGSTLLVNGKRAQPGQIEGWFGTVQEFLSVFVPGYFSSLEPKEAKTVLSRCVPDIPKEDVLARMTSVHASMLARDQFVMGLDSIEFAMQKVRDEIKECEAERLRLEGQCQAYQAVLRRGEPQPYVPSVTDEERARYEAAKRELMELEASQGNRKEKLRDLYARRDSLGRAFRALRDSLPQADTHCHTCGQPLPEDQAARILQEIAQKRKASLAKMKELYDEGNQVQAEIAKLEAMPDYDAPHPELVEFVQTMEARLKDEHYREVAYAAQLRAYEQAKGHFTQAQEDLQATAEHLEGLKQRLQALQEFRFEYLRAQHEQLNGLFRHVAIHLMDVNKETGEVREAFRIEWKGRPYRLLSYSEKIRCDIEIGRALAQAKGEAMPVYVDNAESVQRLMDETFSGQVIAAYVADGPLTVSKMPEAQGA

SEQ ID NO: 793 - protein, 514 aa, Artificial
  Alicyclobacillus acidocaldarius mutated SEQ ID NO 783
MKILSIQLENFRSFTEASFQFHDITVISGHNGAGKSTLAEAVVWCLFGTDIAGRQKQDEKLMRLGEKRMAVTVTWLIHGKSVVISRTRASRQGSTLLVNGKRAQPGQIEGWFGTVQEFLSVFVPGYFSSLEPKEAKTVLSRCVPEIPKEDVLARMTSVHASMLARDQFVMGLDSIEFAMQKVRDEIKECEAERLRLEGQCQAYQAVLRRGEPQPYVPSVTDEERARYEAAKRELMELEASQGNRKERLRDLYARRDSLGRAFRALRDSLPQADTHCHTCGQPLPEDQAARILQEIAQKRKASLAKMKELYDEGNQVQAEIAKLEAMPDYDAPHPELVEFVQTMEARLKDEHYREVAYAAQLRAYEQAKGHFTQAQEDLQATAEHLEGLKQRLQALQEFRFEYLRAQHEQLNGLFRHVAIHLMDVNKETGEVREAFRIEWKGRPYRLLSYSEKIRCDIEIGRALAQAKGEAMPVYVDNAESVQRLMDETFSGQVIAAYVADGPLTVSKMPEAQGA

SEQ ID NO: 794 - protein, 514 aa, Artificial
  Alicyclobacillus acidocaldarius mutated SEQ ID NO 783
MKILSIQLENFRSFTEASFQFHDITVISGHNGAGKSTLAEAVVWCLFGTDIAGRQKQDEKLMRLGEKRMAVTVTWIIHGKSVVISRTRASRQGSTLLVNGKRAQPGQIEGWFGTVQEFLSVFVPGYFSSLEPKEAKTVLSRCVPDIPKEDVLARMTSVHASMLARDQFVMGLDSIEFAMQKVRDEIKECEAERLRLEGQCQAYQAVLRRGEPQPYVPSVTDEERARYEAAKRELMELEASQGNRKERLRDLYARRDSLGRAFRALRDSLPQADTHCHTCGQPLPEDQAARILQEIAQKRKASLAKMKELYDEGNQVQAEIAKLEAMPDYDAPHPELVEFVQTMEARLKDEHYREVAYAAQLRAYEQAKGHFTQAQEDLQATAEHLEGLKQRLQALQEFRFEYLRAQHEQLNGLFRHVAIHLMDVNKETGEVREAFRIEWKGRPYRLLSYSEKIRCDIEIGRALAQAKGEAMPVYVDNAESVQRLMDETFSGQVIAAYVADGPLTVSKMPEAQGA

SEQ ID NO: 795 - DNA, 1545 bp, Artificial
  Alicyclobacillus acidocaldarius mutated SEQ ID NO 784
atgaaaatcctcagcattcaactggagaacttccgctcgtttacggaggcctcgttccagttccacgacatcaccgtcatttccggccacaacggcgccgggaaatccacccttgcagaagccgtcgtctggtgtctttttggaaccgatatcgccggcaggcagaaacaagatgaaaagctcatgcgcttgggcgaaaagcggatggcagtcactgtcacgtggctcattcacggcaagtccgttgtcatctcgcgcacgcgcgcatctcgacagggctcgacgctcctcgtgaacggcaaacgcgcacagcccggccaaatcgaaggatggttcggcaccgtgcaggaattcctgtcggtgttcgtccccggctacttcagctccctggagccgaaggaagcgaagaccgtgctttcgcgctgcgtgccagacttaccgaaagaagatgtgctggctcgcatgacgtccgtacacgcgtcgatgcttgcgcgcgatcagtttgtcatggggctcgactcgattgagtttgccatgcagaaggtgcgcgatgagatcaaggaatgcgaagcggaacgcttgcgacttgaagggcaatgccaagcgtatcaggcggttctgcgtcgcggcgaaccgcaaccgtacgtgccaagcgtgacggatgaggaacgcgctcgatatgaggccgcgaaacgggaactcatggagctcgaagcctcgcaggggaaccgaaaggagcgcctgcgcgacctgtacgctcgccgtgactcgcttgggcgagcgtttcgagcacttcgcgatagcctcccacaggcggatacgcactgccatacctgtggtcagccgctcccggaagatcaggcggctcgcatcttgcaagagatcgcgcaaaagcgcaaagcttcgcttgccaagatgaaggagctctacgacgaggggaaccaagtccaggctgagattgcgaagctcgaggctatgccggactacgacgctccacatccggaactcgtggaattcgtgcaaaccatggaagcgcgcctcaaggatgaacactaccgcgaagtggcctatgcggcgcagcttcgcgcgtatgagcaggcgaaggggcacttcacccaagcgcaagaagacttgcaggcgaccgcggagcacctcgaaggtctcaaacagcggcttcaggcactccaagagtttcgcttcgagtacctgcgcgcccaacatgagcagctgaacggcctgttccgccatgttgctatccacctgatggacgtgaacaaggaaacaggcgaggttcgcgaggcgtttcggattgagtggaagggtcggccctatcggctcttgtcctactcggagaagattcgttgcgacatcgagatcggacgcgccctggctcaagccaagggtgaagcgatgcccgtctacgtcgataacgccgaatctgtgcaacgcctgatggacgagacgttcagcggccaggtgatcgcggcgtacgtcgccgacggtccgctcaccgtgtccaagatgccagaagcacagggagcataa

SEQ ID NO: 796 - DNA, 1545 bp, Artificial
  Alicyclobacillus acidocaldarius mutated SEQ ID NO 784
atgaaaatcctcagcattcaactggagaacttccgctcgtttacggaggcctcgttccagttccacgacatcaccgtcatttccggccacaacggcgccgggaaatccacccttgcagaagccgtcgtctggtgtctttttggaaccgatatcgccggcaggcagaaacaagatgaaaagctcatgcgcttgggcgaaaagcggatggcagtcactgtcacgtggctcattcacggcaagtccgttgtcatctcgcgcacgcgcgcatctcgacagggctcgacgctcctcgtgaacggcaaacgcgcacagcccggccaaatcgaaggatggttcggcaccgtgcaggaattcctgtcggtgttcgtccccggctacttcagctccctggagccgaaggaagcgaagaccgtgctttcgcgctgcgtgccagacatcccgaaagaagatgtgctggctcgcatgacgtccgtacacgcgtcgatgcttgcgcgcgatcagtttgtcatggggctcgactcgattgagtttgccatgcagaagattcgcgatgagatcaaggaatgcgaagcggaacgcttgcgacttgaagggcaatgccaagcgtatcaggcggttctgcgtcgcggcgaaccgcaaccgtacgtgccaagcgtgacggatgaggaacgcgctcgatatgaggccgcgaaacgggaactcatggagctcgaagcctcgcaggggaaccgaaaggagcgcctgcgcgacctgtacgctcgccgtgactcgcttgggcgagcgtttcgagcacttcgcgatagcctcccacaggcggatacgcactgccatacctgtggtcagccgctcccggaagatcaggcggctcgcatcttgcaagagatcgcgcaaaagcgcaaagcttcgcttgccaagatgaaggagctctacgacgaggggaaccaagtccaggctgagattgcgaagctcgaggctatgccggactacgacgctccacatccggaactcgtggaattcgtgcaaaccatggaagcgcgcctcaaggatgaacactaccgcgaagtggcctatgcggcgcagcttcgcgcgtatgagcaggcgaaggggcacttcacccaagcgcaagaagacttgcaggcgaccgcggagcacctcgaaggtctcaaacagcggcttcaggcactccaagagtttcgcttcgagtacctgcgcgcccaacatgagcagctgaacggcctgttccgccatgttgctatccacctgatggacgtgaacaaggaaacaggcgaggttcgcgaggcgtttcggattgagtggaagggtcggccctatcggctcttgtcctactcggagaagattcgttgcgacatcgagatcggacgcgccctggctcaagccaagggtgaagcgatgcccgtctacgtcgataacgccgaatctgtgcaacgcctgatggacgagacgttcagcggccaggtgatcgcggcgtacgtcgccgacggtccgctcaccgtgtccaagatgccagaagcacagggagcataa

SEQ ID NO: 797 - DNA, 1545 bp, Artificial
  Alicyclobacillus acidocaldarius mutated SEQ ID NO 784
atgaaaatcctcagcattcaactggagaacttccgctcgtttacggaggcctcgttccagttccacgacatcaccgtcatttccggccacaacggcgccgggaaatccacccttgcagaagccgtcgtctggtgtctttttggaaccgatatcgccggcaggcagaaacaagatgaaaagctcatgcgcttgggcgaaaagcggatggcagtcactgtcacgtggctcattcacggcaagtccgttgtcatctcgcgcacgcgcgcatctcgacagggctcgacgctcctcgtgaacggcaaacgcgcacagcccggccaaatcgaaggatggttcggcaccgtgcaggaattcctgtcggtgttcgtccccggctacttcagctccctggagccgaaggaagcgaagaccgtgctttcgcgctgcgtgccagacatcccgaaagaagatgtgctggctcgcatgacgtccgtacacgcgtcgatgcttgcgcgcgatcagtttgtcatggggctcgactcgattgagtttgccatgcagaaggtgcgcgatgagatcaaggaatgcgaagcggaacgcttgcgacttgaagggcaatgccaagcgtatcaggcggttctgcgtcgcggcgaaccgcaaccgtacgtgccaagcgtgacggatgaggaacgcgctcgatatgaggccgcgaaacgggaactcatggagctcgaagcctcgcaggggaaccgaaaggagaaactgcgcgacctgtacgctcgccgtgactcgcttgggcgagcgtttcgagcacttcgcgatagcctcccacaggcggatacgcactgccatacctgtggtcagccgctcccggaagatcaggcggctcgcatcttgcaagagatcgcgcaaaagcgcaaagcttcgcttgccaagatgaaggagctctacgacgaggggaaccaagtccaggctgagattgcgaagctcgaggctatgccggactacgacgctccacatccggaactcgtggaattcgtgcaaaccatggaagcgcgcctcaaggatgaacactaccgcgaagtggcctatgcggcgcagcttcgcgcgtatgagcaggcgaaggggcacttcacccaagcgcaagaagacttgcaggcgaccgcggagcacctcgaaggtctcaaacagcggcttcaggcactccaagagtttcgcttcgagtacctgcgcgcccaacatgagcagctgaacggcctgttccgccatgttgctatccacctgatggacgtgaacaaggaaacaggcgaggttcgcgaggcgtttcggattgagtggaagggtcggccctatcggctcttgtcctactcggagaagattcgttgcgacatcgagatcggacgcgccctggctcaagccaagggtgaagcgatgcccgtctacgtcgataacgccgaatctgtgcaacgcctgatggacgagacgttcagcggccaggtgatcgcggcgtacgtcgccgacggtccgctcaccgtgtccaagatgccagaagcacagggagcataa

SEQ ID NO: 798 - DNA, 1545 bp, Artificial
  Alicyclobacillus acidocaldarius mutated SEQ ID NO 784
atgaaaatcctcagcattcaactggagaacttccgctcgtttacggaggcctcgttccagttccacgacatcaccgtcatttccggccacaacggcgccgggaaatccacccttgcagaagccgtcgtctggtgtctttttggaaccgatatcgccggcaggcagaaacaagatgaaaagctcatgcgcttgggcgaaaagcggatggcagtcactgtcacgtggctcattcacggcaagtccgttgtcatctcgcgcacgcgcgcatctcgacagggctcgacgctcctcgtgaacggcaaacgcgcacagcccggccaaatcgaaggatggttcggcaccgtgcaggaattcctgtcggtgttcgtccccggctacttcagctccctggagccgaaggaagcgaagaccgtgctttcgcgctgcgtgccagaaatcccgaaagaagatgtgctggctcgcatgacgtccgtacacgcgtcgatgcttgcgcgcgatcagtttgtcatggggctcgactcgattgagtttgccatgcagaaggtgcgcgatgagatcaaggaatgcgaagcggaacgcttgcgacttgaagggcaatgccaagcgtatcaggcggttctgcgtcgcggcgaaccgcaaccgtacgtgccaagcgtgacggatgaggaacgcgctcgatatgaggccgcgaaacgggaactcatggagctcgaagcctcgcaggggaaccgaaaggagcgcctgcgcgacctgtacgctcgccgtgactcgcttgggcgagcgtttcgagcacttcgcgatagcctcccacaggcggatacgcactgccatacctgtggtcagccgctcccggaagatcaggcggctcgcatcttgcaagagatcgcgcaaaagcgcaaagcttcgcttgccaagatgaaggagctctacgacgaggggaaccaagtccaggctgagattgcgaagctcgaggctatgccggactacgacgctccacatccggaactcgtggaattcgtgcaaaccatggaagcgcgcctcaaggatgaacactaccgcgaagtggcctatgcggcgcagcttcgcgcgtatgagcaggcgaaggggcacttcacccaagcgcaagaagacttgcaggcgaccgcggagcacctcgaaggtctcaaacagcggcttcaggcactccaagagtttcgcttcgagtacctgcgcgcccaacatgagcagctgaacggcctgttccgccatgttgctatccacctgatggacgtgaacaaggaaacaggcgaggttcgcgaggcgtttcggattgagtggaagggtcggccctatcggctcttgtcctactcggagaagattcgttgcgacatcgagatcggacgcgccctggctcaagccaagggtgaagcgatgcccgtctacgtcgataacgccgaatctgtgcaacgcctgatggacgagacgttcagcggccaggtgatcgcggcgtacgtcgccgacggtccgctcaccgtgtccaagatgccagaagcacagggagcataa

SEQ ID NO: 799 - DNA, 1545 bp, Artificial
  Alicyclobacillus acidocaldarius mutated SEQ ID NO 784
atgaaaatcctcagcattcaactggagaacttccgctcgtttacggaggcctcgttccagttccacgacatcaccgtcatttccggccacaacggcgccgggaaatccacccttgcagaagccgtcgtctggtgtctttttggaaccgatatcgccggcaggcagaaacaagatgaaaagctcatgcgcttgggcgaaaagcggatggcagtcactgtcacgtggattattcacggcaagtccgttgtcatctcgcgcacgcgcgcatctcgacagggctcgacgctcctcgtgaacggcaaacgcgcacagcccggccaaatcgaaggatggttcggcaccgtgcaggaattcctgtcggtgttcgtccccggctacttcagctccctggagccgaaggaagcgaagaccgtgctttcgcgctgcgtgccagacatcccgaaagaagatgtgctggctcgcatgacgtccgtacacgcgtcgatgcttgcgcgcgatcagtttgtcatggggctcgactcgattgagtttgccatgcagaaggtgcgcgatgagatcaaggaatgcgaagcggaacgcttgcgacttgaagggcaatgccaagcgtatcaggcggttctgcgtcgcggcgaaccgcaaccgtacgtgccaagcgtgacggatgaggaacgcgctcgatatgaggccgcgaaacgggaactcatggagctcgaagcctcgcaggggaaccgaaaggagcgcctgcgcgacctgtacgctcgccgtgactcgcttgggcgagcgtttcgagcacttcgcgatagcctcccacaggcggatacgcactgccatacctgtggtcagccgctcccggaagatcaggcggctcgcatcttgcaagagatcgcgcaaaagcgcaaagcttcgcttgccaagatgaaggagctctacgacgaggggaaccaagtccaggctgagattgcgaagctcgaggctatgccggactacgacgctccacatccggaactcgtggaattcgtgcaaaccatggaagcgcgcctcaaggatgaacactaccgcgaagtggcctatgcggcgcagcttcgcgcgtatgagcaggcgaaggggcacttcacccaagcgcaagaagacttgcaggcgaccgcggagcacctcgaaggtctcaaacagcggcttcaggcactccaagagtttcgcttcgagtacctgcgcgcccaacatgagcagctgaacggcctgttccgccatgttgctatccacctgatggacgtgaacaaggaaacaggcgaggttcgcgaggcgtttcggattgagtggaagggtcggccctatcggctcttgtcctactcggagaagattcgttgcgacatcgagatcggacgcgccctggctcaagccaagggtgaagcgatgcccgtctacgtcgataacgccgaatctgtgcaacgcctgatggacgagacgttcagcggccaggtgatcgcggcgtacgtcgccgacggtccgctcaccgtgtccaagatgccagaagcacagggagcataa

SEQ ID NO: 800 - protein, 112 aa, Alicyclobacillus acidocaldarius
MRPSTLYYNGVQMNPVRGGPSMEDKKVLKTVIRNGVTFDNYPVYVSEAYGDSYLMKHEELAEQIASCIPQAWRKAARFDCNLIAEFQDDMDETSEDEQRLLSKFERWMSRHN

SEQ ID NO: 801 - DNA, 339 bp, Alicyclobacillus acidocaldarius
atgaggccttcaacgctgtactataatggggttcaaatgaatcccgtacgcggagggccatccatggaggataagaaagtgttgaaaaccgttattcgcaacggcgtgacttttgacaattacccggtttacgtgagcgaagcctatggcgattcctacctcatgaaacatgaggaattggctgaacaaattgcgtcttgcattccgcaagcatggagaaaagccgcacggttcgattgcaacttgattgcggaattccaggatgacatggatgaaacatcagaggatgaacagcgccttcttagcaaattcgagcgctggatgagtcgacacaattaa

SEQ ID NO: 802 - protein, 94 aa, Pichia stipitis
NKSVPSFIIRKPINMNGYDYSVFTNYPTEIDLQHGEHLPPAIKESQIKSWESAERISTNVIFGNSSESEDDIDELDEDEHTEASRSSKVNSRKN

SEQ ID NO: 803 - protein, 67 aa, Aedes aegypti
SDSSGDDHLMKPEELDLRSNFFDKIESTKRQSGEPAPQFDCNAGMRLSDSSDDDDQAEEPIPSSIQK

SEQ ID NO: 804 - protein, 62 aa, Methylococcus capsulatus
PWLVNVAKGDLKLVGVEAVTSEQAACRTAEWEKAADRAPAGLIGPTQLDLPATAPAEERLMS

SEQ ID NO: 805 - protein, 47 aa, Ustilago maydis
KEIADRGAKADKEWTELFKAYGEKYPNEHAEIARRIAGKLPEGWEKS

SEQ ID NO: 806 - protein, 78 aa, Tetrahymena thermophila
VQRNGDLESKKISKVVLKSGITFLDIQIKVQRDLKLGYTENFRLFNREGVEMFENDIPFLQNNCYLLASMGEEYDSTS

SEQ ID NO: 807 - protein, 112 aa, Artificial
  Alicyclobacillus acidocaldarius mutated SEQ ID NO 800
MRPSTLYYNGVQMNPVRGGPSMEDKKVLKTVIRNGVTFDNYPVYVSEAYGDSYLMKHEELAEQIASCIPQAWRKAARFECNLIAEFQDDMDETSEDEQRLLSKFERWMSRHN

SEQ ID NO: 808 - protein, 112 aa, Artificial
  Alicyclobacillus acidocaldarius mutated SEQ ID NO 800
MRPSTLYYNGVQMNPVRGGPSMEDKKVLKTVIRNGVTFDNYPVYISEAYGDSYLMKHEELAEQIASCIPQAWRKAARFDCNLIAEFQDDMDETSEDEQRLLSKFERWMSRHN

SEQ ID NO: 809 - protein, 112 aa, Artificial
  Alicyclobacillus acidocaldarius mutated SEQ ID NO 800
MRPSTLYYNGVQMNPVRGGPSMEDKKVLKTVIRNGVTFDNYPVYVSEAYGDSYLMKHEELAEQIASCIPQAWRKAARFDCNLIAEFQDDMDETSEEEQRLLSKFERWMSRHN

SEQ ID NO: 810 - protein, 112 aa, Artificial
  Alicyclobacillus acidocaldarius mutated SEQ ID NO 800
MRPSTLYYNGVNMNPVRGGPSMEDKKVLKTVIRNGVTFDNYPVYVSEAYGDSYLMKHEELAEQIASCIPQAWRKAARFDCNLIAEFQDDMDETSEDEQRLLSKFERWMSRHN

SEQ ID NO: 811 - protein, 112 aa, Artificial
  Alicyclobacillus acidocaldarius mutated SEQ ID NO 800
MRPSTLYYNGVQMNPVRGGPSMEDKKVLKTVIRNGVTFDNYPVYVSEAYGDSYLMKHEELAEQIASCIPQAWRKAARFDCNLIAEFQDDMDDTSEDEQRLLSKFERWMSRHN

SEQ ID NO: 812 - DNA, 339 bp, Artificial
  Alicyclobacillus acidocaldarius mutated SEQ ID NO 801
atgaggccttcaacgctgtactataatggggttcaaatgaatcccgtacgcggagggccatccatggaggataagaaagtgttgaaaaccgttattcgcaacggcgtgacttttgacaattacccggtttacgtgagcgaagcctatggcgattcctacctcatgaaacatgaggaattggctgaacaaattgcgtcttgcattccgcaagcatggagaaaagccgcacggttcgaatgcaacttgattgcggaattccaggatgacatggatgaaacatcagaggatgaacagcgccttcttagcaaattcgagcgctggatgagtcgacacaattaa

SEQ ID NO: 813 - DNA, 339 bp, Artificial
  Alicyclobacillus acidocaldarius mutated SEQ ID NO 801
atgaggccttcaacgctgtactataatggggttcaaatgaatcccgtacgcggagggccatccatggaggataagaaagtgttgaaaaccgttattcgcaacggcgtgacttttgacaattacccggtttacattagcgaagcctatggcgattcctacctcatgaaacatgaggaattggctgaacaaattgcgtcttgcattccgcaagcatggagaaaagccgcacggttcgattgcaacttgattgcggaattccaggatgacatggatgaaacatcagaggatgaacagcgccttcttagcaaattcgagcgctggatgagtcgacacaattaa

SEQ ID NO: 814 - DNA, 339 bp, Artificial
  Alicyclobacillus acidocaldarius mutated SEQ ID NO 801
atgaggccttcaacgctgtactataatggggttcaaatgaatcccgtacgcggagggccatccatggaggataagaaagtgttgaaaaccgttattcgcaacggcgtgacttttgacaattacccggtttacgtgagcgaagcctatggcgattcctacctcatgaaacatgaggaattggctgaacaaattgcgtcttgcattccgcaagcatggagaaaagccgcacggttcgattgcaacttgattgcggaattccaggatgacatggatgaaacatcagaggaagaacagcgccttcttagcaaattcgagcgctggatgagtcgacacaattaa

SEQ ID NO: 815 - DNA, 339 bp, Artificial
  Alicyclobacillus acidocaldarius mutated SEQ ID NO 801
atgaggccttcaacgctgtactataatggggttaatatgaatcccgtacgcggagggccatccatggaggataagaaagtgttgaaaaccgttattcgcaacggcgtgacttttgacaattacccggtttacgtgagcgaagcctatggcgattcctacctcatgaaacatgaggaattggctgaacaaattgcgtcttgcattccgcaagcatggagaaaagccgcacggttcgattgcaacttgattgcggaattccaggatgacatggatgaaacatcagaggatgaacagcgccttcttagcaaattcgagcgctggatgagtcgacacaattaa

SEQ ID NO: 816 - DNA, 339 bp, Artificial
  Alicyclobacillus acidocaldarius mutated SEQ ID NO 801
atgaggccttcaacgctgtactataatggggttcaaatgaatcccgtacgcggagggccatccatggaggataagaaagtgttgaaaaccgttattcgcaacggcgtgacttttgacaattacccggtttacgtgagcgaagcctatggcgattcctacctcatgaaacatgaggaattggctgaacaaattgcgtcttgcattccgcaagcatggagaaaagccgcacggttcgattgcaacttgattgcggaattccaggatgacatggatgatacatcagaggatgaacagcgccttcttagcaaattcgagcgctggatgagtcgacacaattaa

SEQ ID NO: 817 - protein, 126 aa, Alicyclobacillus acidocaldarius
MGTKLSRRWQTLWDELSDILARHLIQKRVRWSKHAKEQMEDRNISQQSVQYVVTRNVANEMYGAYEYPHGPNPYANPDPVFSITGTDASGRWITVAIAVQNRGGRIVFTIVTVLEPGPHSRHRKQS

SEQ ID NO: 818 - DNA, 381 bp, Alicyclobacillus acidocaldarius
gtgggcacgaagttgtctcggcgttggcaaactctatgggatgaactatcggatatcctggctcgccatctcattcagaaacgagtgaggtggtcgaaacacgcgaaagagcagatggaagaccggaacatctcacagcaaagtgtccaatacgttgtgacacgcaatgttgcaaatgagatgtacggtgcatatgagtacccccatggtcctaatccatatgcaaatccagacccggtgttctccatcaccggaactgacgcttctggacgttggattacggtagccattgcggtacaaaatcggggtggaagaatcgtctttacgattgtcacggttcttgagcccggaccgcatagtcgtcatcgaaagcaatcatga

SEQ ID NO: 819 - protein, 106 aa, Lysinibacillus sphaericus
KQNKHMQSEWDKELEEIKKCVKQGNVLSSHILDRLEERGISIMDLVAAILQGEIVEGYDVAQYPNYRNPNMIRNLIGMDTQGRKLKIGVAIEFNGTQLIVRNLTTV

SEQ ID NO: 820 - protein, 70 aa, Bacillus cereus
EDRMSEREISLQEVAEVIITGVIAEGYDVGKYPSYRNADPVRTIIGKTSKGRILTIGVAIKGNQSFCVTT

SEQ ID NO: 821 - protein, 70 aa, Bacillus cereus
KDRMLQRDISLMEVAEIILYGDIVEGFDVAKYPGYCNSDPVRSIIGKTSSGRILTVGVAIKSKQSFCVVT

SEQ ID NO: 822 - protein, 77 aa, Shewanella baltica
IRWSKHVKVRMAERGITTAQILTLLKSKHSVFREGPYPEPNGNWKFNLKGMAAGRVIELTVALKNHHDQPSSALVTV

SEQ ID NO: 823 - protein, 75 aa, Chlorobium phaeobacteroides
IEWQKHALERMLERGISRKRVKNILLSGEIIDAYPGDKPYSSFLVYGQDDGDVIHVVAAYDDKSGTCFIITVYRP

SEQ ID NO: 824 - protein, 126 aa, Artificial
  Alicyclobacillus acidocaldarius mutated SEQ ID NO 817
MGTKLSRRWQTLWDELSDILARHLIQKKVRWSKHAKEQMEDRNISQQSVQYVVTRNVANEMYGAYEYPHGPNPYANPDPVFSITGTDASGRWITVAIAVQNRGGRIVFTIVTVLEPGPHSRHRKQS

SEQ ID NO: 825 - protein, 126 aa, Artificial
  Alicyclobacillus acidocaldarius mutated SEQ ID NO 817
MGTKLSRRWQTLWDELSDILARHLIQKRVRWSKHAKEQMEDRNISQQSVQYVVTRNVANEMYGAYEYPHGPNPYANPDPVFSITGTDASGRWITVAIAVQNRGGRIVFTIVTVLEPGPHSRHKKQS

SEQ ID NO: 826 - protein, 126 aa, Artificial
  Alicyclobacillus acidocaldarius mutated SEQ ID NO 817
MGTKLSRRWQTLWDELSDILARHLIQKRVRWSKHAKEQMEDRNISQQSVQYVVTKNVANEMYGAYEYPHGPNPYANPDPVFSITGTDASGRWITVAIAVQNRGGRIVFTIVTVLEPGPHSRHRKQS

SEQ ID NO: 827 - protein, 126 aa, Artificial
  Alicyclobacillus acidocaldarius mutated SEQ ID NO 817
MGTKLSRRWQTLWDELSDILARHLIQKRVKWSKHAKEQMEDRNISQQSVQYVVTRNVANEMYGAYEYPHGPNPYANPDPVFSITGTDASGRWITVAIAVQNRGGRIVFTIVTVLEPGPHSRHRKQS

SEQ ID NO: 828 - protein, 126 aa, Artificial
  Alicyclobacillus acidocaldarius mutated SEQ ID NO 817
MGTKLSRRWQTLWDELSDILARHLIQKRVRWSKHAKEQMEDRNISQQSVQYVVTRNVANEMYGAYEYPHGPQPYANPDPVFSITGTDASGRWITVAIAVQNRGGRIVFTIVTVLEPGPHSRHRKQS

SEQ ID NO: 829 - DNA, 381 bp, Artificial
  Alicyclobacillus acidocaldarius mutated SEQ ID NO 818
gtgggcacgaagttgtctcggcgttggcaaactctatgggatgaactatcggatatcctggctcgccatctcattcagaaaaaagtgaggtggtcgaaacacgcgaaagagcagatggaagaccggaacatctcacagcaaagtgtccaatacgttgtgacacgcaatgttgcaaatgagatgtacggtgcatatgagtacccccatggtcctaatccatatgcaaatccagacccggtgttctccatcaccggaactgacgcttctggacgttggattacggtagccattgcggtacaaaatcggggtggaagaatcgtctttacgattgtcacggttcttgagcccggaccgcatagtcgtcatcgaaagcaatcatga

SEQ ID NO: 830 - DNA, 381 bp, Artificial
  Alicyclobacillus acidocaldarius mutated SEQ ID NO 818
gtgggcacgaagttgtctcggcgttggcaaactctatgggatgaactatcggatatcctggctcgccatctcattcagaaacgagtgaggtggtcgaaacacgcgaaagagcagatggaagaccggaacatctcacagcaaagtgtccaatacgttgtgacacgcaatgttgcaaatgagatgtacggtgcatatgagtacccccatggtcctaatccatatgcaaatccagacccggtgttctccatcaccggaactgacgcttctggacgttggattacggtagccattgcggtacaaaatcggggtggaagaatcgtctttacgattgtcacggttcttgagcccggaccgcatagtcgtcataaaaagcaatcatga

SEQ ID NO: 831 - DNA, 381 bp, Artificial
  Alicyclobacillus acidocaldarius mutated SEQ ID NO 818
gtgggcacgaagttgtctcggcgttggcaaactctatgggatgaactatcggatatcctggctcgccatctcattcagaaacgagtgaggtggtcgaaacacgcgaaagagcagatggaagaccggaacatctcacagcaaagtgtccaatacgttgtgacaaaaaatgttgcaaatgagatgtacggtgcatatgagtacccccatggtcctaatccatatgcaaatccagacccggtgttctccatcaccggaactgacgcttctggacgttggattacggtagccattgcggtacaaaatcggggtggaagaatcgtctttacgattgtcacggttcttgagcccggaccgcatagtcgtcatcgaaagcaatcatga

SEQ ID NO: 832 - DNA, 381 bp, Artificial
  Alicyclobacillus acidocaldarius mutated SEQ ID NO 818
gtgggcacgaagttgtctcggcgttggcaaactctatgggatgaactatcggatatcctggctcgccatctcattcagaaacgagtgaaatggtcgaaacacgcgaaagagcagatggaagaccggaacatctcacagcaaagtgtccaatacgttgtgacacgcaatgttgcaaatgagatgtacggtgcatatgagtacccccatggtcctaatccatatgcaaatccagacccggtgttctccatcaccggaactgacgcttctggacgttggattacggtagccattgcggtacaaaatcggggtggaagaatcgtctttacgattgtcacggttcttgagcccggaccgcatagtcgtcatcgaaagcaatcatga

SEQ ID NO: 833 - DNA, 381 bp, Artificial
  Alicyclobacillus acidocaldarius mutated SEQ ID NO 818
gtgggcacgaagttgtctcggcgttggcaaactctatgggatgaactatcggatatcctggctcgccatctcattcagaaacgagtgaggtggtcgaaacacgcgaaagagcagatggaagaccggaacatctcacagcaaagtgtccaatacgttgtgacacgcaatgttgcaaatgagatgtacggtgcatatgagtacccccatggtcctcaaccatatgcaaatccagacccggtgttctccatcaccggaactgacgcttctggacgttggattacggtagccattgcggtacaaaatcggggtggaagaatcgtctttacgattgtcacggttcttgagcccggaccgcatagtcgtcatcgaaagcaatcatga

SEQ ID NO: 834 - protein, 65 aa, Alicyclobacillus acidocaldarius
MAEVVAEGVRFLDRGEGNQSAKSASAAPPVKNNTSPAPSKQPDFGPYDDPFADDLPPGFEEDLPF

SEQ ID NO: 835 - DNA, 198 bp, Alicyclobacillus acidocaldarius
gtggccgaagtggtcgcggaaggcgtacggtttctcgaccgtggagaaggcaatcaaagcgccaaatctgcgtctgccgctccacctgtgaaaaacaacacctcgccggctccgtcgaagcaaccggacttcggtccatacgacgatccgtttgcggacgatttaccgccgggctttgaagaggacttaccgttctag

SEQ ID NO: 836 - protein, 33 aa, Gallus gallus
KYAEEGEGKQSEEEAKASAKIKKNSAPLPAEQP

SEQ ID NO: 837 - protein, 59 aa, Bacillus  NRRL B-14911
VTEVIARYVQFLDSKKNNQSQEQRRPESNNTPSGRNSNNNPYADPYFEGEPISDDDLPF

SEQ ID NO: 838 - protein, 72 aa, Streptococcus pyogenes
VTEVVADNFQMLESRATREGGSTGSFNGGFNNNTSSSNSYSAPAQQTPNFGRDDSPFGNSNPMDISDDDLPF

SEQ ID NO: 839 - protein, 72 aa, Streptococcus pyogenes; identical to SEQ ID NO: 838

SEQ ID NO: 840 - protein, 72 aa, Streptococcus pyogenes; identical to SEQ ID NO: 838

SEQ ID NO: 841 - protein, 65 aa, Artificial
  Alicyclobacillus acidocaldarius mutated SEQ ID NO 834
MAEVIAEGVRFLDRGEGNQSAKSASAAPPVKNNTSPAPSKQPDFGPYDDPFADDLPPGFEEDLPF

SEQ ID NO: 842 - protein, 65 aa, Artificial
  Alicyclobacillus acidocaldarius mutated SEQ ID NO 834
MAEVVAEGVRFLDRGEGNQSAKSASAAPPVKNNTSPAPSKQPDFGPYDDPFADDLPPGFEEELPF

SEQ ID NO: 843 - protein, 65 aa, Artificial
  Alicyclobacillus acidocaldarius mutated SEQ ID NO 834
MAEVVAEGIRFLDRGEGNQSAKSASAAPPVKNNTSPAPSKQPDFGPYDDPFADDLPPGFEEDLPF

SEQ ID NO: 844 - protein, 65 aa, Artificial
  Alicyclobacillus acidocaldarius mutated SEQ ID NO 834
MAEVVAEGVRFLDKGEGNQSAKSASAAPPVKNNTSPAPSKQPDFGPYDDPFADDLPPGFEEDLPF

SEQ ID NO: 845 - protein, 65 aa, Artificial
  Alicyclobacillus acidocaldarius mutated SEQ ID NO 834
MAEVVAEGVRFLDRGEGNQSAKSASAAPPVKNNTSPAPSKQPDFGPYEDPFADDLPPGFEEDLPF

SEQ ID NO: 846 - DNA, 198 bp, Artificial
  Alicyclobacillus acidocaldarius mutated SEQ ID NO 835
gtggccgaagtgattgcggaaggcgtacggtttctcgaccgtggagaaggcaatcaaagcgccaaatctgcgtctgccgctccacctgtgaaaaacaacacctcgccggctccgtcgaagcaaccggacttcggtccatacgacgatccgtttgcggacgatttaccgccgggctttgaagaggacttaccgttctag

SEQ ID NO: 847 - DNA, 198 bp, Artificial
  Alicyclobacillus acidocaldarius mutated SEQ ID NO 835
gtggccgaagtggtcgcggaaggcgtacggtttctcgaccgtggagaaggcaatcaaagcgccaaatctgcgtctgccgctccacctgtgaaaaacaacacctcgccggctccgtcgaagcaaccggacttcggtccatacgacgatccgtttgcggacgatttaccgccgggctttgaagaggaattaccgttctag

SEQ ID NO: 848 - DNA, 198 bp, Artificial
  Alicyclobacillus acidocaldarius mutated SEQ ID NO 835
gtggccgaagtggtcgcggaaggcattcggtttctcgaccgtggagaaggcaatcaaagcgccaaatctgcgtctgccgctccacctgtgaaaaacaacacctcgccggctccgtcgaagcaaccggacttcggtccatacgacgatccgtttgcggacgatttaccgccgggctttgaagaggacttaccgttctag

SEQ ID NO: 849 - DNA, 198 bp, Artificial
  Alicyclobacillus acidocaldarius mutated SEQ ID NO 835
gtggccgaagtggtcgcggaaggcgtacggtttctcgacaaaggagaaggcaatcaaagcgccaaatctgcgtctgccgctccacctgtgaaaaacaacacctcgccggctccgtcgaagcaaccggacttcggtccatacgacgatccgtttgcggacgatttaccgccgggctttgaagaggacttaccgttctag

SEQ ID NO: 850 - DNA, 198 bp, Artificial
  Alicyclobacillus acidocaldarius mutated SEQ ID NO 835
gtggccgaagtggtcgcggaaggcgtacggtttctcgaccgtggagaaggcaatcaaagcgccaaatctgcgtctgccgctccacctgtgaaaaacaacacctcgccggctccgtcgaagcaaccggacttcggtccatacgaagatccgtttgcggacgatttaccgccgggctttgaagaggacttaccgttctag

SEQ ID NO: 851 - protein, 285 aa, Alicyclobacillus acidocaldarius
MALPERQLPRAYGAGVNMVMDFGALRQRLEELRQFVKEYMVPGEDYGIIGDSKPTLFKPGAEKLCDVYGLSAGEAHIEFTRDDTKTPIYISYRVSLPLISRIDGKIIMVGVGSANSWEKKYRWRWVTERELPPDLPKETLKQATFDGKYGSYIKYRIPNDEIDDLDNTLLKMAKKRALIDAVLSATRSSALFTQDIEDLEDLTIRQPESVDRRQRTQPDRSTGSPDISQAQKNLILRKAQERGMDTEALNAFVLQATGKGELDSLTKQEASKLIDLLTSGKPRER

SEQ ID NO: 852 - DNA, 858 bp, Alicyclobacillus acidocaldarius
atggcgcttcccgaacgccagcttccacgtgcgtatggcgccggtgtcaacatggtcatggacttcggcgcactgcgtcagcgcttggaggagcttcggcaattcgtaaaagagtacatggtgcccggcgaagactatggcatcatcggcgacagcaaacccactctgttcaagcctggcgcggaaaagctctgcgacgtgtatgggctaagcgccggagaagcacatatcgagttcacgcgcgacgatacgaaaactcccatttacatcagctatcgcgtatctttaccgctcatcagccgaatcgacgggaaaatcatcatggtgggcgttggctccgcgaactcgtgggagaagaaatatcgttggcgatgggtgaccgaacgcgaattgcccccggacttacccaaggaaaccctcaaacaagccacattcgacggcaagtacggttcgtacatcaagtaccgcattcccaacgacgaaatcgacgacctcgacaacacgctcttaaagatggccaagaagcgcgccctcatcgacgctgtgctctcggctactcggtcaagcgcgttgtttacgcaggacatcgaggatctcgaggatctaaccattcgacagccggaatcggttgaccgtcggcagcggacacagcccgaccgttcgaccggtagcccggacatctcccaggcccaaaagaacctcatcctccgtaaagcccaggaacgagggatggatacggaggccttgaacgcgttcgtgctccaggcaacaggaaagggcgaactcgactcactgacgaaacaagaggcgagtaagctcattgaccttctgacctcggggaaaccacgcgaacgctga

SEQ ID NO: 853 - protein, 245 aa, Clostridium thermocellum
IEKFQMVVQKTLNEGHDYDIIPGTSKPSLLKPGAEKILVLLGLTSEYEIIEKIENYEKGIFAYTVRCILSKNGKKVTEGLGSCNSKEDKYRWRWVSEKDLPPNVDKDMLKSKTNEYGQKLYRIENDEIFTQANTILKIAKKRAQIDAVLTVAALSEIFTQDVEDMQEFLQNEQLETMKAEEAVNVKVTFGKHKGKTLGEIYSQAPDYVQWLAQNARNDVLRKAANMVMNGKGNESQQEAQRSEDL

SEQ ID NO: 854 - protein, 220 aa, Syntrophomonas wolfei
KQRLELLQEFVKEMMIPGQDYGIVPGVSKPSLFKPGAEKLTDIFGFSKQVEILNRTENWENGLFNYEVKVSLINKRNQLIEAEGIGCCNSKEKRYRSQDPYNTVNTVLKMAKKRALIDAVLSATRSSGLFTQDVEDLDISESWVRSPQPQATKTVRGVKPDSLSVANITQPQLRKVQALAEAIGMTPHQLQALIQDMFRVNHTTRLSKNQASALIQHLLS

SEQ ID NO: 855 - protein, 184 aa, Clostridium kluyveri
MEIGEVRNTLGKIAQFQSIIQKTLKNGHDYGEIGGVTKPTLLKPGAEKILMLMGLTSEYNIIEKIEDYDKGIFAYTIKCILRKNGQKITEGVGSCNSKEDKYRWRWVKEDDLPMGIDKDAVKSKVDNYGHTKYKVENDDICSQANTILKMAKKRAQVDATLTVASLSEIFTQDIEDMAQFQERE

SEQ ID NO: 856 - protein, 168 aa, Clostridium botulinum
QKIATFQAVIQKNLKDGHDFGVVAGAGSKPTLLKPGGEKICMMFGLNPEYEFLERTEDYKDGFFAYNIKCTLYRNGNPVSQGVGNCNSMEKKYRYINVDAVPDGIDPSTVEKVTTRYGTVKYKIPNPHIADLVNTILKMAKKRAFIDAVLQVASLSDVFTQDLEEMQE

SEQ ID NO: 857 - protein, 150 aa, Clostridium kluyveri
ISIVPDFAITLNDAKNRVELLQSFVKEMMIINIDYGFIPNCSKPSLFKSGAEKLCDIFGFSKKIEILNRVEDWEKALFHYEIKTILINKKTGLIEAEGIGSCNNRERKYKNQDGYSIVNNILKMAKKRAFIDAVLSATRSSGLFTQDMED

SEQ ID NO: 858 - protein, 285 aa, Artificial
  Alicyclobacillus acidocaldarius mutated SEQ ID NO 851
MALPERQLPRAYGAGVNMVMDFGALRQRLEELRQFVKEYMVPGEDYGIIGDSKPTLFKPGAEKLCDVYGLSAGEAHIEFTRDDTKTPIYISYRVSLPLISRIDGKLIMVGVGSANSWEKKYRWRWVTERELPPDLPKETLKQATFDGKYGSYIKYRIPNDEIDDLDNTLLKMAKKRALIDAVLSATRSSALFTQDIEDLEDLTIRQPESVDRRQRTQPDRSTGSPDISQAQKNLILRKAQERGMDTEALNAFVLQATGKGELDSLTKQEASKLIDLLTSGKPRER

SEQ ID NO: 859 - protein, 285 aa, Artificial
  Alicyclobacillus acidocaldarius mutated SEQ ID NO 851
MALPERQLPRAYGAGVNMVMDFGALRQRLEELRQFVKEYMVPGEDYGIIGDSKPTLFKPGAEKLCDVYGLSAGEAHIEFTRDDTKTPIYISYRVSLPLISRIDGKIIMVGVGSANSWEKKYRWRWVTERELPPDLPKETLKQATFDGKYGSYIKYRIPNDELDDLDNTLLKMAKKRALIDAVLSATRSSALFTQDIEDLEDLTIRQPESVDRRQRTQPDRSTGSPDISQAQKNLILRKAQERGMDTEALNAFVLQATGKGELDSLTKQEASKLIDLLTSGKPRER

SEQ ID NO: 860 - protein, 285 aa, Artificial
  Alicyclobacillus acidocaldarius mutated SEQ ID NO 851
MALPERQLPRAYGAGVNMVMDFGALRQRLEELRQFVKEYMVPGEDYGIIGDSKPTLFKPGAEKLCDVYGLSAGEAHIEFTRDDTKTPIYISYRVSLPLISRIDGKIIMVGVGSANSWEKKYRWRWVTERELPPDLPKETLKQATFDGKYGSYIKYRIPNDEIDDLDNTLLKMAKKRALIDAVLSATRSSALFTQDIEDLEDLTIRQPESVDRRQRTQPDRSTGSPDISQAQKNLILRKAQERGMDTEALNAFVLQATGKGELDSLTKQEASKLIDLITSGKPRER

SEQ ID NO: 861 - protein, 285 aa, Artificial
  Alicyclobacillus acidocaldarius mutated SEQ ID NO 851
MALPERQLPRAYGAGVNMVMDFGALRQRLEELRQFVKEYMVPGEDYGIIGDSKPTLFKPGAEKLCDVYGLSAGEAHIEFTRDDTKTPIYISYRVSLPLISRIDGKIIMVGVGSANSWEKKYRWRWVTERELPPDLPKETLKQATFDGKYGSYIKYRIPNDEIDDLDNTLLKMAKKRALIDAVLSATRSSALFTQDIEDLEDLTIKQPESVDRRQRTQPDRSTGSPDISQAQKNLILRKAQERGMDTEALNAFVLQATGKGELDSLTKQEASKLIDLLTSGKPRER

SEQ ID NO: 862 - protein, 285 aa, Artificial
  Alicyclobacillus acidocaldarius mutated SEQ ID NO 851
MALPERQLPRAYGAGVNMVMDFGALRQRLEELRQFVKEYMVPGEDYGIIGDSKPTLFKPGAEKLCDVYGLSAGEAHIEFTRDDTKTPIYISYRVSLPLISRIDGKIIMVGVGSANSWEKKYRWRWVTERELPPDLPKETLKQATFDGKYGSYIKYRIPNDEIDDLDNTLLKMAKKRALIDAVLSATRSSALFTQDIEDLEDLTIRNPESVDRRQRTQPDRSTGSPDISQAQKNLILRKAQERGMDTEALNAFVLQATGKGELDSLTKQEASKLIDLLTSGKPRER

SEQ ID NO: 863 - DNA, 858 bp, Artificial
  Alicyclobacillus acidocaldarius mutated SEQ ID NO 852
atggcgcttcccgaacgccagcttccacgtgcgtatggcgccggtgtcaacatggtcatggacttcggcgcactgcgtcagcgcttggaggagcttcggcaattcgtaaaagagtacatggtgcccggcgaagactatggcatcatcggcgacagcaaacccactctgttcaagcctggcgcggaaaagctctgcgacgtgtatgggctaagcgccggagaagcacatatcgagttcacgcgcgacgatacgaaaactcccatttacatcagctatcgcgtatctttaccgctcatcagccgaatcgacgggaaattaatcatggtgggcgttggctccgcgaactcgtgggagaagaaatatcgttggcgatgggtgaccgaacgcgaattgcccccggacttacccaaggaaaccctcaaacaagccacattcgacggcaagtacggttcgtacatcaagtaccgcattcccaacgacgaaatcgacgacctcgacaacacgctcttaaagatggccaagaagcgcgccctcatcgacgctgtgctctcggctactcggtcaagcgcgttgtttacgcaggacatcgaggatctcgaggatctaaccattcgacagccggaatcggttgaccgtcggcagcggacacagcccgaccgttcgaccggtagcccggacatctcccaggcccaaaagaacctcatcctccgtaaagcccaggaacgagggatggatacggaggccttgaacgcgttcgtgctccaggcaacaggaaagggcgaactcgactcactgacgaaacaagaggcgagtaagctcattgaccttctgacctcggggaaaccacgcgaacgctga

SEQ ID NO: 864 - DNA, 858 bp, Artificial
  Alicyclobacillus acidocaldarius mutated SEQ ID NO 852
atggcgcttcccgaacgccagcttccacgtgcgtatggcgccggtgtcaacatggtcatggacttcggcgcactgcgtcagcgcttggaggagcttcggcaattcgtaaaagagtacatggtgcccggcgaagactatggcatcatcggcgacagcaaacccactctgttcaagcctggcgcggaaaagctctgcgacgtgtatgggctaagcgccggagaagcacatatcgagttcacgcgcgacgatacgaaaactcccatttacatcagctatcgcgtatctttaccgctcatcagccgaatcgacgggaaaatcatcatggtgggcgttggctccgcgaactcgtgggagaagaaatatcgttggcgatgggtgaccgaacgcgaattgcccccggacttacccaaggaaaccctcaaacaagccacattcgacggcaagtacggttcgtacatcaagtaccgcattcccaacgacgaattagacgacctcgacaacacgctcttaaagatggccaagaagcgcgccctcatcgacgctgtgctctcggctactcggtcaagcgcgttgtttacgcaggacatcgaggatctcgaggatctaaccattcgacagccggaatcggttgaccgtcggcagcggacacagcccgaccgttcgaccggtagcccggacatctcccaggcccaaaagaacctcatcctccgtaaagcccaggaacgagggatggatacggaggccttgaacgcgttcgtgctccaggcaacaggaaagggcgaactcgactcactgacgaaacaagaggcgagtaagctcattgaccttctgacctcggggaaaccacgcgaacgctga

SEQ ID NO: 865 - DNA, 858 bp, Artificial
  Alicyclobacillus acidocaldarius mutated SEQ ID NO 852
atggcgcttcccgaacgccagcttccacgtgcgtatggcgccggtgtcaacatggtcatggacttcggcgcactgcgtcagcgcttggaggagcttcggcaattcgtaaaagagtacatggtgcccggcgaagactatggcatcatcggcgacagcaaacccactctgttcaagcctggcgcggaaaagctctgcgacgtgtatgggctaagcgccggagaagcacatatcgagttcacgcgcgacgatacgaaaactcccatttacatcagctatcgcgtatctttaccgctcatcagccgaatcgacgggaaaatcatcatggtgggcgttggctccgcgaactcgtgggagaagaaatatcgttggcgatgggtgaccgaacgcgaattgcccccggacttacccaaggaaaccctcaaacaagccacattcgacggcaagtacggttcgtacatcaagtaccgcattcccaacgacgaaatcgacgacctcgacaacacgctcttaaagatggccaagaagcgcgccctcatcgacgctgtgctctcggctactcggtcaagcgcgttgtttacgcaggacatcgaggatctcgaggatctaaccattcgacagccggaatcggttgaccgtcggcagcggacacagcccgaccgttcgaccggtagcccggacatctcccaggcccaaaagaacctcatcctccgtaaagcccaggaacgagggatggatacggaggccttgaacgcgttcgtgctccaggcaacaggaaagggcgaactcgactcactgacgaaacaagaggcgagtaagctcattgaccttattacctcggggaaaccacgcgaacgctga

SEQ ID NO: 866 - DNA, 858 bp, Artificial
  Alicyclobacillus acidocaldarius mutated SEQ ID NO 852
atggcgcttcccgaacgccagcttccacgtgcgtatggcgccggtgtcaacatggtcatggacttcggcgcactgcgtcagcgcttggaggagcttcggcaattcgtaaaagagtacatggtgcccggcgaagactatggcatcatcggcgacagcaaacccactctgttcaagcctggcgcggaaaagctctgcgacgtgtatgggctaagcgccggagaagcacatatcgagttcacgcgcgacgatacgaaaactcccatttacatcagctatcgcgtatctttaccgctcatcagccgaatcgacgggaaaatcatcatggtgggcgttggctccgcgaactcgtgggagaagaaatatcgttggcgatgggtgaccgaacgcgaattgcccccggacttacccaaggaaaccctcaaacaagccacattcgacggcaagtacggttcgtacatcaagtaccgcattcccaacgacgaaatcgacgacctcgacaacacgctcttaaagatggccaagaagcgcgccctcatcgacgctgtgctctcggctactcggtcaagcgcgttgtttacgcaggacatcgaggatctcgaggatctaaccattaaacagccggaatcggttgaccgtcggcagcggacacagcccgaccgttcgaccggtagcccggacatctcccaggcccaaaagaacctcatcctccgtaaagcccaggaacgagggatggatacggaggccttgaacgcgttcgtgctccaggcaacaggaaagggcgaactcgactcactgacgaaacaagaggcgagtaagctcattgaccttctgacctcggggaaaccacgcgaacgctga

SEQ ID NO: 867 - DNA, 858 bp, Artificial
  Alicyclobacillus acidocaldarius mutated SEQ ID NO 852
atggcgcttcccgaacgccagcttccacgtgcgtatggcgccggtgtcaacatggtcatggacttcggcgcactgcgtcagcgcttggaggagcttcggcaattcgtaaaagagtacatggtgcccggcgaagactatggcatcatcggcgacagcaaacccactctgttcaagcctggcgcggaaaagctctgcgacgtgtatgggctaagcgccggagaagcacatatcgagttcacgcgcgacgatacgaaaactcccatttacatcagctatcgcgtatctttaccgctcatcagccgaatcgacgggaaaatcatcatggtgggcgttggctccgcgaactcgtgggagaagaaatatcgttggcgatgggtgaccgaacgcgaattgcccccggacttacccaaggaaaccctcaaacaagccacattcgacggcaagtacggttcgtacatcaagtaccgcattcccaacgacgaaatcgacgacctcgacaacacgctcttaaagatggccaagaagcgcgccctcatcgacgctgtgctctcggctactcggtcaagcgcgttgtttacgcaggacatcgaggatctcgaggatctaaccattcgaaatccggaatcggttgaccgtcggcagcggacacagcccgaccgttcgaccggtagcccggacatctcccaggcccaaaagaacctcatcctccgtaaagcccaggaacgagggatggatacggaggccttgaacgcgttcgtgctccaggcaacaggaaagggcgaactcgactcactgacgaaacaagaggcgagtaagctcattgaccttctgacctcggggaaaccacgcgaacgctga

SEQ ID NO: 868 - protein, 121 aa, Alicyclobacillus acidocaldarius
MPFTMKPSDTYWNLMNVRRGQIYLMKVQFSDLSGEKIRPVVVIGTDRVDDDVTVVFVTSSPPRLRYDVQITEWSVAGLLKPSTVRASKFLTVHKGRFLKPLGTLTDSDLQAVMTAVRSYLL

SEQ ID NO: 869 - DNA, 366 bp, Alicyclobacillus acidocaldarius
atgccatttacgatgaaaccttcggacacctactggaatctgatgaacgtgcgtcgagggcaaatttatctgatgaaggttcagttcagtgatctgagcggcgaaaaaattcgccctgtggtggtcatcgggacggaccgtgtggatgatgatgtgactgtcgtcttcgtcacctcatcgccgcctcgacttcgttacgatgtccaaatcacagaatggtcagtagctggactgctcaaaccctcgaccgtacgcgcctctaaattcctcaccgtccacaaaggacgattcctcaaacctcttggaaccctaacagatagcgatctccaagctgtcatgacagctgtcaggtcgtatcttctctaa

SEQ ID NO: 870 - protein, 112 aa, Microcystis aeruginosa
PQKTKVYMTIIKGGEFWVAKILFTDGTSSKKRPVLILWVDGDDVVVTAVTSAMPRTQTDILLKDWANSGLRVPSTVRLSRLDCLEKNLLLAKLGRISNEDAVYLLRAWDDYI

SEQ ID NO: 871 - protein, 103 aa, Candidatus Kuenenia
MTNYNFGEILLLKFPYSDGKGDAKRPVVVLAQTDLEDIVTAKVTSMEQRGEYDIAIDAWKDVGLLYPSVVRIDKLATLSKQRVEKRFGTLVGSYKPEIISRIK

SEQ ID NO: 872 - protein, 98 aa, Candidatus Kuenenia
GEIILVRFPHTDLQDISKRPALILYDSGDQDILIARITTQEYTTGTDYKIVEWKSCGLLVESFIRISKQATIEKKYVIKPLGTLAEAELNAVKSIIKN

SEQ ID NO: 873 - protein, 96 aa, Candidatus Kuenenia
MQYPFSGVSVQKVRPAVVVNAPHVSHDLLVVPLTSKTTSLLKGEFVLTDWTLAGLNVVTAVKRGIYTVHQSLIIKRLGKLSHADSQKIEVALKEWL

SEQ ID NO: 874 - protein, 107 aa, Crocosphaera watsonii
MANYWKNDVILVRYPFSDLSNSKIRPAIIVSSPHTSQDVLITPLTSKTQLLLEGEFILSDWKKAGLNVETAVKRGIYTIYQGLILKKVGKLVDADTTKLEQSLRQWL

SEQ ID NO: 875 - protein, 121 aa, Artificial
  Alicyclobacillus acidocaldarius mutated SEQ ID NO 868
MPFTMKPSDTYWNLMNVKRGQIYLMKVQFSDLSGEKIRPVVVIGTDRVDDDVTVVFVTSSPPRLRYDVQITEWSVAGLLKPSTVRASKFLTVHKGRFLKPLGTLTDSDLQAVMTAVRSYLL

SEQ ID NO: 876 - protein, 121 aa, Artificial
  Alicyclobacillus acidocaldarius mutated SEQ ID NO 868
MPFTMKPSDTYWNLMNVRRGQIYLMKVQFSDLSGEKIRPVVVIGTDRVDDDVTVVFVTSSPPKLRYDVQITEWSVAGLLKPSTVRASKFLTVHKGRFLKPLGTLTDSDLQAVMTAVRSYLL

SEQ ID NO: 877 - protein, 121 aa, Artificial
  Alicyclobacillus acidocaldarius mutated SEQ ID NO 868
MPFTMKPSDTYWNLMNVRRGNIYLMKVQFSDLSGEKIRPVVVIGTDRVDDDVTVVFVTSSPPRLRYDVQITEWSVAGLLKPSTVRASKFLTVHKGRFLKPLGTLTDSDLQAVMTAVRSYLL

SEQ ID NO: 878 - protein, 121 aa, Artificial
  Alicyclobacillus acidocaldarius mutated SEQ ID NO 868
MPFTMKPSDTYWNLMNVRRGQIYLMKVQFSDLSGEKIRPVVVIGTDRVDDDVTVVFVTSSPPRLRYDVQITEWSVAGLLKPSTVRASKFLTVHKGRFLKPLGTLTDSDLQAVMTAIRSYLL

SEQ ID NO: 879 - protein, 121 aa, Artificial
  Alicyclobacillus acidocaldarius mutated SEQ ID NO 868
MPFTMKPSDTYWNLMNVRRGQIYLMKVQFSDLSGEKIRPVVVIGTDRVDDDVTVVFVTSSPPRLKYDVQITEWSVAGLLKPSTVRASKFLTVHKGRFLKPLGTLTDSDLQAVMTAVRSYLL

SEQ ID NO: 880 - DNA, 366 bp, Artificial
  Alicyclobacillus acidocaldarius mutated SEQ ID NO 869
atgccatttacgatgaaaccttcggacacctactggaatctgatgaacgtgaaacgagggcaaatttatctgatgaaggttcagttcagtgatctgagcggcgaaaaaattcgccctgtggtggtcatcgggacggaccgtgtggatgatgatgtgactgtcgtcttcgtcacctcatcgccgcctcgacttcgttacgatgtccaaatcacagaatggtcagtagctggactgctcaaaccctcgaccgtacgcgcctctaaattcctcaccgtccacaaaggacgattcctcaaacctcttggaaccctaacagatagcgatctccaagctgtcatgacagctgtcaggtcgtatcttctctaa

SEQ ID NO: 881 - DNA, 366 bp, Artificial
  Alicyclobacillus acidocaldarius mutated SEQ ID NO 869
atgccatttacgatgaaaccttcggacacctactggaatctgatgaacgtgcgtcgagggcaaatttatctgatgaaggttcagttcagtgatctgagcggcgaaaaaattcgccctgtggtggtcatcgggacggaccgtgtggatgatgatgtgactgtcgtcttcgtcacctcatcgccgcctaaacttcgttacgatgtccaaatcacagaatggtcagtagctggactgctcaaaccctcgaccgtacgcgcctctaaattcctcaccgtccacaaaggacgattcctcaaacctcttggaaccctaacagatagcgatctccaagctgtcatgacagctgtcaggtcgtatcttctctaa

SEQ ID NO: 882 - DNA, 366 bp, Artificial
  Alicyclobacillus acidocaldarius mutated SEQ ID NO 869
atgccatttacgatgaaaccttcggacacctactggaatctgatgaacgtgcgtcgagggaatatttatctgatgaaggttcagttcagtgatctgagcggcgaaaaaattcgccctgtggtggtcatcgggacggaccgtgtggatgatgatgtgactgtcgtcttcgtcacctcatcgccgcctcgacttcgttacgatgtccaaatcacagaatggtcagtagctggactgctcaaaccctcgaccgtacgcgcctctaaattcctcaccgtccacaaaggacgattcctcaaacctcttggaaccctaacagatagcgatctccaagctgtcatgacagctgtcaggtcgtatcttctctaa

SEQ ID NO: 883 - DNA, 366 bp, Artificial
  Alicyclobacillus acidocaldarius mutated SEQ ID NO 869
atgccatttacgatgaaaccttcggacacctactggaatctgatgaacgtgcgtcgagggcaaatttatctgatgaaggttcagttcagtgatctgagcggcgaaaaaattcgccctgtggtggtcatcgggacggaccgtgtggatgatgatgtgactgtcgtcttcgtcacctcatcgccgcctcgacttcgttacgatgtccaaatcacagaatggtcagtagctggactgctcaaaccctcgaccgtacgcgcctctaaattcctcaccgtccacaaaggacgattcctcaaacctcttggaaccctaacagatagcgatctccaagctgtcatgacagctattaggtcgtatcttctctaa

SEQ ID NO: 884 - DNA, 366 bp, Artificial
  Alicyclobacillus acidocaldarius mutated SEQ ID NO 869
atgccatttacgatgaaaccttcggacacctactggaatctgatgaacgtgcgtcgagggcaaatttatctgatgaaggttcagttcagtgatctgagcggcgaaaaaattcgccctgtggtggtcatcgggacggaccgtgtggatgatgatgtgactgtcgtcttcgtcacctcatcgccgcctcgacttaaatacgatgtccaaatcacagaatggtcagtagctggactgctcaaaccctcgaccgtacgcgcctctaaattcctcaccgtccacaaaggacgattcctcaaacctcttggaaccctaacagatagcgatctccaagctgtcatgacagctgtcaggtcgtatcttctctaa

SEQ ID NO: 885 - protein, 107 aa, Alicyclobacillus acidocaldarius
MSRTRSTATNAGKKAARSPFTHGCAESRSRQRKPNCTRRGHGSATYTPQNGSPPPNSPSLASRRASRGACQKAWTHWHGDVSAKQCSIGFGKNTRGMSASSASRPSG

SEQ ID NO: 886 - DNA, 324 bp, Alicyclobacillus acidocaldarius
gtgtcaaggacacgttctactgccacaaatgcggggaaaaaggcggcgcggtcgcctttcacgcatggctgcgcggaatctcgttcgaggcagcgaaagccgaactgtacccgcaggggacacggaagcgcaacctacaccccgcagaacggctcaccgccgcccaactcgccgagcttggcttcacgacgcgcaagccgtggcgcatgccaaaaggcgtggacccactggcatggcgacgtcagcgcaaagcaatgctcgattggatttgggaagaataccaggggcatgagcgcttcaagcgcgagcagaccgagcggttga

SEQ ID NO: 887 - protein, 95 aa, Human papillomavirus
STTRSRSTSVGKTRALTSRSRSRGRSPSTCRRGGGRSPRRRSRSPSTYSSCTTQRSQRARAESPTTRGARGSRGSRGGSRGGRLRRRGRSSSSSS

SEQ ID NO: 888 - protein, 98 aa, Monodelphis domestica
SRTRSPARRGGRSRSRTPARRGGRSRSRTPARRGGRSRSRTPARRGRSRSRTPARRGRTRSRTPARRGRSRTRSPVRRGRSHSRTPQRRGRSGSSSER

SEQ ID NO: 889 - protein, 91 aa, Human papillomavirus
RSRSKSKSRSRSRSRSLSSNRRSRSKSRRKASTTRGRGRGSPTATSDQSSRSPSATSSTTSLRSRGSSRVGRSRGGRSRVGRSRGRGKRSR

SEQ ID NO: 890 - protein, 95 aa, Human papi1lomavirus
STTRSRSTSLTKTRALTSRSRSRGRSPTTCRRGGGRSPRRRSRSPSTSSSCTTQRSQRARAESSTTRGARGSRGSRGGSRGGRGRRRGRSSSSSS

SEQ ID NO: 891 - protein, 71 aa, Homo sapiens
TRERARPSPPPESAARARVTHKAADPRPGVSRATTAREQRGETHGAPYAPAPPPPPPRQPKRSERTRHRGA

SEQ ID NO: 892 - protein, 107 aa, Artificial
  Alicyclobacillus acidocaldarius mutated SEQ ID NO 885
MSRTRSTATNAGKKAARSPFTHGCAESRSRQRKPNCTRRGHGSATYTPNNGSPPPNSPSLASRRASRGACQKAWTHWHGDVSAKQCSIGFGKNTRGMSASSASRPSG

SEQ ID NO: 893 - protein, 107 aa, Artificial
  Alicyclobacillus acidocaldarius mutated SEQ ID NO 885
MSRTRSTATNAGKKAARSPFTHGCAESRSRQRKPNCTRRGHGSATYTPQNGSPPPNSPSLASRRASRGACQKAWTHWHGEVSAKQCSIGFGKNTRGMSASSASRPSG

SEQ ID NO: 894 - protein, 107 aa, Artificial
  Alicyclobacillus acidocaldarius mutated SEQ ID NO 885
MSRTRSTATNAGKKAARSPFTHGCAESRSRQRKPNCTRRGHGSATYTPQNGSPPPNSPSLASRRASRGACQKAWTHWHGDVSAKQCSIGFGRNTRGMSASSASRPSG

SEQ ID NO: 895 - protein, 107 aa, Artificial
  Alicyclobacillus acidocaldarius mutated SEQ ID NO 885
MSRTRSTATNAGKKAARSPFTHGCAESRSRQRKPNCTRRGHGSATYTPQNGSPPPNSPSLASRRASRGACQKAWTHWHGDVSARQCSIGFGKNTRGMSASSASRPSG

SEQ ID NO: 896 - protein, 107 aa, Artificial
  Alicyclobacillus acidocaldarius mutated SEQ ID NO 885
MSRTRSTATNAGKKAARSPFTHGCAESRSRQRKPNCTRKGHGSATYTPQNGSPPPNSPSLASRRASRGACQKAWTHWHGDVSAKQCSIGFGKNTRGMSASSASRPSG

SEQ ID NO: 897 - DNA, 324 bp, Artificial
  Alicyclobacillus acidocaldarius mutated SEQ ID NO 886
gtgtcaaggacacgttctactgccacaaatgcggggaaaaaggcggcgcggtcgcctttcacgcatggctgcgcggaatctcgttcgaggcagcgaaagccgaactgtacccgcaggggacacggaagcgcaacctacaccccgaataacggctcaccgccgcccaactcgccgagcttggcttcacgacgcgcaagccgtggcgcatgccaaaaggcgtggacccactggcatggcgacgtcagcgcaaagcaatgctcgattggatttgggaagaataccaggggcatgagcgcttcaagcgcgagcagaccgagcggttga

SEQ ID NO: 898 - DNA, 324 bp, Artificial
  Alicyclobacillus acidocaldarius mutated SEQ ID NO 886
gtgtcaaggacacgttctactgccacaaatgcggggaaaaaggcggcgcggtcgcctttcacgcatggctgcgcggaatctcgttcgaggcagcgaaagccgaactgtacccgcaggggacacggaagcgcaacctacaccccgcagaacggctcaccgccgcccaactcgccgagcttggcttcacgacgcgcaagccgtggcgcatgccaaaaggcgtggacccactggcatggcgaagtcagcgcaaagcaatgctcgattggatttgggaagaataccaggggcatgagcgcttcaagcgcgagcagaccgagcggttga

SEQ ID NO: 899 - DNA, 324 bp, Artificial
  Alicyclobacillus acidocaldarius mutated SEQ ID NO 886
gtgtcaaggacacgttctactgccacaaatgcggggaaaaaggcggcgcggtcgcctttcacgcatggctgcgcggaatctcgttcgaggcagcgaaagccgaactgtacccgcaggggacacggaagcgcaacctacaccccgcagaacggctcaccgccgcccaactcgccgagcttggcttcacgacgcgcaagccgtggcgcatgccaaaaggcgtggacccactggcatggcgacgtcagcgcaaagcaatgctcgattggatttgggcgtaataccaggggcatgagcgcttcaagcgcgagcagaccgagcggttga

SEQ ID NO: 900 - DNA, 324 bp, Artificial
  Alicyclobacillus acidocaldarius mutated SEQ ID NO 886
gtgtcaaggacacgttctactgccacaaatgcggggaaaaaggcggcgcggtcgcctttcacgcatggctgcgcggaatctcgttcgaggcagcgaaagccgaactgtacccgcaggggacacggaagcgcaacctacaccccgcagaacggctcaccgccgcccaactcgccgagcttggcttcacgacgcgcaagccgtggcgcatgccaaaaggcgtggacccactggcatggcgacgtcagcgcacgtcaatgctcgattggatttgggaagaataccaggggcatgagcgcttcaagcgcgagcagaccgagcggttga

SEQ ID NO: 901 - DNA, 324 bp, Artificial
  Alicyclobacillus acidocaldarius mutated SEQ ID NO 886
gtgtcaaggacacgttctactgccacaaatgcggggaaaaaggcggcgcggtcgcctttcacgcatggctgcgcggaatctcgttcgaggcagcgaaagccgaactgtacccgcaaaggacacggaagcgcaacctacaccccgcagaacggctcaccgccgcccaactcgccgagcttggcttcacgacgcgcaagccgtggcgcatgccaaaaggcgtggacccactggcatggcgacgtcagcgcaaagcaatgctcgattggatttgggaagaataccaggggcatgagcgcttcaagcgcgagcagaccgagcggttga

SEQ ID NO: 902 - protein, 156 aa, Alicyclobacillus acidocaldarius
MCSRLRDSRLRPRKALCRAADGARGRSSRMRSAIIFALMFFFILSWNYQPYMDVINGARLEYLQAVAETAISEAKIKGYFSATDLSNIQQAVATHLGYPVSEVQVQGTTLPTTRGNPIDIQISIPTHINLFSMAPASNQATLTAYESADSEALNPS

SEQ ID NO: 903 - DNA, 471 bp, Alicyclobacillus acidocaldarius
atgtgcagtcgtttacgggacagcagattacgtccgcggaaggctctgtgtcgggcggctgatggggcgagagggaggtcgagtcgaatgagaagtgcgatcatcttcgcgctgatgttcttcttcatcctgtcgtggaactaccagccgtacatggatgtcatcaatggcgcgcggttggagtatctgcaggcggtggccgaaacggcgatttcggaggcgaagatcaagggttacttctcggcgaccgacctctccaacatccaacaggcggtggcgacgcacctgggctatccggtctcggaagtccaggtgcaaggcaccacgcttcccacgacgcgcgggaacccgattgacatccagatctccatccctacgcacatcaacctgttctcgatggcgcctgcatcgaatcaggcaacgctcacagcgtatgagagcgcggatagcgaggcgttgaatccgtcatga

SEQ ID NO: 904 - protein, 62 aa, Strawberry necrotic shock virus
VSEAAFRQYSKTKDPETLVQYIATMLSSSSNHVVINGITMRSGSPIDLEEYVPLAVTFYVMA

SEQ ID NO: 905 - protein, 62 aa, Blackberry chlorotic ringspot virus
VSEAAFRQYSKTKDPETLVQYIATMLSSSSNHVIINGITMRSGSPIDLEEYVPLAVTFYVMA

SEQ ID NO: 906 - protein, 93 aa, Bacillus  NRRL B-14911
FTPFFVYLDSLHRAVVALVLQQGLKEAAIEGYFSQEIVEGMKDTLEQDYKFERNLIEITTPDSSPQTRGEYLEVEISVPRGPMFILNIFNQGP

SEQ ID NO: 907 - protein, 67 aa, Caenorhabditis elegans
SHMKKVIVFILLYPFLLLWNVIISEKYLDFIFGGFVISYIKRVPWASLSKFQIISYVFTFSVTLVTN

SEQ ID NO: 908 - protein, 67 aa, Caenorhabditis elegans; identical to SEQ ID NO: 907

SEQ ID NO: 909 - protein, 156 aa, Artificial
  Alicyclobacillus acidocaldarius mutated SEQ ID NO 902
MCSRLRDSRLRPRKALCRAADGARGRSSRMRSAIIFALMFFFILSWNYQPYMDVINGARLDYLQAVAETAISEAKIKGYFSATDLSNIQQAVATHLGYPVSEVQVQGTTLPTTRGNPIDIQISIPTHINLFSMAPASNQATLTAYESADSEALNPS

SEQ ID NO: 910 - protein, 156 aa, Artificial
  Alicyclobacillus acidocaldarius mutated SEQ ID NO 902
MCSRLRDSRLRPRKALCRAADGARGKSSRMRSAIIFALMFFFILSWNYQPYMDVINGARLEYLQAVAETAISEAKIKGYFSATDLSNIQQAVATHLGYPVSEVQVQGTTLPTTRGNPIDIQISIPTHINLFSMAPASNQATLTAYESADSEALNPS

SEQ ID NO: 911 - protein, 156 aa, Artificial
  Alicyclobacillus acidocaldarius mutated SEQ ID NO 902
MCSRLRDSRLRPRKALCRAADGARGRSSRMRSAIIFALMFFFILSWNYQPYMDVLNGARLEYLQAVAETAISEAKIKGYFSATDLSNIQQAVATHLGYPVSEVQVQGTTLPTTRGNPIDIQISIPTHINLFSMAPASNQATLTAYESADSEALNPS

SEQ ID NO: 912 - protein, 156 aa, Artificial
  Alicyclobacillus acidocaldarius mutated SEQ ID NO 902
MCSRLRDSRLRPRKALCRAADGARGRSSRMRSAIIFALMFFFILSWNYQPYMDVINGARLEYLQAVAETAISEAKIKGYFSATDLSNIQQAVATHLGYPVSEVQVQGTTLPTTRGQPIDIQISIPTHINLFSMAPASNQATLTAYESADSEALNPS

SEQ ID NO: 913 - protein, 156 aa, Artificial
  Alicyclobacillus acidocaldarius mutated SEQ ID NO 902
MCSRLRDSRLRPRKALCRAADGARGRSSRMRSAIIFALMFFFILSWNYQPYMDVINGARLEYLQAVAETAISEAKIKGYFSATDLSQIQQAVATHLGYPVSEVQVQGTTLPTTRGNPIDIQISIPTHINLFSMAPASNQATLTAYESADSEALNPS

SEQ ID NO: 914 - DNA, 471 bp, Artificial
  Alicyclobacillus acidocaldarius mutated SEQ ID NO 903
atgtgcagtcgtttacgggacagcagattacgtccgcggaaggctctgtgtcgggcggctgatggggcgagagggaggtcgagtcgaatgagaagtgcgatcatcttcgcgctgatgttcttcttcatcctgtcgtggaactaccagccgtacatggatgtcatcaatggcgcgcggttggattatctgcaggcggtggccgaaacggcgatttcggaggcgaagatcaagggttacttctcggcgaccgacctctccaacatccaacaggcggtggcgacgcacctgggctatccggtctcggaagtccaggtgcaaggcaccacgcttcccacgacgcgcgggaacccgattgacatccagatctccatccctacgcacatcaacctgttctcgatggcgcctgcatcgaatcaggcaacgctcacagcgtatgagagcgcggatagcgaggcgttgaatccgtcatga

SEQ ID NO: 915 - DNA, 471 bp, Artificial
  Alicyclobacillus acidocaldarius mutated SEQ ID NO 903
atgtgcagtcgtttacgggacagcagattacgtccgcggaaggctctgtgtcgggcggctgatggggcgagagggaaatcgagtcgaatgagaagtgcgatcatcttcgcgctgatgttcttcttcatcctgtcgtggaactaccagccgtacatggatgtcatcaatggcgcgcggttggagtatctgcaggcggtggccgaaacggcgatttcggaggcgaagatcaagggttacttctcggcgaccgacctctccaacatccaacaggcggtggcgacgcacctgggctatccggtctcggaagtccaggtgcaaggcaccacgcttcccacgacgcgcgggaacccgattgacatccagatctccatccctacgcacatcaacctgttctcgatggcgcctgcatcgaatcaggcaacgctcacagcgtatgagagcgcggatagcgaggcgttgaatccgtcatga

SEQ ID NO: 916 - DNA, 471 bp, Artificial
  Alicyclobacillus acidocaldarius mutated SEQ ID NO 903
atgtgcagtcgtttacgggacagcagattacgtccgcggaaggctctgtgtcgggcggctgatggggcgagagggaggtcgagtcgaatgagaagtgcgatcatcttcgcgctgatgttcttcttcatcctgtcgtggaactaccagccgtacatggatgtcttaaatggcgcgcggttggagtatctgcaggcggtggccgaaacggcgatttcggaggcgaagatcaagggttacttctcggcgaccgacctctccaacatccaacaggcggtggcgacgcacctgggctatccggtctcggaagtccaggtgcaaggcaccacgcttcccacgacgcgcgggaacccgattgacatccagatctccatccctacgcacatcaacctgttctcgatggcgcctgcatcgaatcaggcaacgctcacagcgtatgagagcgcggatagcgaggcgttgaatccgtcatga

SEQ ID NO: 917 - DNA, 471 bp, Artificial
  Alicyclobacillus acidocaldarius mutated SEQ ID NO 903
atgtgcagtcgtttacgggacagcagattacgtccgcggaaggctctgtgtcgggcggctgatggggcgagagggaggtcgagtcgaatgagaagtgcgatcatcttcgcgctgatgttcttcttcatcctgtcgtggaactaccagccgtacatggatgtcatcaatggcgcgcggttggagtatctgcaggcggtggccgaaacggcgatttcggaggcgaagatcaagggttacttctcggcgaccgacctctccaacatccaacaggcggtggcgacgcacctgggctatccggtctcggaagtccaggtgcaaggcaccacgcttcccacgacgcgcgggcaaccgattgacatccagatctccatccctacgcacatcaacctgttctcgatggcgcctgcatcgaatcaggcaacgctcacagcgtatgagagcgcggatagcgaggcgttgaatccgtcatga

SEQ ID NO: 918 - DNA, 471 bp, Artificial
  Alicyclobacillus acidocaldarius mutated SEQ ID NO 903
atgtgcagtcgtttacgggacagcagattacgtccgcggaaggctctgtgtcgggcggctgatggggcgagagggaggtcgagtcgaatgagaagtgcgatcatcttcgcgctgatgttcttcttcatcctgtcgtggaactaccagccgtacatggatgtcatcaatggcgcgcggttggagtatctgcaggcggtggccgaaacggcgatttcggaggcgaagatcaagggttacttctcggcgaccgacctctcccaaatccaacaggcggtggcgacgcacctgggctatccggtctcggaagtccaggtgcaaggcaccacgcttcccacgacgcgcgggaacccgattgacatccagatctccatccctacgcacatcaacctgttctcgatggcgcctgcatcgaatcaggcaacgctcacagcgtatgagagcgcggatagcgaggcgttgaatccgtcatga

SEQ ID NO: 919 - protein, 292 aa, Alicyclobacillus acidocaldarius
MNEVNTMENLRAVYVNTFAEGSRSTDPIQLSVDELKMAARGWKRAKTVIHVHLLGMQQKLVDGTTRDILVGDIGPAKVMLPVDPEYSALEDGEDPMSLTDRWICGIVEDFDLQDEGDSTILLNRKKGLERLRELNAERVSKPGNRAIGVIVGIRRGAYVLNVGGYTALMPKAWYDWDDSKRDQGTIGEEFPVQIQPSKVEDRIVVSRCHLMENPNVPSSLRFDRGTILRATVAFIRNGLIRAEVYPGFLVSVDPVILRQIPKPGDRITVRILGQNKNGYYGMMVDHQPQSVG

SEQ ID NO: 920 - DNA, 879 bp, Alicyclobacillus acidocaldarius
gtgaacgaggtgaatactatggaaaatttgcgtgctgtatacgtaaacacgtttgcagagggttcgcgaagcacagatcccattcaattgagcgttgatgaattgaagatggccgcgcgaggatggaaacgcgcaaaaacagttatccatgtgcatctcttaggtatgcagcagaaacttgtagatggtacgacacgagacattctcgttggagacattggcccagccaaagtcatgctccccgttgacccagaatattcggcgttggaagatggcgaagatcctatgtcccttacagatcgttggatttgtggaatcgtagaagactttgacctacaggacgaaggggattcgaccattcttctaaatcgcaagaagggtttagagcgcctgagagaattgaatgcggaacgagttagcaaacccggaaatcgagcaattggcgtgatcgttggaattcgaaggggcgcatatgtgttgaatgttggcggttatacagccctcatgcctaaagcgtggtacgactgggatgactccaagcgagatcaggggacgattggagaggagttcccggttcaaatccagccatcgaaagtcgaggatcgaatcgtcgtcagtcgatgccacctgatggagaatccgaatgtcccatcgtcactacgatttgaccgcggcacgattctccgtgcaacggttgccttcattcggaatgggttaatcagggctgaggtctatccaggattcctcgtgagtgtagaccccgtgattcttcgacaaattccgaaacctggagatcgaattactgttcgaatcttgggccagaacaaaaatggctattatgggatgatggtcgatcaccaaccgcaaagtgttggatga

SEQ ID NO: 921 - protein, 202 aa, Moorella thermoacetica
PASLVERGYVEDLNAYLGQTLRLRVIELDRSKNKVVLSRKAILEEEYEKQRQATWNSLEVGQVRKGIVRRLTNFGAFVDLGGVDGLLHVSEISWGRVEHPRDALSEGQEIEVKILGIDREEGKVSLGRKQLLPNPWDTAAERYPVGTIVEGKILRLAPFGAFVEVEPGIEGLVHISQLADRHVDKPEDVVSIGDIIPVKVLG

SEQ ID NO: 922 - protein, 172 aa, Acidiphi1ium cryptum
DTFDLYIERYEDKDGSIVLSREKARREEAWTALERAYEQQARVNGVIHGRVKGGFTVDLGGATAFLPGSQVDIRPVRDVTPLMGVQQPFQILKMDRARGNIVVSRRAVLEETRAEQRSELIQGLKEGQILDGVVKNITDYGAFVDLGGVDGLLHVTDIAWRRINHPAEALTI

SEQ ID NO: 923 - protein, 159 aa, Candidatus Cloacamonas
LEEMREQERKETALAKLKVGDIVKGKVLRMTTFGAFIDLGGIEGLMHVSEISWQHIVRPQDELKKGQEIEVKILDIKGEKIALSRKVLLEDPFEVAMKELHEGDIINCRVLRLHNFGAFAELKPGVEGLIPISEMSRNRNISHPRDIVKEGDWVQVQIL

SEQ ID NO: 924 - protein, 100 aa, Gluconacetobacter dia1otrophicus
EDRDGSIVLSREKARREEAWTNLEKAFEGNQRVNGTIYGRVKGGFTVDLGGAMAFLPGSQVDIRPVRDVTPLMGVPQPFQILKMDRARGNIVVSRRAVLE

SEQ ID NO: 925 - protein, 179 aa, Haemophilus somnus
DAVEDGFGETKLSREKAVRQESWIDLEKAYEEQATVIGLINGKVKGGFTVELNGVRAFLPGSLVDTRPTREADHLLGKEQEFKVIKLDQKRNNVVVSRRAVIESENSQEREEILANLAEGSEVKGTVKNLTDYGAFVDLGGVDGLLHITDMAWKRVKHPGEIVSVGDEITVKVLKFDKD

SEQ ID NO: 926 - protein, 292 aa, Artificial
  Alicyclobacillus acidocaldarius mutated SEQ ID NO 919
MNEVNTMENLRAVYVNTFAEGSKSTDPIQLSVDELKMAARGWKRAKTVIHVHLLGMQQKLVDGTTRDILVGDIGPAKVMLPVDPEYSALEDGEDPMSLTDRWICGIVEDFDLQDEGDSTILLNRKKGLERLRELNAERVSKPGNRAIGVIVGIRRGAYVLNVGGYTALMPKAWYDWDDSKRDQGTIGEEFPVQIQPSKVEDRIVVSRCHLMENPNVPSSLRFDRGTILRATVAFIRNGLIRAEVYPGFLVSVDPVILRQIPKPGDRITVRILGQNKNGYYGMMVDHQPQSVG

SEQ ID NO: 927 - protein, 292 aa, Artificial
  Alicyclobacillus acidocaldarius mutated SEQ ID NO 919
MNEVNTMENLRAVYVNTFAEGSRSTDPIQLSVDDLKMAARGWKRAKTVIHVHLLGMQQKLVDGTTRDILVGDIGPAKVMLPVDPEYSALEDGEDPMSLTDRWICGIVEDFDLQDEGDSTILLNRKKGLERLRELNAERVSKPGNRAIGVIVGIRRGAYVLNVGGYTALMPKAWYDWDDSKRDQGTIGEEFPVQIQPSKVEDRIVVSRCHLMENPNVPSSLRFDRGTILRATVAFIRNGLIRAEVYPGFLVSVDPVILRQIPKPGDRITVRILGQNKNGYYGMMVDHQPQSVG

SEQ ID NO: 928 - protein, 292 aa, Artificial
  Alicyclobacillus acidocaldarius mutated SEQ ID NO 919
MNEVNTMENLRAVYVNTFAEGSRSTDPIQLSVDELKMAARGWKRAKTVIHVHLLGMQQKLVDGTTRDILVGDIGPAKVMLPVDPEYSALEDGEDPMSLTDRWICGIVEDFDLQDEGDSTILLNRKKGLERLRELNAERVSKPGNKAIGVIVGIRRGAYVLNVGGYTALMPKAWYDWDDSKRDQGTIGEEFPVQIQPSKVEDRIVVSRCHLMENPNVPSSLRFDRGTILRATVAFIRNGLIRAEVYPGFLVSVDPVILRQIPKPGDRITVRILGQNKNGYYGMMVDHQPQSVG

SEQ ID NO: 929 - protein, 292 aa, Artificial
  Alicyclobacillus acidocaldarius mutated SEQ ID NO 919
MNEVNTMENLRAVYVNTFAEGSRSTDPIQLSVDELKMAARGWKRAKTVIHVHLLGMQQKLVDGTTRDILVGDIGPAKVMLPVDPEYSALEDGEDPMSLTERWICGIVEDFDLQDEGDSTILLNRKKGLERLRELNAERVSKPGNRAIGVIVGIRRGAYVLNVGGYTALMPKAWYDWDDSKRDQGTIGEEFPVQIQPSKVEDRIVVSRCHLMENPNVPSSLRFDRGTILRATVAFIRNGLIRAEVYPGFLVSVDPVILRQIPKPGDRITVRILGQNKNGYYGMMVDHQPQSVG

SEQ ID NO: 930 - protein, 292 aa, Artificial
  Alicyclobacillus acidocaldarius mutated SEQ ID NO 919
MNEVNTMENLRAVYVNTFAEGSRSTDPIQLSVDELKMAARGWKRAKTVIHVHLLGMQQKIVDGTTRDILVGDIGPAKVMLPVDPEYSALEDGEDPMSLTDRWICGIVEDFDLQDEGDSTILLNRKKGLERLRELNAERVSKPGNRAIGVIVGIRRGAYVLNVGGYTALMPKAWYDWDDSKRDQGTIGEEFPVQIQPSKVEDRIVVSRCHLMENPNVPSSLRFDRGTILRATVAFIRNGLIRAEVYPGFLVSVDPVILRQIPKPGDRITVRILGQNKNGYYGMMVDHQPQSVG

SEQ ID NO: 931 - DNA, 879 bp, Artificial
  Alicyclobacillus acidocaldarius mutated SEQ ID NO 920
gtgaacgaggtgaatactatggaaaatttgcgtgctgtatacgtaaacacgtttgcagagggttcgaaaagcacagatcccattcaattgagcgttgatgaattgaagatggccgcgcgaggatggaaacgcgcaaaaacagttatccatgtgcatctcttaggtatgcagcagaaacttgtagatggtacgacacgagacattctcgttggagacattggcccagccaaagtcatgctccccgttgacccagaatattcggcgttggaagatggcgaagatcctatgtcccttacagatcgttggatttgtggaatcgtagaagactttgacctacaggacgaaggggattcgaccattcttctaaatcgcaagaagggtttagagcgcctgagagaattgaatgcggaacgagttagcaaacccggaaatcgagcaattggcgtgatcgttggaattcgaaggggcgcatatgtgttgaatgttggcggttatacagccctcatgcctaaagcgtggtacgactgggatgactccaagcgagatcaggggacgattggagaggagttcccggttcaaatccagccatcgaaagtcgaggatcgaatcgtcgtcagtcgatgccacctgatggagaatccgaatgtcccatcgtcactacgatttgaccgcggcacgattctccgtgcaacggttgccttcattcggaatgggttaatcagggctgaggtctatccaggattcctcgtgagtgtagaccccgtgattcttcgacaaattccgaaacctggagatcgaattactgttcgaatcttgggccagaacaaaaatggctattatgggatgatggtcgatcaccaaccgcaaagtgttggatga

SEQ ID NO: 932 - DNA, 879 bp, Artificial
  Alicyclobacillus acidocaldarius mutated SEQ ID NO 920
gtgaacgaggtgaatactatggaaaatttgcgtgctgtatacgtaaacacgtttgcagagggttcgcgaagcacagatcccattcaattgagcgttgatgatttgaagatggccgcgcgaggatggaaacgcgcaaaaacagttatccatgtgcatctcttaggtatgcagcagaaacttgtagatggtacgacacgagacattctcgttggagacattggcccagccaaagtcatgctccccgttgacccagaatattcggcgttggaagatggcgaagatcctatgtcccttacagatcgttggatttgtggaatcgtagaagactttgacctacaggacgaaggggattcgaccattcttctaaatcgcaagaagggtttagagcgcctgagagaattgaatgcggaacgagttagcaaacccggaaatcgagcaattggcgtgatcgttggaattcgaaggggcgcatatgtgttgaatgttggcggttatacagccctcatgcctaaagcgtggtacgactgggatgactccaagcgagatcaggggacgattggagaggagttcccggttcaaatccagccatcgaaagtcgaggatcgaatcgtcgtcagtcgatgccacctgatggagaatccgaatgtcccatcgtcactacgatttgaccgcggcacgattctccgtgcaacggttgccttcattcggaatgggttaatcagggctgaggtctatccaggattcctcgtgagtgtagaccccgtgattcttcgacaaattccgaaacctggagatcgaattactgttcgaatcttgggccagaacaaaaatggctattatgggatgatggtcgatcaccaaccgcaaagtgttggatga

SEQ ID NO: 933 - DNA, 879 bp, Artificial
  Alicyclobacillus acidocaldarius mutated SEQ ID NO 920
gtgaacgaggtgaatactatggaaaatttgcgtgctgtatacgtaaacacgtttgcagagggttcgcgaagcacagatcccattcaattgagcgttgatgaattgaagatggccgcgcgaggatggaaacgcgcaaaaacagttatccatgtgcatctcttaggtatgcagcagaaacttgtagatggtacgacacgagacattctcgttggagacattggcccagccaaagtcatgctccccgttgacccagaatattcggcgttggaagatggcgaagatcctatgtcccttacagatcgttggatttgtggaatcgtagaagactttgacctacaggacgaaggggattcgaccattcttctaaatcgcaagaagggtttagagcgcctgagagaattgaatgcggaacgagttagcaaacccggaaataaagcaattggcgtgatcgttggaattcgaaggggcgcatatgtgttgaatgttggcggttatacagccctcatgcctaaagcgtggtacgactgggatgactccaagcgagatcaggggacgattggagaggagttcccggttcaaatccagccatcgaaagtcgaggatcgaatcgtcgtcagtcgatgccacctgatggagaatccgaatgtcccatcgtcactacgatttgaccgcggcacgattctccgtgcaacggttgccttcattcggaatgggttaatcagggctgaggtctatccaggattcctcgtgagtgtagaccccgtgattcttcgacaaattccgaaacctggagatcgaattactgttcgaatcttgggccagaacaaaaatggctattatgggatgatggtcgatcaccaaccgcaaagtgttggatga

SEQ ID NO: 934 - DNA, 879 bp, Artificial
  Alicyclobacillus acidocaldarius mutated SEQ ID NO 920
gtgaacgaggtgaatactatggaaaatttgcgtgctgtatacgtaaacacgtttgcagagggttcgcgaagcacagatcccattcaattgagcgttgatgaattgaagatggccgcgcgaggatggaaacgcgcaaaaacagttatccatgtgcatctcttaggtatgcagcagaaacttgtagatggtacgacacgagacattctcgttggagacattggcccagccaaagtcatgctccccgttgacccagaatattcggcgttggaagatggcgaagatcctatgtcccttacagaacgttggatttgtggaatcgtagaagactttgacctacaggacgaaggggattcgaccattcttctaaatcgcaagaagggtttagagcgcctgagagaattgaatgcggaacgagttagcaaacccggaaatcgagcaattggcgtgatcgttggaattcgaaggggcgcatatgtgttgaatgttggcggttatacagccctcatgcctaaagcgtggtacgactgggatgactccaagcgagatcaggggacgattggagaggagttcccggttcaaatccagccatcgaaagtcgaggatcgaatcgtcgtcagtcgatgccacctgatggagaatccgaatgtcccatcgtcactacgatttgaccgcggcacgattctccgtgcaacggttgccttcattcggaatgggttaatcagggctgaggtctatccaggattcctcgtgagtgtagaccccgtgattcttcgacaaattccgaaacctggagatcgaattactgttcgaatcttgggccagaacaaaaatggctattatgggatgatggtcgatcaccaaccgcaaagtgttggatga

SEQ ID NO: 935 - DNA, 879 bp, Artificial
  Alicyclobacillus acidocaldarius mutated SEQ ID NO 920
gtgaacgaggtgaatactatggaaaatttgcgtgctgtatacgtaaacacgtttgcagagggttcgcgaagcacagatcccattcaattgagcgttgatgaattgaagatggccgcgcgaggatggaaacgcgcaaaaacagttatccatgtgcatctcttaggtatgcagcagaaaattgtagatggtacgacacgagacattctcgttggagacattggcccagccaaagtcatgctccccgttgacccagaatattcggcgttggaagatggcgaagatcctatgtcccttacagatcgttggatttgtggaatcgtagaagactttgacctacaggacgaaggggattcgaccattcttctaaatcgcaagaagggtttagagcgcctgagagaattgaatgcggaacgagttagcaaacccggaaatcgagcaattggcgtgatcgttggaattcgaaggggcgcatatgtgttgaatgttggcggttatacagccctcatgcctaaagcgtggtacgactgggatgactccaagcgagatcaggggacgattggagaggagttcccggttcaaatccagccatcgaaagtcgaggatcgaatcgtcgtcagtcgatgccacctgatggagaatccgaatgtcccatcgtcactacgatttgaccgcggcacgattctccgtgcaacggttgccttcattcggaatgggttaatcagggctgaggtctatccaggattcctcgtgagtgtagaccccgtgattcttcgacaaattccgaaacctggagatcgaattactgttcgaatcttgggccagaacaaaaatggctattatgggatgatggtcgatcaccaaccgcaaagtgttggatga

SEQ ID NO: 936 - protein, 282 aa, Alicyclobacillus acidocaldarius
MVTHMLTDIKLERHAVPYAPVWIPGRERTGNVLVEGGPGTGKTYCLKTMLHQDIQAMVDGQQDCRMIVISPEGSMCDIEDCTSRLQVDWIKIYSRALHVSSPYEKAFFSALRNLLMVSPDDSQSTCDRVLAEYGLLKPFLYCSRQNTKIVSLYTGYQEIDTFIGAAFVHYLACNMSKITMKPTILYVDELHRYAAYAPHAVAKLFECGAEHGISLIAAVQSTEQLNTAESPCLSELVNRNTRFHVKMRTSEDRDTLRLAPNQALWITSTTRHVIEVSPQFRN

SEQ ID NO: 937 - DNA, 849 bp, Alicyclobacillus acidocaldarius
gtggtcacacacatgttaacggacatcaagttagagcgtcatgcagttccttatgcgccagtttggataccgggaagggaaagaaccgggaatgtcctcgttgaaggtggcccgggaactggaaagacatattgcctgaagactatgctgcatcaagacattcaagcgatggttgacggacaacaagactgcagaatgattgtcatctcaccggaaggtagtatgtgtgacatcgaagattgcacaagtagattgcaagtggattggatcaaaatttactctagggccttgcatgtaagctctccatatgaaaaagcgtttttcagtgctttacgaaaccttctaatggtgagcccggatgattcacagtccacatgcgaccgggtactggccgaatacgggttattgaaaccattcctatattgctcaaggcaaaacaccaaaattgtctcgttgtatacaggatatcaagagatcgacacattcatcggcgcagcgtttgtgcattatctagcttgcaacatgagcaaaatcacgatgaagccaaccattctgtatgttgatgaacttcaccgttacgctgcctatgcgccacacgcagtagcgaagttatttgagtgcggagcagagcatggaatatctttgatcgccgcagttcagtccacagaacagctgaacaccgcggaatcgccatgcctgagtgaattggtcaatcgaaacactcgctttcatgtgaagatgcgaacctcagaggatagagatacactccgcctcgcacccaatcaggcgttgtggatcacaagcacaacaaggcatgttatcgaagtatctcctcaatttagaaattaa

SEQ ID NO: 938 - protein, 218 aa, Enterobacter sakazakii
IILEDVTGAGKTEAALVLAHRLMAAGQARGLYIGLPTMATANAMYARMSQAWLRLYREGSHPSLVLAHSARKLSAGFNASIWVHELLPNDSGDEAAAYEGCAAWFAQSPKKALLAETGVGTLDQAMMAVMAFKHQNLHLLGLNDKVLIADEIHSYDAYMSHVVEKLVETRARYGNATILLSATLSQAQRDRLIAAFYKGLNTTRESPRLGPDDYPWIT

SEQ ID NO: 939 - protein, 106 aa, Legionella pneumophila
PVYIPQDVRVGHTFVVGTTRVGKTRLASILINQDIRNGDAVIVVDPKGDQDLVRDMMAACKVSGRTEDFKIVHLGFPEQSAQYNPLKNFDQISEVATRITDAISAE

SEQ ID NO: 940 - protein, 106 aa, Legionella pneumophila; identical to SEQ ID NO: 939

SEQ ID NO: 941 - protein, 106 aa, Legionella pneumophila
PVYIPQDVRVGHTFVVGTTRVGKTRLASILINQDIRNGDAVIVVDPKGDQDLVRDMKAACKVSGRTEDFKIVHLGFPEQSAQYNPLKNFDQISEVATRITDAISAE

SEQ ID NO: 942 - protein, 105 aa, Legionella pneumophila
VYIPQEVRVGHTFVVGTTRVGKTRLASILINQDIRNGDAVIVVDPKGDLDLVRDMYSACKASGRLHDFRVVHLGFPELSAHYNPLKNYDQVSEVATRVTDAIQAE

SEQ ID NO: 943 - protein, 282 aa, Artificial
  Alicyclobacillus acidocaldarius mutated SEQ ID NO 936
MVTHMLTDIKLERHAVPYAPVWIPGRERTGNVLVEGGPGTGKTYCLKTMLHQDIQAMVDGQQDCRMIVISPEGSMCDIEDCTSRLQVDWIKIYSRALHVSSPYEKAFFSALRNLLMVSPDDSQSTCDRVLAEYGLLKPFLYCSRQNTKIVSLYTGYQEIDTFIGAAFVHYLACNMSKITMKPTLLYVDELHRYAAYAPHAVAKLFECGAEHGISLIAAVQSTEQLNTAESPCLSELVNRNTRFHVKMRTSEDRDTLRLAPNQALWITSTTRHVIEVSPQFRN

SEQ ID NO: 944 - protein, 282 aa, Artificial
  Alicyclobacillus acidocaldarius mutated SEQ ID NO 936
MVTHMLTDIKLERHAVPYAPVWIPGRERTGNVLVEGGPGTGKTYCLKTMLHQDIQAMVDGQQDCRMIVISPEGSMCDIEDCTSRLQVDWIKIYSRALHVSSPYEKAFFSALRNLLMVSPDDSQSTCDRVLAEYGLLKPFLYCSRQNTKIVSLYTGYQEIDTFIGAAFVHYLACNMSKITMKPTILYVDELHRYAAYAPHAVAKLFECGAEHGISLIAAVQSTEQLNTAESPCLSELVNRNTRFHVKMRTSEDRDTLRLAPNQALWITSTTRHVLEVSPQFRN

SEQ ID NO: 945 - protein, 282 aa, Artificial
  Alicyclobacillus acidocaldarius mutated SEQ ID NO 936
MVTHMLTDIKLERHAVPYAPVWIPGRERTGNVLVEGGPGTGKTYCLKTMLHQDIQAMVDGQQDCRMIVISPEGSMCDIEDCTSRLQVDWIKIYSRALHVSSPYEKAFFSALRNLLMVSPDDSQSTCDRVLAEYGLLKPFLYCSRQNTKIVSLYTGYQEIDTFIGAAFVHYLACNMSKITMKPTILYVDELHRYAAYAPHAVAKLFECGAEHGISLIAAVQSTEQLNTAESPCLSDLVNRNTRFHVKMRTSEDRDTLRLAPNQALWITSTTRHVIEVSPQFRN

SEQ ID NO: 946 - protein, 282 aa, Artificial
  Alicyclobacillus acidocaldarius mutated SEQ ID NO 936
MVTHMLTDIKLERHAVPYAPVWIPGRERTGNVLVEGGPGTGKTYCLKTMLHQDIQAMVDGQQDCRMIVISPEGSMCDIEDCTSRLQVDWIKIYSRALHVSSPYEKAFFSALRNLLMVSPDDSQSTCDRVLAEYGLLKPFLYCSRQNTKIVSLYTGYQEIDTFIGAAFVHYLACNMSKITMKPTILYVDELHRYAAYAPHAVAKLFECGAEHGISLIAAVQSTEQLNTAESPCLSELVNRNTRFHVRMRTSEDRDTLRLAPNQALWITSTTRHVIEVSPQFRN

SEQ ID NO: 947 - protein, 282 aa, Artificial
  Alicyclobacillus acidocaldarius mutated SEQ ID NO 936
MVTHMLTDIKLERHAVPYAPVWIPGRERTGNVLVEGGPGTGKTYCLKTMLHQDIQAMVDGQQDCRMIVISPEGSMCDIEDCTSRLQVDWIKIYSRALHVSSPYEKAFFSALRNLLMVSPDDSQSTCDRVLAEYGLLKPFLYCSRQNTKIVSLYTGYQEIETFIGAAFVHYLACNMSKITMKPTILYVDELHRYAAYAPHAVAKLFECGAEHGISLIAAVQSTEQLNTAESPCLSELVNRNTRFHVKMRTSEDRDTLRLAPNQALWITSTTRHVIEVSPQFRN

SEQ ID NO: 948 - DNA, 849 bp, Artificial
  Alicyclobacillus acidocaldarius mutated SEQ ID NO 937
gtggtcacacacatgttaacggacatcaagttagagcgtcatgcagttccttatgcgccagtttggataccgggaagggaaagaaccgggaatgtcctcgttgaaggtggcccgggaactggaaagacatattgcctgaagactatgctgcatcaagacattcaagcgatggttgacggacaacaagactgcagaatgattgtcatctcaccggaaggtagtatgtgtgacatcgaagattgcacaagtagattgcaagtggattggatcaaaatttactctagggccttgcatgtaagctctccatatgaaaaagcgtttttcagtgctttacgaaaccttctaatggtgagcccggatgattcacagtccacatgcgaccgggtactggccgaatacgggttattgaaaccattcctatattgctcaaggcaaaacaccaaaattgtctcgttgtatacaggatatcaagagatcgacacattcatcggcgcagcgtttgtgcattatctagcttgcaacatgagcaaaatcacgatgaagccaaccttactgtatgttgatgaacttcaccgttacgctgcctatgcgccacacgcagtagcgaagttatttgagtgcggagcagagcatggaatatctttgatcgccgcagttcagtccacagaacagctgaacaccgcggaatcgccatgcctgagtgaattggtcaatcgaaacactcgctttcatgtgaagatgcgaacctcagaggatagagatacactccgcctcgcacccaatcaggcgttgtggatcacaagcacaacaaggcatgttatcgaagtatctcctcaatttagaaattaa

SEQ ID NO: 949 - DNA, 849 bp, Artificial
  Alicyclobacillus acidocaldarius mutated SEQ ID NO 937
gtggtcacacacatgttaacggacatcaagttagagcgtcatgcagttccttatgcgccagtttggataccgggaagggaaagaaccgggaatgtcctcgttgaaggtggcccgggaactggaaagacatattgcctgaagactatgctgcatcaagacattcaagcgatggttgacggacaacaagactgcagaatgattgtcatctcaccggaaggtagtatgtgtgacatcgaagattgcacaagtagattgcaagtggattggatcaaaatttactctagggccttgcatgtaagctctccatatgaaaaagcgtttttcagtgctttacgaaaccttctaatggtgagcccggatgattcacagtccacatgcgaccgggtactggccgaatacgggttattgaaaccattcctatattgctcaaggcaaaacaccaaaattgtctcgttgtatacaggatatcaagagatcgacacattcatcggcgcagcgtttgtgcattatctagcttgcaacatgagcaaaatcacgatgaagccaaccattctgtatgttgatgaacttcaccgttacgctgcctatgcgccacacgcagtagcgaagttatttgagtgcggagcagagcatggaatatctttgatcgccgcagttcagtccacagaacagctgaacaccgcggaatcgccatgcctgagtgaattggtcaatcgaaacactcgctttcatgtgaagatgcgaacctcagaggatagagatacactccgcctcgcacccaatcaggcgttgtggatcacaagcacaacaaggcatgttttagaagtatctcctcaatttagaaattaa

SEQ ID NO: 950 - DNA, 849 bp, Artificial
  Alicyclobacillus acidocaldarius mutated SEQ ID NO 937
gtggtcacacacatgttaacggacatcaagttagagcgtcatgcagttccttatgcgccagtttggataccgggaagggaaagaaccgggaatgtcctcgttgaaggtggcccgggaactggaaagacatattgcctgaagactatgctgcatcaagacattcaagcgatggttgacggacaacaagactgcagaatgattgtcatctcaccggaaggtagtatgtgtgacatcgaagattgcacaagtagattgcaagtggattggatcaaaatttactctagggccttgcatgtaagctctccatatgaaaaagcgtttttcagtgctttacgaaaccttctaatggtgagcccggatgattcacagtccacatgcgaccgggtactggccgaatacgggttattgaaaccattcctatattgctcaaggcaaaacaccaaaattgtctcgttgtatacaggatatcaagagatcgacacattcatcggcgcagcgtttgtgcattatctagcttgcaacatgagcaaaatcacgatgaagccaaccattctgtatgttgatgaacttcaccgttacgctgcctatgcgccacacgcagtagcgaagttatttgagtgcggagcagagcatggaatatctttgatcgccgcagttcagtccacagaacagctgaacaccgcggaatcgccatgcctgagtgatttggtcaatcgaaacactcgctttcatgtgaagatgcgaacctcagaggatagagatacactccgcctcgcacccaatcaggcgttgtggatcacaagcacaacaaggcatgttatcgaagtatctcctcaatttagaaattaa

SEQ ID NO: 951 - DNA, 849 bp, Artificial
  Alicyclobacillus acidocaldarius mutated SEQ ID NO 937
gtggtcacacacatgttaacggacatcaagttagagcgtcatgcagttccttatgcgccagtttggataccgggaagggaaagaaccgggaatgtcctcgttgaaggtggcccgggaactggaaagacatattgcctgaagactatgctgcatcaagacattcaagcgatggttgacggacaacaagactgcagaatgattgtcatctcaccggaaggtagtatgtgtgacatcgaagattgcacaagtagattgcaagtggattggatcaaaatttactctagggccttgcatgtaagctctccatatgaaaaagcgtttttcagtgctttacgaaaccttctaatggtgagcccggatgattcacagtccacatgcgaccgggtactggccgaatacgggttattgaaaccattcctatattgctcaaggcaaaacaccaaaattgtctcgttgtatacaggatatcaagagatcgacacattcatcggcgcagcgtttgtgcattatctagcttgcaacatgagcaaaatcacgatgaagccaaccattctgtatgttgatgaacttcaccgttacgctgcctatgcgccacacgcagtagcgaagttatttgagtgcggagcagagcatggaatatctttgatcgccgcagttcagtccacagaacagctgaacaccgcggaatcgccatgcctgagtgaattggtcaatcgaaacactcgctttcatgtgcgtatgcgaacctcagaggatagagatacactccgcctcgcacccaatcaggcgttgtggatcacaagcacaacaaggcatgttatcgaagtatctcctcaatttagaaattaa

SEQ ID NO: 952 - DNA, 849 bp, Artificial
  Alicyclobacillus acidocaldarius mutated SEQ ID NO 937
gtggtcacacacatgttaacggacatcaagttagagcgtcatgcagttccttatgcgccagtttggataccgggaagggaaagaaccgggaatgtcctcgttgaaggtggcccgggaactggaaagacatattgcctgaagactatgctgcatcaagacattcaagcgatggttgacggacaacaagactgcagaatgattgtcatctcaccggaaggtagtatgtgtgacatcgaagattgcacaagtagattgcaagtggattggatcaaaatttactctagggccttgcatgtaagctctccatatgaaaaagcgtttttcagtgctttacgaaaccttctaatggtgagcccggatgattcacagtccacatgcgaccgggtactggccgaatacgggttattgaaaccattcctatattgctcaaggcaaaacaccaaaattgtctcgttgtatacaggatatcaagagatcgaaacattcatcggcgcagcgtttgtgcattatctagcttgcaacatgagcaaaatcacgatgaagccaaccattctgtatgttgatgaacttcaccgttacgctgcctatgcgccacacgcagtagcgaagttatttgagtgcggagcagagcatggaatatctttgatcgccgcagttcagtccacagaacagctgaacaccgcggaatcgccatgcctgagtgaattggtcaatcgaaacactcgctttcatgtgaagatgcgaacctcagaggatagagatacactccgcctcgcacccaatcaggcgttgtggatcacaagcacaacaaggcatgttatcgaagtatctcctcaatttagaaattaa

SEQ ID NO: 953 - protein, 844 aa, Alicyclobacillus acidocaldarius
MYALAYWRAKRKEHRRMPEVPALVRVSIAHSTWFMVVIGAIGAFALYRSVFRALGRMAQLGTLAVIAMAGFGVVKLHGLIAAWQNRMLHPSTPKAATTATNSHAIINPLTSGTGPKLPLSALNATNPLVHENAWVIALALVAGVLGLLAFFVYRGLSPTAKAQFLQRMQATDFDRSTHRRDDDPNKFSLVGVEVGIRKDNGRPIRIEGKDRFINTLVLGSTGTGKTSRIMLKAVYQDLRSMANGTPMDVIAMDPDGGFAQAAVNMANQLGVETIIMDLRGTMPSTVSFSPFGGEIADIIDNVRAALQEKMGKQDGFFQNAQDDLVRTVIQVQVPLWPEADFLQFADLVTDPLHFRAICSMVQDCAAQEAGTAKKKRKSEMDEAMSMWEHERPEVEARFHRLTPHEKSMVLSAARSFLMDTATEQKLEKLETITKGLKIVVNELATNPRLRQVFKTDELPPFDFQGFLAAGKEQPGRLVVVVTGNRPAGKLFGKLFLVTLKMYALEREGTEDTRRPVYLYVDEFAVYGTESFTEMFSQARKYRVGMMLAIQARAQLLDVSKKFMDVVEGSCRNKIYFPAPSPDDARFLEHALGSVKNIRETYSENKLSWFFDTRNLDRRVSTQETIDPRYRLEDISYGLSKDEAIFAMTVDNQVQAPCVGITSYADEWVKKQRGFFDVRRSQNRSQRQPTPINVAVKVVEHGVSERRSMPEPRDETYVPSPASPSKVRPTADRNAKINVQAFARAIQEAAFHMSDASRADTVDVEPVETHTETSPQQGETSPYASPNESTAQEAERPIEEPAIVRIDLRPQRPPKRCPQCEAELTLTPDERKWRCPRCGFERKNR

SEQ ID NO: 954 - DNA, 2535 bp, Alicyclobacillus acidocaldarius
gtgtatgcgctagcttattggcgagcaaagcgaaaggagcatcgacgcatgccggaagtccctgcgcttgtgcgcgtaagcatcgcgcattcgacgtggttcatggtcgtcattggcgcaattggcgcgtttgcgttgtatcgatccgtctttcgcgcgctcgggcgcatggctcaactcggtacattggccgtcatcgccatggccgggtttggcgtggtgaaactgcatggtctgatcgcagcgtggcagaaccgtatgctgcatccaagcacgccgaaggccgcaaccaccgcgaccaacagccatgcaatcatcaacccgctcacatccggtacagggccaaagctcccgctttccgcactgaacgcgacaaacccgctggtgcatgagaatgcctgggtgatcgcgttggccttagtggccggagtcctcggcctactggccttcttcgtatatcgaggcctgtctccaacagcaaaagcgcagttcttgcaacgcatgcaggccacggatttcgataggagcacccatcgtcgtgatgacgatccgaacaagttttcactcgtcggggtcgaagtcggcatccgaaaagataacggccgaccgattcgcattgaagggaaagaccggtttatcaacaccttagtgcttggttccaccggcacggggaagacaagccgtatcatgctcaaagctgtgtaccaggaccttcgttcgatggcaaacggcactcccatggacgtgatcgcgatggaccccgacggcggattcgcacaagccgcagtgaacatggcgaatcagttgggcgtggagaccatcatcatggatttgcgcggcacgatgccgagtacggtgtcgttcagcccgttcggtggcgagattgcggacatcatcgacaatgtgcgtgctgcactccaagagaagatgggcaagcaggacgggttcttccaaaacgcgcaggacgacttggtgcggacggtgatacaggttcaggtgccgctttggccagaagcggacttcttgcagttcgcagatctggtgaccgatccgctccacttccgtgcgatttgcagcatggtgcaagactgcgcggctcaagaagcggggacggcgaagaaaaagcgcaagagcgaaatggatgaggccatgagcatgtgggagcacgagcgaccggaggtcgaggcccgattccataggctcactccgcacgaaaagagcatggtgctttcggcagcgcgctcgttcctcatggacaccgcgaccgaacagaagctggagaagttggagaccatcacgaaaggcctcaagatcgtcgtcaatgagttggcgacgaaccctcgcctgcgacaggtattcaagacagacgagctcccgccgtttgactttcagggctttctcgcggcaggcaaagaacaacctgggcgtttggtcgtggtcgtgacggggaaccgtccggccggcaaactcttcggcaagctgttcctggtcaccctcaagatgtacgcgctcgaacgcgaaggcacggaagatacgcgccgacccgtgtatctctacgtcgacgaattcgccgtctacggcaccgagtcgttcaccgagatgttctcccaagcgcgcaagtaccgcgtcggtatgatgctcgccattcaagcgcgagcgcagctccttgatgtcagcaagaagttcatggacgtcgtggaggggagctgtcgcaacaaaatctacttcccggccccgtctccggatgatgcgcgcttcttggagcacgcgctgggatccgtgaagaacattcgcgaaacctattcagaaaacaagctcagctggttctttgacacccgcaacttggaccggcgcgtgagcacccaggagaccatcgacccgcggtatcgcttggaggacatctcctacgggctttccaaggacgaggcgattttcgccatgaccgtggacaatcaggtgcaggcgccctgtgtcggcatcacgtcgtacgcagatgaatgggtgaaaaagcaacgcggattcttcgacgtgcgccgttcgcagaacagatcgcaacgacagccgacgcctatcaacgtagcggtaaaagtcgtcgaacatggggtatcagaaaggcggtctatgccggaacctcgtgacgaaacctatgtcccaagtcctgcatcgccgtcgaaggtacgacccacggcagatcggaacgcgaaaatcaatgttcaagccttcgcgcgcgcgatccaagaggcggctttccatatgtccgatgcgtcgcgcgccgataccgtagatgtcgagccagtcgaaactcacacggagacatcgccccaacagggggaaacaagcccatatgcgtcgccgaatgagtcgacagcgcaagaggccgagagacccatagaagagccagccattgtccgtatcgacttacggcctcagcgaccgccgaaacgttgcccacagtgcgaagcagaactgaccttgacgccggatgagcgcaaatggcggtgtccgcggtgcgggtttgaacggaagaatcgatga

SEQ ID NO: 955 - protein, 443 aa, Clostridium difficile
KIESINGEAGETLDTPVFIPLKDRFLHMLILGPTGCGKTSQTIIPMINQDLQNKEIGVTVLEPKSDLAEKVYQMAKIHNREVIYFNPLLADCPYFNPLFGHESEVIENMATTFNMLNPDSPQFFKDMSDGLIRKSVKLLKRLYGDDATLIDLNDLVWNSNGIGKKIVNEFSKLPVKNPLQQKENEEIAIWFLTDYYSGMTGDRKGTKTYEHCSGVRTQISKLVSNEYLRKALNPPRGHGTDIDFDKALEEGLVITMTTTQGSLRDLGKFLGYFIILQLQSSVFRRPGDEDSRRENMLYIDEFQVYANQGFGEMLTQGRSYRVASHLATQARDQMSVGREGDSFLELVSANARNKIIYPGISITDAKYYSEEFGEELRTTIGKSYSKDRYFSSFSDEKMTTKVDERYEPRFSPSNLIYRDFGQITHCLVKNNTVQIPALAQIEY

SEQ ID NO: 956 - protein, 605 aa, Lysinibacillus sphaericus
LILFVLPALISGLMIFIQVRDFMVHKDMLSESFMTWKAPIIRRFTHKKLLGTADIIIGYQFKTMIPIVLKEAQRFLHEAVIGATGSGKTSTALLLRIAQDLINIATGRRKMGLVFLEPKGDGVDDVLKMCKKLKIPDEKIKVIDATKAFTIKFNPFIGPSAPAAATFEGTINALSGDQDDFYKGQQNEAASTLTKLAKIAFGEKTNIFHIQRMFSDPRYLANIVESIREQITTNREKQFREQKDLIMLLDSLGTSVEHIEQTEHELMFKLKNLSNSSAINENQKKLNEIQELKKRNNLLRAQQIEIDNTEQIIFYFENEVLLYKVDQRTQQPILYPKNHIYANQQMVESKKDKFVTGAKKYLNDIALNDLLKNLFIGAEGEEVFDADEFLREGGVLLVNTSLAELDELSLMFGQFFIRQFQSAIFRRPQEGRIPIFFYIDEFPLYVNEAFERILTLGRSYNVGAVIAMQSIGQLEGVKAGYQDIILGNASSKTVFGRGPNKDNEYFSLEFGEKEINEESLNESASPMTSEDQKWGYRLNTAKKKVARFSTTAIRELPFKHMIVQIVDETNSIAPPLKAVGRFVNEARFIKPYLNLKKSDIKSNQE

SEQ ID NO: 957 - protein, 433 aa, Bacillus cereus
VEIGPHIEHKEMVRIKGKDRTLNCIIIGPIGSGKTSSLIIPMINQDLHWMARFINKFINVFKKKDYHTEEVKGTFLNGVTVIEPSNDLCQKVFKLVQAHKIPESAVYYIDPTNPDTKNINILRGPVDKVAEVFAMVIQGLSESNNAFFEQAQRNHLKQHIYLLKLHNPQKDVTFDDLIEMYDDVEHVHRMHKLLKVQVEKLYDFVQSGAASRDQKNEYKIIKGIHEWFDNTIREKLDFQGEPAVYKSGKYRGQPMHYDREEEYVKGLRNILKDLASNVLIRRVLFGKSDFDFDVHLEQGGILLVNTAKGELADLSNVLGKFVLLSMQNAVFRRDPNVSPYHHIIVDEFPDYVVRPFKEFPAQSRKYKVILTIASQTLSQLALDFTEQYMFTLLGSFRNKMIFGDVTPYDAKIFSDMFGEKEEFKEAESEQGIS

SEQ ID NO: 958 - protein, 433 aa, Bacillus cereus
VEIGPHIEHKEMVRIKGKDRTLNCIIIGPIGSGKTSSLIIPMINQDLHWMARFINKFINVFKKKDYHTEEVKGTFLNGVTVIEPSNDLCQKVFKLVQAHKIPESAVYYIDPTNPDTKNINILRGPVDKVAEVFAMVIQGLSESNNAFFEQAQRNHLKQHIYLLKLHNPQKDVTFDDLIEMYDDVERVHRMHKLLKVQVEKLYDFVQSGAASRDQKNEYKIIKGIDEWFDNTIREKLDFQGEPAVYKSGKYRGQPMHYDREEEYVKGLRNILKDLASNVLIRRVLFGKSDFDFDVHLEQGGILLVNTAKGELADLSNVLGKFVLLSMQNAVFRRDPNVSPYHHIIVDEFPDYVVRPFKEFPAQSRKYKVILTIASQTLSQLALDFTEQYMFTLLGSFRNKMIFGDVTPYDAKIFSDMFGEKEEFKEAESEQGIS

SEQ ID NO: 959 - protein, 433 aa, Bacillus cereus
VDIGPHIKHKEMIRIKGKDRTLNGIIIGPIGSGKTSSLIIPMINQDLHWMVRFINKFENTYKKNNYDTEEVKGTFLNGITVIEPSNDLCQKVFKLVQAHKIPESSIYYIDPTNPDTKNINILRGPVDKVAEVFAMVIQGLSESNNAFFEQAQRNHLKQHIYLLKLHNPQKDVTFDDLIDMYDDVEHVHRMHKLLKVQVEKLYDFVQSGVASRDQKNEYKIIKGIDEWFDNTIREKTGFQGEPAVYKSGKYRGKPMHYDREEEYVKGLRNILKDLASNVLIRRVLFGKSDFDFDVHLEQGGILLVNTAKGELADLSNVLGKFVLLSMQNAVFRREPNISPYHHIIVDEFPDYVVRPFKEFPAQSRKYKVILTIASQTLSQLALDFTEQYMFTLLGSFRNKMIFGDVTPYDAKIFSDMFGETEEFKESESEQGIS

SEQ ID NO: 960 - protein, 844 aa, Artificial
  Alicyclobacillus acidocaldarius mutated SEQ ID NO 953
MYALAYWRAKRKEHRRMPEVPALVRVSIAHSTWFMVVIGAIGAFALYRSVFRALGRMAQLGTLAVIAMAGFGVVKLHGLIAAWQNRMLHPSTPKAATTATNSHAIINPLTSGTGPKLPLSALNATNPLVHENAWVIALALVAGVLGLLAFFVYRGLSPTAKAQFLQRMQATDFDRSTHRRDDDPNKFSLVGVEVGIRKDNGRPIRIEGKDRFINTLVLGSTGTGKTSRIMLKAVYQDLRSMANGTPMDVIAMDPDGGFAQAAVNMANQLGVETIIMDLRGTMPSTVSFSPFGGEIADIIDNVRAALQEKMGKQDGFFQNAQDDLVRTVIQVQVPLWPEADFLQFADLVTDPLHFRAICSMVQDCAAQEAGTAKKKRKSEMDEAMSMWEHERPEVEARFHRLTPHEKSMVLSAARSFLMDTATEQKLEKLETITKGLKIVVNELATNPRLRQVFKTDELPPFDFQGFLAAGKENPGRLVVVVTGNRPAGKLFGKLFLVTLKMYALEREGTEDTRRPVYLYVDEFAVYGTESFTEMFSQARKYRVGMMLAIQARAQLLDVSKKFMDVVEGSCRNKIYFPAPSPDDARFLEHALGSVKNIRETYSENKLSWFFDTRNLDRRVSTQETIDPRYRLEDISYGLSKDEAIFAMTVDNQVQAPCVGITSYADEWVKKQRGFFDVRRSQNRSQRQPTPINVAVKVVEHGVSERRSMPEPRDETYVPSPASPSKVRPTADRNAKINVQAFARAIQEAAFHMSDASRADTVDVEPVETHTETSPQQGETSPYASPNESTAQEAERPIEEPAIVRIDLRPQRPPKRCPQCEAELTLTPDERKWRCPRCGFERKNR

SEQ ID NO: 961 - protein, 844 aa, Artificial
  Alicyclobacillus acidocaldarius mutated SEQ ID NO 953
MYALAYWRAKRKEHRRMPEVPALVRVSIAHSTWFMVVIGAIGAFALYRSVFRALGRMAQLGTLAVIAMAGFGVVKLHGLIAAWQNRMLHPSTPKAATTATNSHAIINPLTSGTGPKLPLSALNATNPLVHENAWVIALALVAGVLGLLAFFVYRGLSPTAKAQFLQRMQATDFDRSTHRRDDDPNKFSLVGVEVGIRKDNGRPIRIEGKDRFINTLVLGSTGTGKTSRIMLKAVYQDLRSMANGTPMDVIAMDPDGGFAQAAVNMANQLGVETIIMDLRGTMPSTVSFSPFGGEIADIIDNVRAALQEKMGKQDGFFQNAQDDLVRTVIQVQVPLWPEADFLQFADLVTDPLHFRAICSMVQDCAAQEAGTAKKKRKSEMDEAMSMWEHERPEVEARFHRLTPHEKSMVLSAARSFLMDTATEQKLEKLETITKGLKIVVNELATNPRLRQVFKTDELPPFDFQGFLAAGKEQPGRLVVVVTGNRPAGKLFGKLFLVTLKMYALEREGTEDTRRPVYLYVDEFAVYGTESFTEMFSQARKYRVGMMLAIQARAQLLDVSKKFMDVVEGSCRNKIYFPAPSPDDARFLEHALGSVKNIRETYSENKLSWFFDTRNLDRRVSTQETIDPRYRLEDISYGLSKDEAIFAMTVDNQVQAPCVGITSYADEWVKKQRGFFDVRRSQNRSNRQPTPINVAVKVVEHGVSERRSMPEPRDETYVPSPASPSKVRPTADRNAKINVQAFARAIQEAAFHMSDASRADTVDVEPVETHTETSPQQGETSPYASPNESTAQEAERPIEEPAIVRIDLRPQRPPKRCPQCEAELTLTPDERKWRCPRCGFERKNR

SEQ ID NO: 962 - protein, 844 aa, Artificial
  Alicyclobacillus acidocaldarius mutated SEQ ID NO 953
MYALAYWRAKRKEHRRMPEVPALVRVSIAHSTWFMVVIGAIGAFALYRSVFRALGRMAQLGTLAVIAMAGFGVVKLHGLIAAWQNRMLHPSTPKAATTATNSHAIINPLTSGTGPKLPLSALNATNPLVHENAWVIALALVAGVLGLLAFFVYRGLSPTAKAQFLQRMQATDFDRSTHRRDDDPNKFSLVGVEVGIRKDNGRPIRIEGKDRFINTLVLGSTGTGKTSRIMLKAVYQDLRSMANGTPMDVIAMDPDGGFAQAAVNMANQLGVETIIMDLRGTMPSTVSFSPFGGEIADIIDNVRAALQEKMGKQDGFFQNAQDDLVRTVIQVQVPLWPEADFLQFADLVTDPLHFRAICSMVQDCAAQEAGTAKKKRKSEMDEAMSMWEHERPEVEARFHRLTPHEKSMVLSAARSFLMDTATEQKLEKLETITKGLKIVVNELATNPRLRQVFKTDELPPFDFQGFLAAGKEQPGRLVVVVTGNRPAGKLFGKLFLVTLKMYALEREGTEDTRRPVYLYVDEFAVYGTESFTEMFSQARKYRVGMMLAIQARAQLLDVSKKFMDVVEGSCRNKIYFPAPSPDDARFLEHALGSVKNIRETYSENKLSWFFDTRNLDRRVSTQETIDPRYRLEDISYGLSKDEAIFAMTVDNQVQAPCVGITSYADEWVKKQRGFFDVRRSQNRSQRQPTPINVAVKVVEHGVSERRSMPEPRDETYVPSPASPSKVRPTADRNAKINVQAFARAIQEAAFHMSDASRADTVDVEPVETHTETSPQQGETSPYASPNESTAQEAERPIEEPAIVRIDLRPQRPPKRCPQCEAELTLTPDERKWRCPKCGFERKNR

SEQ ID NO: 963 - protein, 844 aa, Artificial
  Alicyclobacillus acidocaldarius mutated SEQ ID NO 953
MYALAYWRAKRKEHRRMPEVPALVRVSIAHSTWFMVVIGAIGAFALYRSVFRALGRMAQLGTLAVIAMAGFGVVKLHGLIAAWQNRMLHPSTPKAATTATNSHAIINPLTSGTGPKLPLSALNATNPLVHENAWVIALALVAGVLGLLAFFVYRGLSPTAKAQFLQRMQATDFDRSTHRRDDDPNKFSLVGVEVGIRKDNGRPIRIEGKDRFINTLVLGSTGTGKTSRIMLKAVYQDLRSMANGTPMDVIAMDPDGGFAQAAVNMANQLGVETIIMDLRGTMPSTVSFSPFGGEIADIIDNVRAALQEKMGKQDGFFQNAQDDLVRTVIQVQVPLWPEADFLQFADLVTDPLHFRAICSMVQDCAAQEAGTAKKKRKSEMDEAMSMWEHERPEVEARFHRLTPHEKSMVLSAARSFLMDTATEQKLEKLETITKGLKIVVNELATNPRLRQVFKTDELPPFDFQGFLAAGKEQPGRLVVVVTGNRPAGKLFGKLFLVTLKMYALEREGTEDTRRPVYLYVDEFAVYGTESFTEMFSQARKYRVGMMLAIQARAQLLDVSKKFMDVVEGSCRNKIYFPAPSPDDARFLEHALGSVKNIRETYSENKLSWFFDTRNLDRRVSTQETIDPRYRLEDISYGLSKDEAIFAMTVDNQVQAPCVGITSYADEWVKKQRGFFDVRRSQNRSQRQPTPLNVAVKVVEHGVSERRSMPEPRDETYVPSPASPSKVRPTADRNAKINVQAFARAIQEAAFHMSDASRADTVDVEPVETHTETSPQQGETSPYASPNESTAQEAERPIEEPAIVRIDLRPQRPPKRCPQCEAELTLTPDERKWRCPRCGFERKNR

SEQ ID NO: 964 - protein, 844 aa, Artificial
  Alicyclobacillus acidocaldarius mutated SEQ ID NO 953
MYALAYWRAKRKEHRRMPEVPALVRVSIAHSTWFMVVIGAIGAFALYRSVFRALGRMAQLGTLAVIAMAGFGVVKLHGLIAAWQNRMLHPSTPKAATTATNSHAIINPLTSGTGPKLPLSALNATNPLVHENAWVIALALVAGVLGLLAFFVYRGLSPTAKAQFLQRMQATDFDRSTHRRDDDPNKFSLVGIEVGIRKDNGRPIRIEGKDRFINTLVLGSTGTGKTSRIMLKAVYQDLRSMANGTPMDVIAMDPDGGFAQAAVNMANQLGVETIIMDLRGTMPSTVSFSPFGGEIADIIDNVRAALQEKMGKQDGFFQNAQDDLVRTVIQVQVPLWPEADFLQFADLVTDPLHFRAICSMVQDCAAQEAGTAKKKRKSEMDEAMSMWEHERPEVEARFHRLTPHEKSMVLSAARSFLMDTATEQKLEKLETITKGLKIVVNELATNPRLRQVFKTDELPPFDFQGFLAAGKEQPGRLVVVVTGNRPAGKLFGKLFLVTLKMYALEREGTEDTRRPVYLYVDEFAVYGTESFTEMFSQARKYRVGMMLAIQARAQLLDVSKKFMDVVEGSCRNKIYFPAPSPDDARFLEHALGSVKNIRETYSENKLSWFFDTRNLDRRVSTQETIDPRYRLEDISYGLSKDEAIFAMTVDNQVQAPCVGITSYADEWVKKQRGFFDVRRSQNRSQRQPTPINVAVKVVEHGVSERRSMPEPRDETYVPSPASPSKVRPTADRNAKINVQAFARAIQEAAFHMSDASRADTVDVEPVETHTETSPQQGETSPYASPNESTAQEAERPIEEPAIVRIDLRPQRPPKRCPQCEAELTLTPDERKWRCPRCGFERKNR

SEQ ID NO: 965 - DNA, 2535 bp, Artificial
  Alicyclobacillus acidocaldarius mutated SEQ ID NO 954
gtgtatgcgctagcttattggcgagcaaagcgaaaggagcatcgacgcatgccggaagtccctgcgcttgtgcgcgtaagcatcgcgcattcgacgtggttcatggtcgtcattggcgcaattggcgcgtttgcgttgtatcgatccgtctttcgcgcgctcgggcgcatggctcaactcggtacattggccgtcatcgccatggccgggtttggcgtggtgaaactgcatggtctgatcgcagcgtggcagaaccgtatgctgcatccaagcacgccgaaggccgcaaccaccgcgaccaacagccatgcaatcatcaacccgctcacatccggtacagggccaaagctcccgctttccgcactgaacgcgacaaacccgctggtgcatgagaatgcctgggtgatcgcgttggccttagtggccggagtcctcggcctactggccttcttcgtatatcgaggcctgtctccaacagcaaaagcgcagttcttgcaacgcatgcaggccacggatttcgataggagcacccatcgtcgtgatgacgatccgaacaagttttcactcgtcggggtcgaagtcggcatccgaaaagataacggccgaccgattcgcattgaagggaaagaccggtttatcaacaccttagtgcttggttccaccggcacggggaagacaagccgtatcatgctcaaagctgtgtaccaggaccttcgttcgatggcaaacggcactcccatggacgtgatcgcgatggaccccgacggcggattcgcacaagccgcagtgaacatggcgaatcagttgggcgtggagaccatcatcatggatttgcgcggcacgatgccgagtacggtgtcgttcagcccgttcggtggcgagattgcggacatcatcgacaatgtgcgtgctgcactccaagagaagatgggcaagcaggacgggttcttccaaaacgcgcaggacgacttggtgcggacggtgatacaggttcaggtgccgctttggccagaagcggacttcttgcagttcgcagatctggtgaccgatccgctccacttccgtgcgatttgcagcatggtgcaagactgcgcggctcaagaagcggggacggcgaagaaaaagcgcaagagcgaaatggatgaggccatgagcatgtgggagcacgagcgaccggaggtcgaggcccgattccataggctcactccgcacgaaaagagcatggtgctttcggcagcgcgctcgttcctcatggacaccgcgaccgaacagaagctggagaagttggagaccatcacgaaaggcctcaagatcgtcgtcaatgagttggcgacgaaccctcgcctgcgacaggtattcaagacagacgagctcccgccgtttgactttcagggctttctcgcggcaggcaaagaaaatcctgggcgtttggtcgtggtcgtgacggggaaccgtccggccggcaaactcttcggcaagctgttcctggtcaccctcaagatgtacgcgctcgaacgcgaaggcacggaagatacgcgccgacccgtgtatctctacgtcgacgaattcgccgtctacggcaccgagtcgttcaccgagatgttctcccaagcgcgcaagtaccgcgtcggtatgatgctcgccattcaagcgcgagcgcagctccttgatgtcagcaagaagttcatggacgtcgtggaggggagctgtcgcaacaaaatctacttcccggccccgtctccggatgatgcgcgcttcttggagcacgcgctgggatccgtgaagaacattcgcgaaacctattcagaaaacaagctcagctggttctttgacacccgcaacttggaccggcgcgtgagcacccaggagaccatcgacccgcggtatcgcttggaggacatctcctacgggctttccaaggacgaggcgattttcgccatgaccgtggacaatcaggtgcaggcgccctgtgtcggcatcacgtcgtacgcagatgaatgggtgaaaaagcaacgcggattcttcgacgtgcgccgttcgcagaacagatcgcaacgacagccgacgcctatcaacgtagcggtaaaagtcgtcgaacatggggtatcagaaaggcggtctatgccggaacctcgtgacgaaacctatgtcccaagtcctgcatcgccgtcgaaggtacgacccacggcagatcggaacgcgaaaatcaatgttcaagccttcgcgcgcgcgatccaagaggcggctttccatatgtccgatgcgtcgcgcgccgataccgtagatgtcgagccagtcgaaactcacacggagacatcgccccaacagggggaaacaagcccatatgcgtcgccgaatgagtcgacagcgcaagaggccgagagacccatagaagagccagccattgtccgtatcgacttacggcctcagcgaccgccgaaacgttgcccacagtgcgaagcagaactgaccttgacgccggatgagcgcaaatggcggtgtccgcggtgcgggtttgaacggaagaatcgatga

SEQ ID NO: 966 - DNA, 2535 bp, Artificial
  Alicyclobacillus acidocaldarius mutated SEQ ID NO 954
gtgtatgcgctagcttattggcgagcaaagcgaaaggagcatcgacgcatgccggaagtccctgcgcttgtgcgcgtaagcatcgcgcattcgacgtggttcatggtcgtcattggcgcaattggcgcgtttgcgttgtatcgatccgtctttcgcgcgctcgggcgcatggctcaactcggtacattggccgtcatcgccatggccgggtttggcgtggtgaaactgcatggtctgatcgcagcgtggcagaaccgtatgctgcatccaagcacgccgaaggccgcaaccaccgcgaccaacagccatgcaatcatcaacccgctcacatccggtacagggccaaagctcccgctttccgcactgaacgcgacaaacccgctggtgcatgagaatgcctgggtgatcgcgttggccttagtggccggagtcctcggcctactggccttcttcgtatatcgaggcctgtctccaacagcaaaagcgcagttcttgcaacgcatgcaggccacggatttcgataggagcacccatcgtcgtgatgacgatccgaacaagttttcactcgtcggggtcgaagtcggcatccgaaaagataacggccgaccgattcgcattgaagggaaagaccggtttatcaacaccttagtgcttggttccaccggcacggggaagacaagccgtatcatgctcaaagctgtgtaccaggaccttcgttcgatggcaaacggcactcccatggacgtgatcgcgatggaccccgacggcggattcgcacaagccgcagtgaacatggcgaatcagttgggcgtggagaccatcatcatggatttgcgcggcacgatgccgagtacggtgtcgttcagcccgttcggtggcgagattgcggacatcatcgacaatgtgcgtgctgcactccaagagaagatgggcaagcaggacgggttcttccaaaacgcgcaggacgacttggtgcggacggtgatacaggttcaggtgccgctttggccagaagcggacttcttgcagttcgcagatctggtgaccgatccgctccacttccgtgcgatttgcagcatggtgcaagactgcgcggctcaagaagcggggacggcgaagaaaaagcgcaagagcgaaatggatgaggccatgagcatgtgggagcacgagcgaccggaggtcgaggcccgattccataggctcactccgcacgaaaagagcatggtgctttcggcagcgcgctcgttcctcatggacaccgcgaccgaacagaagctggagaagttggagaccatcacgaaaggcctcaagatcgtcgtcaatgagttggcgacgaaccctcgcctgcgacaggtattcaagacagacgagctcccgccgtttgactttcagggctttctcgcggcaggcaaagaacaacctgggcgtttggtcgtggtcgtgacggggaaccgtccggccggcaaactcttcggcaagctgttcctggtcaccctcaagatgtacgcgctcgaacgcgaaggcacggaagatacgcgccgacccgtgtatctctacgtcgacgaattcgccgtctacggcaccgagtcgttcaccgagatgttctcccaagcgcgcaagtaccgcgtcggtatgatgctcgccattcaagcgcgagcgcagctccttgatgtcagcaagaagttcatggacgtcgtggaggggagctgtcgcaacaaaatctacttcccggccccgtctccggatgatgcgcgcttcttggagcacgcgctgggatccgtgaagaacattcgcgaaacctattcagaaaacaagctcagctggttctttgacacccgcaacttggaccggcgcgtgagcacccaggagaccatcgacccgcggtatcgcttggaggacatctcctacgggctttccaaggacgaggcgattttcgccatgaccgtggacaatcaggtgcaggcgccctgtgtcggcatcacgtcgtacgcagatgaatgggtgaaaaagcaacgcggattcttcgacgtgcgccgttcgcagaacagatcgaatcgacagccgacgcctatcaacgtagcggtaaaagtcgtcgaacatggggtatcagaaaggcggtctatgccggaacctcgtgacgaaacctatgtcccaagtcctgcatcgccgtcgaaggtacgacccacggcagatcggaacgcgaaaatcaatgttcaagccttcgcgcgcgcgatccaagaggcggctttccatatgtccgatgcgtcgcgcgccgataccgtagatgtcgagccagtcgaaactcacacggagacatcgccccaacagggggaaacaagcccatatgcgtcgccgaatgagtcgacagcgcaagaggccgagagacccatagaagagccagccattgtccgtatcgacttacggcctcagcgaccgccgaaacgttgcccacagtgcgaagcagaactgaccttgacgccggatgagcgcaaatggcggtgtccgcggtgcgggtttgaacggaagaatcgatga

SEQ ID NO: 967 - DNA, 2535 bp, Artificial
  Alicyclobacillus acidocaldarius mutated SEQ ID NO 954
gtgtatgcgctagcttattggcgagcaaagcgaaaggagcatcgacgcatgccggaagtccctgcgcttgtgcgcgtaagcatcgcgcattcgacgtggttcatggtcgtcattggcgcaattggcgcgtttgcgttgtatcgatccgtctttcgcgcgctcgggcgcatggctcaactcggtacattggccgtcatcgccatggccgggtttggcgtggtgaaactgcatggtctgatcgcagcgtggcagaaccgtatgctgcatccaagcacgccgaaggccgcaaccaccgcgaccaacagccatgcaatcatcaacccgctcacatccggtacagggccaaagctcccgctttccgcactgaacgcgacaaacccgctggtgcatgagaatgcctgggtgatcgcgttggccttagtggccggagtcctcggcctactggccttcttcgtatatcgaggcctgtctccaacagcaaaagcgcagttcttgcaacgcatgcaggccacggatttcgataggagcacccatcgtcgtgatgacgatccgaacaagttttcactcgtcggggtcgaagtcggcatccgaaaagataacggccgaccgattcgcattgaagggaaagaccggtttatcaacaccttagtgcttggttccaccggcacggggaagacaagccgtatcatgctcaaagctgtgtaccaggaccttcgttcgatggcaaacggcactcccatggacgtgatcgcgatggaccccgacggcggattcgcacaagccgcagtgaacatggcgaatcagttgggcgtggagaccatcatcatggatttgcgcggcacgatgccgagtacggtgtcgttcagcccgttcggtggcgagattgcggacatcatcgacaatgtgcgtgctgcactccaagagaagatgggcaagcaggacgggttcttccaaaacgcgcaggacgacttggtgcggacggtgatacaggttcaggtgccgctttggccagaagcggacttcttgcagttcgcagatctggtgaccgatccgctccacttccgtgcgatttgcagcatggtgcaagactgcgcggctcaagaagcggggacggcgaagaaaaagcgcaagagcgaaatggatgaggccatgagcatgtgggagcacgagcgaccggaggtcgaggcccgattccataggctcactccgcacgaaaagagcatggtgctttcggcagcgcgctcgttcctcatggacaccgcgaccgaacagaagctggagaagttggagaccatcacgaaaggcctcaagatcgtcgtcaatgagttggcgacgaaccctcgcctgcgacaggtattcaagacagacgagctcccgccgtttgactttcagggctttctcgcggcaggcaaagaacaacctgggcgtttggtcgtggtcgtgacggggaaccgtccggccggcaaactcttcggcaagctgttcctggtcaccctcaagatgtacgcgctcgaacgcgaaggcacggaagatacgcgccgacccgtgtatctctacgtcgacgaattcgccgtctacggcaccgagtcgttcaccgagatgttctcccaagcgcgcaagtaccgcgtcggtatgatgctcgccattcaagcgcgagcgcagctccttgatgtcagcaagaagttcatggacgtcgtggaggggagctgtcgcaacaaaatctacttcccggccccgtctccggatgatgcgcgcttcttggagcacgcgctgggatccgtgaagaacattcgcgaaacctattcagaaaacaagctcagctggttctttgacacccgcaacttggaccggcgcgtgagcacccaggagaccatcgacccgcggtatcgcttggaggacatctcctacgggctttccaaggacgaggcgattttcgccatgaccgtggacaatcaggtgcaggcgccctgtgtcggcatcacgtcgtacgcagatgaatgggtgaaaaagcaacgcggattcttcgacgtgcgccgttcgcagaacagatcgcaacgacagccgacgcctatcaacgtagcggtaaaagtcgtcgaacatggggtatcagaaaggcggtctatgccggaacctcgtgacgaaacctatgtcccaagtcctgcatcgccgtcgaaggtacgacccacggcagatcggaacgcgaaaatcaatgttcaagccttcgcgcgcgcgatccaagaggcggctttccatatgtccgatgcgtcgcgcgccgataccgtagatgtcgagccagtcgaaactcacacggagacatcgccccaacagggggaaacaagcccatatgcgtcgccgaatgagtcgacagcgcaagaggccgagagacccatagaagagccagccattgtccgtatcgacttacggcctcagcgaccgccgaaacgttgcccacagtgcgaagcagaactgaccttgacgccggatgagcgcaaatggcggtgtccgaaatgcgggtttgaacggaagaatcgatga

SEQ ID NO: 968 - DNA, 2535 bp, Artificial
  Alicyclobacillus acidocaldarius mutated SEQ ID NO 954
gtgtatgcgctagcttattggcgagcaaagcgaaaggagcatcgacgcatgccggaagtccctgcgcttgtgcgcgtaagcatcgcgcattcgacgtggttcatggtcgtcattggcgcaattggcgcgtttgcgttgtatcgatccgtctttcgcgcgctcgggcgcatggctcaactcggtacattggccgtcatcgccatggccgggtttggcgtggtgaaactgcatggtctgatcgcagcgtggcagaaccgtatgctgcatccaagcacgccgaaggccgcaaccaccgcgaccaacagccatgcaatcatcaacccgctcacatccggtacagggccaaagctcccgctttccgcactgaacgcgacaaacccgctggtgcatgagaatgcctgggtgatcgcgttggccttagtggccggagtcctcggcctactggccttcttcgtatatcgaggcctgtctccaacagcaaaagcgcagttcttgcaacgcatgcaggccacggatttcgataggagcacccatcgtcgtgatgacgatccgaacaagttttcactcgtcggggtcgaagtcggcatccgaaaagataacggccgaccgattcgcattgaagggaaagaccggtttatcaacaccttagtgcttggttccaccggcacggggaagacaagccgtatcatgctcaaagctgtgtaccaggaccttcgttcgatggcaaacggcactcccatggacgtgatcgcgatggaccccgacggcggattcgcacaagccgcagtgaacatggcgaatcagttgggcgtggagaccatcatcatggatttgcgcggcacgatgccgagtacggtgtcgttcagcccgttcggtggcgagattgcggacatcatcgacaatgtgcgtgctgcactccaagagaagatgggcaagcaggacgggttcttccaaaacgcgcaggacgacttggtgcggacggtgatacaggttcaggtgccgctttggccagaagcggacttcttgcagttcgcagatctggtgaccgatccgctccacttccgtgcgatttgcagcatggtgcaagactgcgcggctcaagaagcggggacggcgaagaaaaagcgcaagagcgaaatggatgaggccatgagcatgtgggagcacgagcgaccggaggtcgaggcccgattccataggctcactccgcacgaaaagagcatggtgctttcggcagcgcgctcgttcctcatggacaccgcgaccgaacagaagctggagaagttggagaccatcacgaaaggcctcaagatcgtcgtcaatgagttggcgacgaaccctcgcctgcgacaggtattcaagacagacgagctcccgccgtttgactttcagggctttctcgcggcaggcaaagaacaacctgggcgtttggtcgtggtcgtgacggggaaccgtccggccggcaaactcttcggcaagctgttcctggtcaccctcaagatgtacgcgctcgaacgcgaaggcacggaagatacgcgccgacccgtgtatctctacgtcgacgaattcgccgtctacggcaccgagtcgttcaccgagatgttctcccaagcgcgcaagtaccgcgtcggtatgatgctcgccattcaagcgcgagcgcagctccttgatgtcagcaagaagttcatggacgtcgtggaggggagctgtcgcaacaaaatctacttcccggccccgtctccggatgatgcgcgcttcttggagcacgcgctgggatccgtgaagaacattcgcgaaacctattcagaaaacaagctcagctggttctttgacacccgcaacttggaccggcgcgtgagcacccaggagaccatcgacccgcggtatcgcttggaggacatctcctacgggctttccaaggacgaggcgattttcgccatgaccgtggacaatcaggtgcaggcgccctgtgtcggcatcacgtcgtacgcagatgaatgggtgaaaaagcaacgcggattcttcgacgtgcgccgttcgcagaacagatcgcaacgacagccgacgcctttaaacgtagcggtaaaagtcgtcgaacatggggtatcagaaaggcggtctatgccggaacctcgtgacgaaacctatgtcccaagtcctgcatcgccgtcgaaggtacgacccacggcagatcggaacgcgaaaatcaatgttcaagccttcgcgcgcgcgatccaagaggcggctttccatatgtccgatgcgtcgcgcgccgataccgtagatgtcgagccagtcgaaactcacacggagacatcgccccaacagggggaaacaagcccatatgcgtcgccgaatgagtcgacagcgcaagaggccgagagacccatagaagagccagccattgtccgtatcgacttacggcctcagcgaccgccgaaacgttgcccacagtgcgaagcagaactgaccttgacgccggatgagcgcaaatggcggtgtccgcggtgcgggtttgaacggaagaatcgatga

SEQ ID NO: 969 - DNA, 2535 bp, Artificial
  Alicyclobacillus acidocaldarius mutated SEQ ID NO 954
gtgtatgcgctagcttattggcgagcaaagcgaaaggagcatcgacgcatgccggaagtccctgcgcttgtgcgcgtaagcatcgcgcattcgacgtggttcatggtcgtcattggcgcaattggcgcgtttgcgttgtatcgatccgtctttcgcgcgctcgggcgcatggctcaactcggtacattggccgtcatcgccatggccgggtttggcgtggtgaaactgcatggtctgatcgcagcgtggcagaaccgtatgctgcatccaagcacgccgaaggccgcaaccaccgcgaccaacagccatgcaatcatcaacccgctcacatccggtacagggccaaagctcccgctttccgcactgaacgcgacaaacccgctggtgcatgagaatgcctgggtgatcgcgttggccttagtggccggagtcctcggcctactggccttcttcgtatatcgaggcctgtctccaacagcaaaagcgcagttcttgcaacgcatgcaggccacggatttcgataggagcacccatcgtcgtgatgacgatccgaacaagttttcactcgtcgggattgaagtcggcatccgaaaagataacggccgaccgattcgcattgaagggaaagaccggtttatcaacaccttagtgcttggttccaccggcacggggaagacaagccgtatcatgctcaaagctgtgtaccaggaccttcgttcgatggcaaacggcactcccatggacgtgatcgcgatggaccccgacggcggattcgcacaagccgcagtgaacatggcgaatcagttgggcgtggagaccatcatcatggatttgcgcggcacgatgccgagtacggtgtcgttcagcccgttcggtggcgagattgcggacatcatcgacaatgtgcgtgctgcactccaagagaagatgggcaagcaggacgggttcttccaaaacgcgcaggacgacttggtgcggacggtgatacaggttcaggtgccgctttggccagaagcggacttcttgcagttcgcagatctggtgaccgatccgctccacttccgtgcgatttgcagcatggtgcaagactgcgcggctcaagaagcggggacggcgaagaaaaagcgcaagagcgaaatggatgaggccatgagcatgtgggagcacgagcgaccggaggtcgaggcccgattccataggctcactccgcacgaaaagagcatggtgctttcggcagcgcgctcgttcctcatggacaccgcgaccgaacagaagctggagaagttggagaccatcacgaaaggcctcaagatcgtcgtcaatgagttggcgacgaaccctcgcctgcgacaggtattcaagacagacgagctcccgccgtttgactttcagggctttctcgcggcaggcaaagaacaacctgggcgtttggtcgtggtcgtgacggggaaccgtccggccggcaaactcttcggcaagctgttcctggtcaccctcaagatgtacgcgctcgaacgcgaaggcacggaagatacgcgccgacccgtgtatctctacgtcgacgaattcgccgtctacggcaccgagtcgttcaccgagatgttctcccaagcgcgcaagtaccgcgtcggtatgatgctcgccattcaagcgcgagcgcagctccttgatgtcagcaagaagttcatggacgtcgtggaggggagctgtcgcaacaaaatctacttcccggccccgtctccggatgatgcgcgcttcttggagcacgcgctgggatccgtgaagaacattcgcgaaacctattcagaaaacaagctcagctggttctttgacacccgcaacttggaccggcgcgtgagcacccaggagaccatcgacccgcggtatcgcttggaggacatctcctacgggctttccaaggacgaggcgattttcgccatgaccgtggacaatcaggtgcaggcgccctgtgtcggcatcacgtcgtacgcagatgaatgggtgaaaaagcaacgcggattcttcgacgtgcgccgttcgcagaacagatcgcaacgacagccgacgcctatcaacgtagcggtaaaagtcgtcgaacatggggtatcagaaaggcggtctatgccggaacctcgtgacgaaacctatgtcccaagtcctgcatcgccgtcgaaggtacgacccacggcagatcggaacgcgaaaatcaatgttcaagccttcgcgcgcgcgatccaagaggcggctttccatatgtccgatgcgtcgcgcgccgataccgtagatgtcgagccagtcgaaactcacacggagacatcgccccaacagggggaaacaagcccatatgcgtcgccgaatgagtcgacagcgcaagaggccgagagacccatagaagagccagccattgtccgtatcgacttacggcctcagcgaccgccgaaacgttgcccacagtgcgaagcagaactgaccttgacgccggatgagcgcaaatggcggtgtccgcggtgcgggtttgaacggaagaatcgatga

SEQ ID NO: 970 - protein, 252 aa, Alicyclobacillus acidocaldarius
MMGRSHMAIGAVGAVAATPLVLHERWESLRDLLTHPWASMPHIVVVQAAFVAATVVGALVPDLDQQDAKLTYTIEIVFGLPVLALAIVVMVLMHWATSLTAWGIALLLMFIFGAAHNVTRMLGLGALATILLDLAYHHRMPMEAAVLLAAWMVATMPAKHRTFTHSLLGLAVFGAGCYLSEPALSHLHLGVAAYGLILGYVLHMAADFIAGGVPLLWPWGKRQGVHLVKSFSAVDYLIGGIGIFTFVGLALV

SEQ ID NO: 971 - DNA, 759 bp, Alicyclobacillus acidocaldarius
atgatgggtcgttcccatatggccattggcgcagtcggggcggttgcggcgacaccactggttttacatgagcgctgggagtcgttgcgggatttactcacgcatccctgggcctcgatgccgcatatcgtcgtcgtccaggctgcgtttgtcgcggctacggtggtcggagcgctggtgccggatttggatcagcaggatgccaagctgacctacaccatcgaaatcgtgtttggcctgccggttttggccctggccatcgtggtaatggtgctcatgcactgggcgacgtcgctcaccgcatggggcatagcactcttgctcatgttcatcttcggcgcagcgcacaacgtcacgcgcatgctcggcttgggcgcccttgcgaccattttgctcgacttggcgtaccaccatcgcatgccgatggaagccgcggtattgctcgccgcttggatggtggcgacgatgccggccaaacaccggacattcacccacagcctgctgggcctcgctgtgtttggagcgggctgttacctgagtgagccggcgctgagtcacttgcacctgggcgttgccgcgtacggcctcatcttggggtatgtgctccacatggcggcggacttcatcgcgggcggtgtaccgctcctttggccgtggggaaagcgccaaggcgtgcacctggtgaagtcgttcagcgctgtcgactacctcattggtggcatcgggattttcacgtttgttggactcgcactcgtgtag

SEQ ID NO: 972 - protein, 181 aa, Clostridium acetobutylicum
AVGLAVGVLGALMPDIDTSRSKVSYNLRKIVVYAALVIVGAYILMANFYPEVEKTNLFLKNMGVYKLKDYIPYNLKLSNAGLLIIVGCIIFSKFTKHRSFSHSILGLILFTVGVKLLLGNIFIYFAVGFISHMVADTFTNSGIEVFYPIKKKISLKLVHTGSMLDHFTGGLAFIVFLAIIL

SEQ ID NO: 973 - protein, 143 aa, Magnetospirillum magneticum
MMVVSHVVLGVSAWTLAQRAGLAVPLGPEGAAAAALGALLPDIDHPSSWLGRRLWPISKPISMVLGHRGLTHSLLAVMGGLAVLMLVEPGRGLVRLAEPLALGYLSHLAADALTPAGVPLLWPWKQRFGVGLCSTGGVMEWLV

SEQ ID NO: 974 - protein, 176 aa, Bacillus  SG-1
IGAGGISGLIPDLDVDGKLSNTFTSSYKFLMTLVQFIGVAVIVYSWWAGTDQEMWKGIAAGLGIMLVSSFIKKRHLLTVAGGGALAGGMFLAETWLQLLGIYIVIASLVSHRSYTHSLIGLAFFAVIAYYLQASIKTEGILLACTGGYVSHLIADMKWLPFNKRGIKLFLPVSRKE

SEQ ID NO: 975 - protein, 116 aa, Moorella thermoacetica
IGRGIVGIAILGAWHQTRLPLLLPAGVAFVALAFLPHRGITHSALGLVLAWLAIKTLGWPQVPFLIGYGIHLAEDLLTPSGIPLLYPWQERMRIPLAQTGGIIDRTLGLAALALFL

SEQ ID NO: 976 - protein, 71 aa, Rubrobacter xylanophilus
LRATSFVLVRTVGHRTLTHSLLGLALFCAPVWLLLGGYPAFALALAAGYASHLLADALNTRGVPLLWPLGK

SEQ ID NO: 977 - protein, 252 aa, Artificial
  Alicyclobacillus acidocaldarius mutated SEQ ID NO 970
MMGRSHMAIGAVGAVAATPLVLHERWESLRDLLTHPWASMPHIVVVQAAFVAATVVGALVPDLDQQDAKLTYTIEIVFGLPVLALAIIVMVLMHWATSLTAWGIALLLMFIFGAAHNVTRMLGLGALATILLDLAYHHRMPMEAAVLLAAWMVATMPAKHRTFTHSLLGLAVFGAGCYLSEPALSHLHLGVAAYGLILGYVLHMAADFIAGGVPLLWPWGKRQGVHLVKSFSAVDYLIGGIGIFTFVGLALV

SEQ ID NO: 978 - protein, 252 aa, Artificial
  Alicyclobacillus acidocaldarius mutated SEQ ID NO 970
MMGRSHMAIGAVGAVAATPLVLHERWESLRDLLTHPWASMPHIVVVQAAFVAATVVGALVPDLDQQDAKLTYTIEIVFGLPVLALAIVVMVLMHWATSLTAWGIALLLMFIFGAAHNVTRMLGLGALATILLDLAYHHRMPMEAAVLLAAWMVATMPAKHRTFTHSLLGLAVFGAGCYLSEPALSHIHLGVAAYGLILGYVLHMAADFIAGGVPLLWPWGKRQGVHLVKSFSAVDYLIGGIGIFTFVGLALV

SEQ ID NO: 979 - protein, 252 aa, Artificial
  Alicyclobacillus acidocaldarius mutated SEQ ID NO 970
MMGRSHMAIGAVGAVAATPLVLHERWESLRDLLTHPWASMPHIVVVQAAFVAATVVGALVPDLDQQDAKLTYTIEIVFGLPVLALAIVVMVLMHWATSLTAWGIALLLMFIFGAAHNVTRMLGLGALATILLDLAYHHRMPMEAAVLLAAWMVATMPAKHRTFTHSILGLAVFGAGCYLSEPALSHLHLGVAAYGLILGYVLHMAADFIAGGVPLLWPWGKRQGVHLVKSFSAVDYLIGGIGIFTFVGLALV

SEQ ID NO: 980 - protein, 252 aa, Artificial
  Alicyclobacillus acidocaldarius mutated SEQ ID NO 970
MMGRSHMAIGAVGAVAATPLVLHERWESLRDLLTHPWASMPHIVVVQAAFVAATVVGALVPDLDQQEAKLTYTIEIVFGLPVLALAIVVMVLMHWATSLTAWGIALLLMFIFGAAHNVTRMLGLGALATILLDLAYHHRMPMEAAVLLAAWMVATMPAKHRTFTHSLLGLAVFGAGCYLSEPALSHLHLGVAAYGLILGYVLHMAADFIAGGVPLLWPWGKRQGVHLVKSFSAVDYLIGGIGIFTFVGLALV

SEQ ID NO: 981 - protein, 252 aa, Artificial
  Alicyclobacillus acidocaldarius mutated SEQ ID NO 970
MMGRSHMAIGAVGAVAATPLVLHERWESLKDLLTHPWASMPHIVVVQAAFVAATVVGALVPDLDQQDAKLTYTIEIVFGLPVLALAIVVMVLMHWATSLTAWGIALLLMFIFGAAHNVTRMLGLGALATILLDLAYHHRMPMEAAVLLAAWMVATMPAKHRTFTHSLLGLAVFGAGCYLSEPALSHLHLGVAAYGLILGYVLHMAADFIAGGVPLLWPWGKRQGVHLVKSFSAVDYLIGGIGIFTFVGLALV

SEQ ID NO: 982 - DNA, 759 bp, Artificial
  Alicyclobacillus acidocaldarius mutated SEQ ID NO 971
atgatgggtcgttcccatatggccattggcgcagtcggggcggttgcggcgacaccactggttttacatgagcgctgggagtcgttgcgggatttactcacgcatccctgggcctcgatgccgcatatcgtcgtcgtccaggctgcgtttgtcgcggctacggtggtcggagcgctggtgccggatttggatcagcaggatgccaagctgacctacaccatcgaaatcgtgtttggcctgccggttttggccctggccatcattgtaatggtgctcatgcactgggcgacgtcgctcaccgcatggggcatagcactcttgctcatgttcatcttcggcgcagcgcacaacgtcacgcgcatgctcggcttgggcgcccttgcgaccattttgctcgacttggcgtaccaccatcgcatgccgatggaagccgcggtattgctcgccgcttggatggtggcgacgatgccggccaaacaccggacattcacccacagcctgctgggcctcgctgtgtttggagcgggctgttacctgagtgagccggcgctgagtcacttgcacctgggcgttgccgcgtacggcctcatcttggggtatgtgctccacatggcggcggacttcatcgcgggcggtgtaccgctcctttggccgtggggaaagcgccaaggcgtgcacctggtgaagtcgttcagcgctgtcgactacctcattggtggcatcgggattttcacgtttgttggactcgcactcgtgtag

SEQ ID NO: 983 - DNA, 759 bp, Artificial
  Alicyclobacillus acidocaldarius mutated SEQ ID NO 971
atgatgggtcgttcccatatggccattggcgcagtcggggcggttgcggcgacaccactggttttacatgagcgctgggagtcgttgcgggatttactcacgcatccctgggcctcgatgccgcatatcgtcgtcgtccaggctgcgtttgtcgcggctacggtggtcggagcgctggtgccggatttggatcagcaggatgccaagctgacctacaccatcgaaatcgtgtttggcctgccggttttggccctggccatcgtggtaatggtgctcatgcactgggcgacgtcgctcaccgcatggggcatagcactcttgctcatgttcatcttcggcgcagcgcacaacgtcacgcgcatgctcggcttgggcgcccttgcgaccattttgctcgacttggcgtaccaccatcgcatgccgatggaagccgcggtattgctcgccgcttggatggtggcgacgatgccggccaaacaccggacattcacccacagcctgctgggcctcgctgtgtttggagcgggctgttacctgagtgagccggcgctgagtcacattcacctgggcgttgccgcgtacggcctcatcttggggtatgtgctccacatggcggcggacttcatcgcgggcggtgtaccgctcctttggccgtggggaaagcgccaaggcgtgcacctggtgaagtcgttcagcgctgtcgactacctcattggtggcatcgggattttcacgtttgttggactcgcactcgtgtag

SEQ ID NO: 984 - DNA, 759 bp, Artificial
  Alicyclobacillus acidocaldarius mutated SEQ ID NO 971
atgatgggtcgttcccatatggccattggcgcagtcggggcggttgcggcgacaccactggttttacatgagcgctgggagtcgttgcgggatttactcacgcatccctgggcctcgatgccgcatatcgtcgtcgtccaggctgcgtttgtcgcggctacggtggtcggagcgctggtgccggatttggatcagcaggatgccaagctgacctacaccatcgaaatcgtgtttggcctgccggttttggccctggccatcgtggtaatggtgctcatgcactgggcgacgtcgctcaccgcatggggcatagcactcttgctcatgttcatcttcggcgcagcgcacaacgtcacgcgcatgctcggcttgggcgcccttgcgaccattttgctcgacttggcgtaccaccatcgcatgccgatggaagccgcggtattgctcgccgcttggatggtggcgacgatgccggccaaacaccggacattcacccacagcattctgggcctcgctgtgtttggagcgggctgttacctgagtgagccggcgctgagtcacttgcacctgggcgttgccgcgtacggcctcatcttggggtatgtgctccacatggcggcggacttcatcgcgggcggtgtaccgctcctttggccgtggggaaagcgccaaggcgtgcacctggtgaagtcgttcagcgctgtcgactacctcattggtggcatcgggattttcacgtttgttggactcgcactcgtgtag

SEQ ID NO: 985 - DNA, 759 bp, Artificial
  Alicyclobacillus acidocaldarius mutated SEQ ID NO 971
atgatgggtcgttcccatatggccattggcgcagtcggggcggttgcggcgacaccactggttttacatgagcgctgggagtcgttgcgggatttactcacgcatccctgggcctcgatgccgcatatcgtcgtcgtccaggctgcgtttgtcgcggctacggtggtcggagcgctggtgccggatttggatcagcaggaagccaagctgacctacaccatcgaaatcgtgtttggcctgccggttttggccctggccatcgtggtaatggtgctcatgcactgggcgacgtcgctcaccgcatggggcatagcactcttgctcatgttcatcttcggcgcagcgcacaacgtcacgcgcatgctcggcttgggcgcccttgcgaccattttgctcgacttggcgtaccaccatcgcatgccgatggaagccgcggtattgctcgccgcttggatggtggcgacgatgccggccaaacaccggacattcacccacagcctgctgggcctcgctgtgtttggagcgggctgttacctgagtgagccggcgctgagtcacttgcacctgggcgttgccgcgtacggcctcatcttggggtatgtgctccacatggcggcggacttcatcgcgggcggtgtaccgctcctttggccgtggggaaagcgccaaggcgtgcacctggtgaagtcgttcagcgctgtcgactacctcattggtggcatcgggattttcacgtttgttggactcgcactcgtgtag

SEQ ID NO: 986 - DNA, 759 bp, Artificial
  Alicyclobacillus acidocaldarius mutated SEQ ID NO 971
atgatgggtcgttcccatatggccattggcgcagtcggggcggttgcggcgacaccactggttttacatgagcgctgggagtcgttgaaagatttactcacgcatccctgggcctcgatgccgcatatcgtcgtcgtccaggctgcgtttgtcgcggctacggtggtcggagcgctggtgccggatttggatcagcaggatgccaagctgacctacaccatcgaaatcgtgtttggcctgccggttttggccctggccatcgtggtaatggtgctcatgcactgggcgacgtcgctcaccgcatggggcatagcactcttgctcatgttcatcttcggcgcagcgcacaacgtcacgcgcatgctcggcttgggcgcccttgcgaccattttgctcgacttggcgtaccaccatcgcatgccgatggaagccgcggtattgctcgccgcttggatggtggcgacgatgccggccaaacaccggacattcacccacagcctgctgggcctcgctgtgtttggagcgggctgttacctgagtgagccggcgctgagtcacttgcacctgggcgttgccgcgtacggcctcatcttggggtatgtgctccacatggcggcggacttcatcgcgggcggtgtaccgctcctttggccgtggggaaagcgccaaggcgtgcacctggtgaagtcgttcagcgctgtcgactacctcattggtggcatcgggattttcacgtttgttggactcgcactcgtgtag

SEQ ID NO: 987 - protein, 304 aa, Alicyclobacillus acidocaldarius
MVCDMAIRYDGWSIAAQYRRCGKSACRVCREGPGHGPYWYGSKTVDGRRLTKYFGKVPPVEQEIAQDEPSVLKELSRLREENENLRAQVAQLQAELAALRTPPALSDPPHPLEETKEASQDELTIHEQPRRRASVRSSDELTKADVEAIWCEETEGLDEEPDILAEVHDALVRNLFPVPTQDTTRLKTGTNPRKPYVCPFRATKRGGRLTFGSADKLVRTAIPWLIQSVKHQREWRELSRRRQQDRIAELLSTYRRMDTLELVHLVERMERAILMGDRTGWTVRLEELDEHVEVIRQVLQERNT

SEQ ID NO: 988 - DNA, 915 bp, Alicyclobacillus acidocaldarius
gtggtgtgtgacatggcgatccgatacgacgggtggagcattgcagcacaatatcgcaggtgcgggaaatcggcttgtcgtgtgtgccgagaaggccctggccacggcccgtactggtatggctcgaagaccgtggatggacggcgcttgactaagtactttggcaaagttccgccggtagaacaagaaatcgcacaagatgaaccgtccgtgttgaaagaactctcccggttacgcgaagaaaacgagaacttacgcgcacaggtcgcgcagttgcaggcggaacttgctgctctacggacgccgcctgctctttcggaccctccacatcccttggaggagacgaaggaagcctcacaggacgagttaacgatacatgagcaaccaaggcgaagggcgtctgtgcggtcgagtgacgagttgacgaaggccgacgtcgaggcaatttggtgcgaggaaactgaaggccttgacgaagagccagacatcctggcggaagttcacgatgcactcgtgcgcaatctgtttcctgtacccacacaagataccacaagactcaagacgggcacgaacccacgcaaaccgtacgtgtgtccctttcgtgcgacaaagcgcggtggacgccttacatttggctcagccgataagctcgtgcggacggcgattccgtggctcatccagtccgtgaaacatcagcgggagtggcgtgagctaagccgccggagacaacaagatcgaatagccgagctgctttctacctatcggcggatggataccctggaactcgtacatctggtggagcgaatggaacgagccatattgatgggtgaccgcacgggttggacagtgcgcttggaggagttggatgaacatgtggaagtcatccgccaggtactccaagaacgcaacacctag

SEQ ID NO: 989 - protein, 84 aa, Mycobacterium tuberculosis
SISENYRRCGKPNCVCAQEGHPGHGPRYLWTRTVAGRGTKGRQLSVEEVDKVRAELANYHRFAQVSEQIVAVNEAICEARPPNP

SEQ ID NO: 990 - protein, 78 aa, Burkholderia phymatum
SLIERYKRCGKPGCKCADGPGHGPKYYLSVSFPGRRPQMDYVPQADYTDVAEHLANYHRVREIIEEICEINRELLRRR

SEQ ID NO: 991 - protein, 84 aa, Mycobacterium bovis; identical to SEQ ID NO: 989

SEQ ID NO: 992 - protein, 84 aa, Mycobacterium tuberculosis; identical to SEQ ID NO: 989

SEQ ID NO: 993 - protein, 84 aa, Mycobacterium tuberculosis; identical to SEQ ID NO: 989

SEQ ID NO: 994 - protein, 304 aa, Artificial
  Alicyclobacillus acidocaldarius mutated SEQ ID NO 987
MVCDMAIRYDGWSIAAQYRRCGKSACRVCREGPGHGPYWYGSKTVDGRRLTKYFGKVPPVEQEIAQDEPSVLKELSRLREENENLRAQVAQLQAELAALRTPPALSDPPHPLEETKEASQDELTIHEQPRRRASVRSSDELTKADVEAIWCEETEGLDEEPDILAEVHDALVRNLFPVPTQDTTRIKTGTNPRKPYVCPFRATKRGGRLTFGSADKLVRTAIPWLIQSVKHQREWRELSRRRQQDRIAELLSTYRRMDTLELVHLVERMERAILMGDRTGWTVRLEELDEHVEVIRQVLQERNT

SEQ ID NO: 995 - protein, 304 aa, Artificial
  Alicyclobacillus acidocaldarius mutated SEQ ID NO 987
MVCDMAIRYDGWSIAAQYRRCGKSACRVCREGPGHGPYWYGSKTVDGRRLTKYFGKVPPVEQEIAQDEPSVLKELSRLREENENLRAQVAQLQAELAALRTPPALSDPPHPLEETKEASQDELTIHEQPRRRASVRSSDELTKADVEAIWCEETEGLDEEPDILAEVHDALVRNLFPVPTQDTTRLKTGTNPRKPYVCPFKATKRGGRLTFGSADKLVRTAIPWLIQSVKHQREWRELSRRRQQDRIAELLSTYRRMDTLELVHLVERMERAILMGDRTGWTVRLEELDEHVEVIRQVLQERNT

SEQ ID NO: 996 - protein, 304 aa, Artificial
  Alicyclobacillus acidocaldarius mutated SEQ ID NO 987
MVCDMAIRYDGWSIAAQYRRCGKSACRVCREGPGHGPYWYGSKTVDGRRLTKYFGKVPPVEQEIAQDEPSVLKELSRLREENENLRAQVAQLQAELAALRTPPALSDPPHPLEETKEASQDELTIHEQPRRRASVRSSDELTKADVEAIWCEETEGLDEEPDILAEVHDAIVRNLFPVPTQDTTRLKTGTNPRKPYVCPFRATKRGGRLTFGSADKLVRTAIPWLIQSVKHQREWRELSRRRQQDRIAELLSTYRRMDTLELVHLVERMERAILMGDRTGWTVRLEELDEHVEVIRQVLQERNT

SEQ ID NO: 997 - protein, 304 aa, Artificial
  Alicyclobacillus acidocaldarius mutated SEQ ID NO 987
MVCDMAIRYDGWSIAAQYRRCGKSACRVCREGPGHGPYWYGSKTVDGRRLTKYFGKVPPVEQELAQDEPSVLKELSRLREENENLRAQVAQLQAELAALRTPPALSDPPHPLEETKEASQDELTIHEQPRRRASVRSSDELTKADVEAIWCEETEGLDEEPDILAEVHDALVRNLFPVPTQDTTRLKTGTNPRKPYVCPFRATKRGGRLTFGSADKLVRTAIPWLIQSVKHQREWRELSRRRQQDRIAELLSTYRRMDTLELVHLVERMERAILMGDRTGWTVRLEELDEHVEVIRQVLQERNT

SEQ ID NO: 998 - protein, 304 aa, Artificial
  Alicyclobacillus acidocaldarius mutated SEQ ID NO 987
MVCDMAIRYDGWSIAAQYRRCGKSACRVCREGPGHGPYWYGSKTVDGRRLTKYFGKVPPVEQEIAQDEPSVLKELSRLREENENLRAQVAQLQAELAALRTPPALSDPPHPLEETKEASQDELTIHEQPRRRASVRSSDELTKADVEAIWCEETEGLDEEPDILAEVHDALVRNLFPVPTQDTTRLKTGTNPRKPYVCPFRATRRGGRLTFGSADKLVRTAIPWLIQSVKHQREWRELSRRRQQDRIAELLSTYRRMDTLELVHLVERMERAILMGDRTGWTVRLEELDEHVEVIRQVLQERNT

SEQ ID NO: 999 - DNA, 915 bp, Artificial
  Alicyclobacillus acidocaldarius mutated SEQ ID NO 988
gtggtgtgtgacatggcgatccgatacgacgggtggagcattgcagcacaatatcgcaggtgcgggaaatcggcttgtcgtgtgtgccgagaaggccctggccacggcccgtactggtatggctcgaagaccgtggatggacggcgcttgactaagtactttggcaaagttccgccggtagaacaagaaatcgcacaagatgaaccgtccgtgttgaaagaactctcccggttacgcgaagaaaacgagaacttacgcgcacaggtcgcgcagttgcaggcggaacttgctgctctacggacgccgcctgctctttcggaccctccacatcccttggaggagacgaaggaagcctcacaggacgagttaacgatacatgagcaaccaaggcgaagggcgtctgtgcggtcgagtgacgagttgacgaaggccgacgtcgaggcaatttggtgcgaggaaactgaaggccttgacgaagagccagacatcctggcggaagttcacgatgcactcgtgcgcaatctgtttcctgtacccacacaagataccacaagaattaagacgggcacgaacccacgcaaaccgtacgtgtgtccctttcgtgcgacaaagcgcggtggacgccttacatttggctcagccgataagctcgtgcggacggcgattccgtggctcatccagtccgtgaaacatcagcgggagtggcgtgagctaagccgccggagacaacaagatcgaatagccgagctgctttctacctatcggcggatggataccctggaactcgtacatctggtggagcgaatggaacgagccatattgatgggtgaccgcacgggttggacagtgcgcttggaggagttggatgaacatgtggaagtcatccgccaggtactccaagaacgcaacacctag

SEQ ID NO: 1000 - DNA, 915 bp, Artificial
  Alicyclobacillus acidocaldarius mutated SEQ ID NO 988
gtggtgtgtgacatggcgatccgatacgacgggtggagcattgcagcacaatatcgcaggtgcgggaaatcggcttgtcgtgtgtgccgagaaggccctggccacggcccgtactggtatggctcgaagaccgtggatggacggcgcttgactaagtactttggcaaagttccgccggtagaacaagaaatcgcacaagatgaaccgtccgtgttgaaagaactctcccggttacgcgaagaaaacgagaacttacgcgcacaggtcgcgcagttgcaggcggaacttgctgctctacggacgccgcctgctctttcggaccctccacatcccttggaggagacgaaggaagcctcacaggacgagttaacgatacatgagcaaccaaggcgaagggcgtctgtgcggtcgagtgacgagttgacgaaggccgacgtcgaggcaatttggtgcgaggaaactgaaggccttgacgaagagccagacatcctggcggaagttcacgatgcactcgtgcgcaatctgtttcctgtacccacacaagataccacaagactcaagacgggcacgaacccacgcaaaccgtacgtgtgtccctttaaagcgacaaagcgcggtggacgccttacatttggctcagccgataagctcgtgcggacggcgattccgtggctcatccagtccgtgaaacatcagcgggagtggcgtgagctaagccgccggagacaacaagatcgaatagccgagctgctttctacctatcggcggatggataccctggaactcgtacatctggtggagcgaatggaacgagccatattgatgggtgaccgcacgggttggacagtgcgcttggaggagttggatgaacatgtggaagtcatccgccaggtactccaagaacgcaacacctag

SEQ ID NO: 1001 - DNA, 915 bp, Artificial
  Alicyclobacillus acidocaldarius mutated SEQ ID NO 988
gtggtgtgtgacatggcgatccgatacgacgggtggagcattgcagcacaatatcgcaggtgcgggaaatcggcttgtcgtgtgtgccgagaaggccctggccacggcccgtactggtatggctcgaagaccgtggatggacggcgcttgactaagtactttggcaaagttccgccggtagaacaagaaatcgcacaagatgaaccgtccgtgttgaaagaactctcccggttacgcgaagaaaacgagaacttacgcgcacaggtcgcgcagttgcaggcggaacttgctgctctacggacgccgcctgctctttcggaccctccacatcccttggaggagacgaaggaagcctcacaggacgagttaacgatacatgagcaaccaaggcgaagggcgtctgtgcggtcgagtgacgagttgacgaaggccgacgtcgaggcaatttggtgcgaggaaactgaaggccttgacgaagagccagacatcctggcggaagttcacgatgcaattgtgcgcaatctgtttcctgtacccacacaagataccacaagactcaagacgggcacgaacccacgcaaaccgtacgtgtgtccctttcgtgcgacaaagcgcggtggacgccttacatttggctcagccgataagctcgtgcggacggcgattccgtggctcatccagtccgtgaaacatcagcgggagtggcgtgagctaagccgccggagacaacaagatcgaatagccgagctgctttctacctatcggcggatggataccctggaactcgtacatctggtggagcgaatggaacgagccatattgatgggtgaccgcacgggttggacagtgcgcttggaggagttggatgaacatgtggaagtcatccgccaggtactccaagaacgcaacacctag

SEQ ID NO: 1002 - DNA, 915 bp, Artificial
  Alicyclobacillus acidocaldarius mutated SEQ ID NO 988
gtggtgtgtgacatggcgatccgatacgacgggtggagcattgcagcacaatatcgcaggtgcgggaaatcggcttgtcgtgtgtgccgagaaggccctggccacggcccgtactggtatggctcgaagaccgtggatggacggcgcttgactaagtactttggcaaagttccgccggtagaacaagaattagcacaagatgaaccgtccgtgttgaaagaactctcccggttacgcgaagaaaacgagaacttacgcgcacaggtcgcgcagttgcaggcggaacttgctgctctacggacgccgcctgctctttcggaccctccacatcccttggaggagacgaaggaagcctcacaggacgagttaacgatacatgagcaaccaaggcgaagggcgtctgtgcggtcgagtgacgagttgacgaaggccgacgtcgaggcaatttggtgcgaggaaactgaaggccttgacgaagagccagacatcctggcggaagttcacgatgcactcgtgcgcaatctgtttcctgtacccacacaagataccacaagactcaagacgggcacgaacccacgcaaaccgtacgtgtgtccctttcgtgcgacaaagcgcggtggacgccttacatttggctcagccgataagctcgtgcggacggcgattccgtggctcatccagtccgtgaaacatcagcgggagtggcgtgagctaagccgccggagacaacaagatcgaatagccgagctgctttctacctatcggcggatggataccctggaactcgtacatctggtggagcgaatggaacgagccatattgatgggtgaccgcacgggttggacagtgcgcttggaggagttggatgaacatgtggaagtcatccgccaggtactccaagaacgcaacacctag

SEQ ID NO: 1003 - DNA, 915 bp, Artificial
  Alicyclobacillus acidocaldarius mutated SEQ ID NO 988
gtggtgtgtgacatggcgatccgatacgacgggtggagcattgcagcacaatatcgcaggtgcgggaaatcggcttgtcgtgtgtgccgagaaggccctggccacggcccgtactggtatggctcgaagaccgtggatggacggcgcttgactaagtactttggcaaagttccgccggtagaacaagaaatcgcacaagatgaaccgtccgtgttgaaagaactctcccggttacgcgaagaaaacgagaacttacgcgcacaggtcgcgcagttgcaggcggaacttgctgctctacggacgccgcctgctctttcggaccctccacatcccttggaggagacgaaggaagcctcacaggacgagttaacgatacatgagcaaccaaggcgaagggcgtctgtgcggtcgagtgacgagttgacgaaggccgacgtcgaggcaatttggtgcgaggaaactgaaggccttgacgaagagccagacatcctggcggaagttcacgatgcactcgtgcgcaatctgtttcctgtacccacacaagataccacaagactcaagacgggcacgaacccacgcaaaccgtacgtgtgtccctttcgtgcgacacgtcgcggtggacgccttacatttggctcagccgataagctcgtgcggacggcgattccgtggctcatccagtccgtgaaacatcagcgggagtggcgtgagctaagccgccggagacaacaagatcgaatagccgagctgctttctacctatcggcggatggataccctggaactcgtacatctggtggagcgaatggaacgagccatattgatgggtgaccgcacgggttggacagtgcgcttggaggagttggatgaacatgtggaagtcatccgccaggtactccaagaacgcaacacctag

SEQ ID NO: 1004 - protein, 650 aa, Alicyclobacillus acidocaldarius
MRPVQRAIPGPVKRWKFRLVVSRHSSQVPNSNRPCRCDHSTGTPPVPTARTNIVRPAEGRALNDVEGISVAIQLRPYQQAAVDAFFQALAEGRKRQLIVLPTGAGKTIVFGSVARRFHEEVSRERPILVIAHRTELLDQAEQKIHFVWPEAFIGRIQGARNEQLGDVLLASTQTLVAGRRIPQPGLIIYDECHHSRAEGALGVLERLGVFESDGPPLLGVTATPSRSDRTELGDIFEHLTYERTILDMIMDGYLSDVRGVKVEVPGLNLGAIRTTAGDYNSKDLSYVMNIESALDAVVDAVVTHAPGRKCLVFAVDVKHAHALAERFQKRGIACAAVDGAMKAEERAAILQAFAENRLCVLVNCQILTEGYDQPDVDCVVIARPTRSQALYVQMVGRALRLHPDKTDALVLDLTGASDDKSLQTFARLMRTQRKTATHALVGAEEGEDAVPMEDGESVGEWLTRVAQKRELAEQVAQAINLFANRSRYRWVRVKDNFAIAYGHDGWAYLYRDGDEFWPVLELKNEKFMPLHDRSLPLEYAQGVVEGFLSLFESSLITKEADWRNAPMTERQKYVLQKYRIRYDDTWTRGMAADALGQRFAAKRVRVLQKNFDAQKWRDVLAQPHGQAWLEHRLMALRARAQSRARVAQTS

SEQ ID NO: 1005 - DNA, 1953 bp, Alicyclobacillus acidocaldarius
gtgcggcccgtacagcgcgcaatccccggaccggtgaagcggtggaagttccggctcgtcgtgtcccggcattcaagccaggtgccgaactcaaacaggccgtgcaggtgtgatcacagcacagggacgccccctgtgccgactgcacgaacgaacatcgtgcggccggcagagggacgtgcgctaaacgatgtggagggcatatccgtggctatccaacttcgtccgtaccaacaggctgccgtcgacgcgttctttcaggctctggccgaaggtcgcaagcgccaactcatcgtccttccgacgggcgcaggcaagaccattgtgttcgggagtgtcgcgcggcgcttccacgaagaagtttcgcgcgagcggccgattctggtcatcgcgcatcgtacggaactgctcgaccaggcggaacagaaaatccacttcgtctggccggaggccttcatcggacgcatccaaggcgctcgcaacgagcagctgggcgacgtactgctcgcttccacgcaaacacttgtcgcaggtcgacggataccccaaccggggctcatcatctatgatgaatgccaccacagccgcgcagagggcgcgcttggcgtactggagcgcttgggtgtgtttgagtcggatggcccgccgttgcttggcgtaaccgcgacaccttcacgttcagatcggacggagttgggcgacatcttcgaacacctgacgtacgagcgcacgattctcgacatgatcatggacggatacctgtcggatgtgcgcggagtgaaggttgaggttccgggtctgaaccttggcgccattcggaccacggcgggtgactacaactcgaaagacctgtcgtacgtgatgaatatcgaatcggcactcgatgcggtcgtggacgccgtggtcacgcacgcgcctgggcgcaaatgcctcgtcttcgcggtcgatgtcaagcacgcgcacgccctcgcggagcgatttcagaagcgtggcatcgcctgcgccgccgtagacggagctatgaaggcagaagaacgcgctgccatcctccaagcgttcgcggagaaccgcctgtgtgtcctcgtcaactgccagattctcaccgaaggctatgaccagccggacgtggactgcgtggtcattgcgcggccaacacgttcccaagcgctgtacgtgcagatggtcgggcgagccctgcgtctccatcctgacaaaacagatgcgctggtgctcgatcttacaggtgcgagcgacgataaatcgctccagacgtttgcgcgtctcatgcgcacccagagaaaaacggcgacacacgcgctggtcggagcggaagaaggcgaagatgccgtgcctatggaggacggggaaagcgtaggcgagtggctgacgcgcgtggcgcaaaagcgggaactcgcggagcaagtggcacaagccatcaatctgttcgcgaacagaagccggtatcgctgggtgcgggtcaaagacaacttcgcgatcgcgtatggccacgatggctgggcgtacttgtaccgcgacggggacgagttttggccggtgctcgaactgaagaacgagaagttcatgccactccatgaccgctccttgccgcttgaatatgcccaaggcgtggtcgaaggctttctctcgctcttcgaatcgtcgcttatcacgaaggaggccgactggcgaaatgctcccatgaccgagaggcagaagtacgtgctccagaagtatcgaatccgctacgatgatacgtggacgcgcggcatggcggcggatgcgctcggacaacgatttgcggcgaagcgggtgcgcgtgctgcagaagaacttcgacgcgcaaaaatggcgggatgtcttagcacagccgcatgggcaagcgtggctggaacatcggctcatggccttacgcgcgcgtgcacagtctcgagcacgcgtagcgcaaaccagctaa

SEQ ID NO: 1006 - protein, 560 aa, Actinoplanes phage
LRPYQEKALEGIEKAEREGVRRPLVVLPTGTGKTVVFSHGIKNRADRGRSLVLVHRDELVRQTIEKIGMVAPELTTGVVKADENGLDADVVVASVQTAQVDRRLAQLVEAAKRSPFGTVWVDEAHHAPAPSWTKVLTGLGSFNPYGPLTVGFTATPERDKKTLGVWERLAAFMSIREAIYGNGKRGKDGHEGGYLVPILPAVVVETEMDLTRVRKTGGDFSEGDLGREMEESGAIAQIADAYLINAHDRKGVAFTPTVATAHALAAALCARGIRTEALDGTTHKDERRAILRRLKTGETQVVTNCGVLTEGFDEPSISCVVVARPTKFHGLYVQMIGRGTRLYPGKKDLMILDLVAASRRHEFVGYVDLGLDLDEGKKPKEGEPERQACPTCEEPCEVTEHRCALCHRYLPVAVTAEGGSRHENCQANGSGRVNVFGESRLRWLPVGPAWVLGAGKEIVVMVPEGVDTWKLAAYENGRVEVLHEEIPSDWAMGIGEDRAKAFQKLVERQARWLNEPVSISQKGRLVREGLPEKHLPRVKTKGEAADLLTRISGKRAVRKL

SEQ ID NO: 1007 - protein, 353 aa, Corynebacterium phage BFK20
ELRAYQTEAVNAVLGEWVDGKRTCVVLPTGTGKSTVIAKLAEIAYKAGQRVILLAHRRELLDQMAQSIRMVAPQIPTDDIGFVQAERDQPERPIVCASFQTLMSASRLQAVGERTVVLVDEVHHSAASTYAEILSAPNFDGAFKAGFTATLQRADGGLADYWDSIAFERDLRWALDEGFLVPPQGKTVVIPGLDTTNIKLRNGDYAAGDLSEVMMSSVDSTVEAIHTHAPDRRMLIFGAGVEHCQALSDTLSATGIHTALVVGSTSSEERTELFEEFTAGRVQALVTVQVLTEGTDLPACDCVVLARPTRSAVLFTQMVGRALRLHQDKNDALVLDLAGSTRDVAMVTLSSLV

SEQ ID NO: 1008 - protein, 361 aa, Mycobacterium phage Orion
ELRPYQREAVEAIESHWSQGVTRVGVVLPTGTGKSTVIGRTAVNGYQNREPVLMVAHRGELIDQMAGTIFEVDPSIPRSHVGIVRAEMDDHSAPIVVATLQTLATAHRREAVGFRRRILWDEVHHAGAEGFHTTFTELGGYTDALFAGFTATMRRDDKGKSPVGLGDVIEKVVYEKDILWAIDSGYLVRPRGLTVRIKNLNALDDVRTVAGDFQQSDLAEVMEAATEYVVDAIKLHAADRRPIIFAASVDAAHHIADALTAADFPAVAVTGSMSYAERQPVYEAYRNGTAKALVTVQVLTEGADFPMCDCVVLARPTRSRNLYSQMIGRALRLYDGKQDALVLDLAGSSRSMKLVNLTQLV

SEQ ID NO: 1009 - protein, 610 aa, Aspergillus fumigatus
SPKLVLRDYQEECIQSVLKYLDEGHKRLGISLATGAGKTVIFTELIGRIPSRNEIGDKSLIIVHRKELVEQAAQHCRRAYPDRTVEIEMGHSHASGAGDIVVASVQTLTRGNRLAKFDPKRFKLLLVDEAHHIVASSYREVLKHFGADETSADSPVLVGVSATFSRSDGLKLGAAIDHIVYHKDYIDMINDNWLANAVFTTVRSEANLSKVKKDSFGDFAIGPLSKAVNTENVNNITVRAWLANAQDRKSTLVFCVDVAHTKALTETFRNYGIDARYITAKTPKDVRMEQLRAFRNGEYPVLLNCGLFTEGTDIPNIDCVLLARPTRSRNLLIQMIGRGLRLYPGKEDCHIIDMVATLNTGVLSTPTLFGLHPDEILQNAKAKDLRDMPLEKTTTGTGTALAGEETEEPPPTPDDLDVNLTFTKYDTIYDLIADLKSEKHIRSLSPHVWVRVGDHRYVLSDASGWLTIDKEEDTSRAYRPRLNPDPTSIANTPDEPYIFTVRHVAKFKNSDDSIMHTRPRLIATAPDFETALRAADTFATKEFEERYVSVRQTWRQLPATEAQVRFLNKAKVRHGSIQRKHLTRGQAADLITKLKFGGKQRFEARRAERL

SEQ ID NO: 1010 - protein, 360 aa, Mycobacterium phage PG1
MRPYQREAVEAIESHWSQGVTRVGVVLPTGTGKSTVIGRTAVNGYQNREPVLMVAHRGELIDQMAGTIFEVDPSIPRSHVGIVRAEMDDHSAPIVVATLQTLATAHRREAVGFRRRILWDEVHHAGAEGFHTTFTELGGYTDALFAGFTATMRRDDKGKSPVGLGDVIEKVVYEKDILWAIDSGYLVRPRGLTVRINNLNALDDVRTVAGDFQQSDLAEVMEAATEYVVDAIKLHAADRRPIIFAASVDAAHHIADALTAADFPAVAVTGSMSYAERQPVYEAYRNGTAKALVTVQVLTEGADFPMCDCVVLARPTRSRNLYSQMIGRALRLYDGKQDALVLDLAGSSRSMKLVNLTQLV

SEQ ID NO: 1011 - protein, 650 aa, Artificial
  Alicyclobacillus acidocaldarius mutated SEQ ID NO 1004
MRPVQRAIPGPVKRWKFRLVVSRHSSQVPNSNRPCRCDHSTGTPPVPTARTNIVRPAEGRALNDVEGISIAIQLRPYQQAAVDAFFQALAEGRKRQLIVLPTGAGKTIVFGSVARRFHEEVSRERPILVIAHRTELLDQAEQKIHFVWPEAFIGRIQGARNEQLGDVLLASTQTLVAGRRIPQPGLIIYDECHHSRAEGALGVLERLGVFESDGPPLLGVTATPSRSDRTELGDIFEHLTYERTILDMIMDGYLSDVRGVKVEVPGLNLGAIRTTAGDYNSKDLSYVMNIESALDAVVDAVVTHAPGRKCLVFAVDVKHAHALAERFQKRGIACAAVDGAMKAEERAAILQAFAENRLCVLVNCQILTEGYDQPDVDCVVIARPTRSQALYVQMVGRALRLHPDKTDALVLDLTGASDDKSLQTFARLMRTQRKTATHALVGAEEGEDAVPMEDGESVGEWLTRVAQKRELAEQVAQAINLFANRSRYRWVRVKDNFAIAYGHDGWAYLYRDGDEFWPVLELKNEKFMPLHDRSLPLEYAQGVVEGFLSLFESSLITKEADWRNAPMTERQKYVLQKYRIRYDDTWTRGMAADALGQRFAAKRVRVLQKNFDAQKWRDVLAQPHGQAWLEHRLMALRARAQSRARVAQTS

SEQ ID NO: 1012 - protein, 650 aa, Artificial
  Alicyclobacillus acidocaldarius mutated SEQ ID NO 1004
MRPVQRAIPGPVKRWKFRLVVSRHSSQVPNSNRPCRCDHSTGTPPVPTARTNIVRPAEGRALNDVEGISVAIQLRPYQQAAVDAFFQALAEGRKRQLIVLPTGAGKTIVFGSVARRFHEEVSRERPILVIAHRTELLDQAEQKIHFVWPEAFIGRIQGARNEQLGDVLLASTQTLVAGRRIPQPGLIIYDECHHSRAEGALGVLERLGVFESDGPPLLGVTATPSRSDRTELGDIFEHLTYERTILDMIMDGYLSDVRGVKVEVPGLNLGAIRTTAGDYNSKDLSYVMQIESALDAVVDAVVTHAPGRKCLVFAVDVKHAHALAERFQKRGIACAAVDGAMKAEERAAILQAFAENRLCVLVNCQILTEGYDQPDVDCVVIARPTRSQALYVQMVGRALRLHPDKTDALVLDLTGASDDKSLQTFARLMRTQRKTATHALVGAEEGEDAVPMEDGESVGEWLTRVAQKRELAEQVAQAINLFANRSRYRWVRVKDNFAIAYGHDGWAYLYRDGDEFWPVLELKNEKFMPLHDRSLPLEYAQGVVEGFLSLFESSLITKEADWRNAPMTERQKYVLQKYRIRYDDTWTRGMAADALGQRFAAKRVRVLQKNFDAQKWRDVLAQPHGQAWLEHRLMALRARAQSRARVAQTS

SEQ ID NO: 1013 - protein, 650 aa, Artificial
  Alicyclobacillus acidocaldarius mutated SEQ ID NO 1004
MRPVQRAIPGPVKRWKFRLVVSRHSSQVPNSNRPCRCDHSTGTPPVPTARTNIVRPAEGRALNDVEGISVAIQLRPYQQAAVDAFFQALAEGRKRQLIVLPTGAGKTIVFGSVARRFHEEVSRERPILVIAHRTELLDQAEQKIHFVWPEAFIGRIQGARNEQLGDVLLASTQTLVAGRRIPQPGLIIYDECHHSRAEGALGVLDRLGVFESDGPPLLGVTATPSRSDRTELGDIFEHLTYERTILDMIMDGYLSDVRGVKVEVPGLNLGAIRTTAGDYNSKDLSYVMNIESALDAVVDAVVTHAPGRKCLVFAVDVKHAHALAERFQKRGIACAAVDGAMKAEERAAILQAFAENRLCVLVNCQILTEGYDQPDVDCVVIARPTRSQALYVQMVGRALRLHPDKTDALVLDLTGASDDKSLQTFARLMRTQRKTATHALVGAEEGEDAVPMEDGESVGEWLTRVAQKRELAEQVAQAINLFANRSRYRWVRVKDNFAIAYGHDGWAYLYRDGDEFWPVLELKNEKFMPLHDRSLPLEYAQGVVEGFLSLFESSLITKEADWRNAPMTERQKYVLQKYRIRYDDTWTRGMAADALGQRFAAKRVRVLQKNFDAQKWRDVLAQPHGQAWLEHRLMALRARAQSRARVAQTS

SEQ ID NO: 1014 - protein, 650 aa, Artificial
  Alicyclobacillus acidocaldarius mutated SEQ ID NO 1004
MRPVQRAIPGPVKRWKFRLVVSRHSSQVPNSNRPCRCDHSTGTPPVPTARTNIVRPAEGRALNDVEGISVAIQLRPYQQAAVDAFFQALAEGRKRQLIVLPTGAGKTIVFGSVARRFHEEVSRERPILVIAHRTELLDQAEQKIHFVWPEAFIGRIQGARNEQLGDVLLASTQTLVAGRRIPQPGLIIYDECHHSRAEGALGVLERLGVFESDGPPLLGVTATPSRSDRTELGDIFEHLTYERTILDMIMDGYLSDVRGVKVEVPGLNLGAIRTTAGDYNSKELSYVMNIESALDAVVDAVVTHAPGRKCLVFAVDVKHAHALAERFQKRGIACAAVDGAMKAEERAAILQAFAENRLCVLVNCQILTEGYDQPDVDCVVIARPTRSQALYVQMVGRALRLHPDKTDALVLDLTGASDDKSLQTFARLMRTQRKTATHALVGAEEGEDAVPMEDGESVGEWLTRVAQKRELAEQVAQAINLFANRSRYRWVRVKDNFAIAYGHDGWAYLYRDGDEFWPVLELKNEKFMPLHDRSLPLEYAQGVVEGFLSLFESSLITKEADWRNAPMTERQKYVLQKYRIRYDDTWTRGMAADALGQRFAAKRVRVLQKNFDAQKWRDVLAQPHGQAWLEHRLMALRARAQSRARVAQTS

SEQ ID NO: 1015 - protein, 650 aa, Artificial
  Alicyclobacillus acidocaldarius mutated SEQ ID NO 1004
MRPVQRAIPGPVKRWKFRLVVSRHSSQVPNSNRPCRCDHSTGTPPVPTARTNIVRPAEGRALNDVEGISVAIQLRPYQQAAVDAFFQALAEGRKRQLIVLPTGAGKTIVFGSVARRFHEEVSRERPILVIAHRTELLDQAEQKIHFVWPEAFIGRIQGARNEQLGDVLLASTQTLVAGRRIPQPGLIIYDECHHSRAEGALGVLERLGVFESDGPPLLGVTATPSRSDRTELGDIFEHLTYERTILDMIMDGYLSDVRGVKVEVPGLNLGAIRTTAGDYNSKDLSYVMNIESALDAVVDAVVTHAPGRKCLVFAVDVKHAHALAERFQKRGIACAAVDGAMKAEERAAILQAFAENRLCVLVNCQILTEGYDQPDVDCVVIARPTRSQALYVQMVGRALRLHPDKTDALVLDLTGASDDKSLQTFARLMRTQRKTATHALVGAEEGDDAVPMEDGESVGEWLTRVAQKRELAEQVAQAINLFANRSRYRWVRVKDNFAIAYGHDGWAYLYRDGDEFWPVLELKNEKFMPLHDRSLPLEYAQGVVEGFLSLFESSLITKEADWRNAPMTERQKYVLQKYRIRYDDTWTRGMAADALGQRFAAKRVRVLQKNFDAQKWRDVLAQPHGQAWLEHRLMALRARAQSRARVAQTS

SEQ ID NO: 1016 - DNA, 1953 bp, Artificial
  Alicyclobacillus acidocaldarius mutated SEQ ID NO 1005
gtgcggcccgtacagcgcgcaatccccggaccggtgaagcggtggaagttccggctcgtcgtgtcccggcattcaagccaggtgccgaactcaaacaggccgtgcaggtgtgatcacagcacagggacgccccctgtgccgactgcacgaacgaacatcgtgcggccggcagagggacgtgcgctaaacgatgtggagggcatatccattgctatccaacttcgtccgtaccaacaggctgccgtcgacgcgttctttcaggctctggccgaaggtcgcaagcgccaactcatcgtccttccgacgggcgcaggcaagaccattgtgttcgggagtgtcgcgcggcgcttccacgaagaagtttcgcgcgagcggccgattctggtcatcgcgcatcgtacggaactgctcgaccaggcggaacagaaaatccacttcgtctggccggaggccttcatcggacgcatccaaggcgctcgcaacgagcagctgggcgacgtactgctcgcttccacgcaaacacttgtcgcaggtcgacggataccccaaccggggctcatcatctatgatgaatgccaccacagccgcgcagagggcgcgcttggcgtactggagcgcttgggtgtgtttgagtcggatggcccgccgttgcttggcgtaaccgcgacaccttcacgttcagatcggacggagttgggcgacatcttcgaacacctgacgtacgagcgcacgattctcgacatgatcatggacggatacctgtcggatgtgcgcggagtgaaggttgaggttccgggtctgaaccttggcgccattcggaccacggcgggtgactacaactcgaaagacctgtcgtacgtgatgaatatcgaatcggcactcgatgcggtcgtggacgccgtggtcacgcacgcgcctgggcgcaaatgcctcgtcttcgcggtcgatgtcaagcacgcgcacgccctcgcggagcgatttcagaagcgtggcatcgcctgcgccgccgtagacggagctatgaaggcagaagaacgcgctgccatcctccaagcgttcgcggagaaccgcctgtgtgtcctcgtcaactgccagattctcaccgaaggctatgaccagccggacgtggactgcgtggtcattgcgcggccaacacgttcccaagcgctgtacgtgcagatggtcgggcgagccctgcgtctccatcctgacaaaacagatgcgctggtgctcgatcttacaggtgcgagcgacgataaatcgctccagacgtttgcgcgtctcatgcgcacccagagaaaaacggcgacacacgcgctggtcggagcggaagaaggcgaagatgccgtgcctatggaggacggggaaagcgtaggcgagtggctgacgcgcgtggcgcaaaagcgggaactcgcggagcaagtggcacaagccatcaatctgttcgcgaacagaagccggtatcgctgggtgcgggtcaaagacaacttcgcgatcgcgtatggccacgatggctgggcgtacttgtaccgcgacggggacgagttttggccggtgctcgaactgaagaacgagaagttcatgccactccatgaccgctccttgccgcttgaatatgcccaaggcgtggtcgaaggctttctctcgctcttcgaatcgtcgcttatcacgaaggaggccgactggcgaaatgctcccatgaccgagaggcagaagtacgtgctccagaagtatcgaatccgctacgatgatacgtggacgcgcggcatggcggcggatgcgctcggacaacgatttgcggcgaagcgggtgcgcgtgctgcagaagaacttcgacgcgcaaaaatggcgggatgtcttagcacagccgcatgggcaagcgtggctggaacatcggctcatggccttacgcgcgcgtgcacagtctcgagcacgcgtagcgcaaaccagctaa

SEQ ID NO: 1017 - DNA, 1953 bp, Artificial
  Alicyclobacillus acidocaldarius mutated SEQ ID NO 1005
gtgcggcccgtacagcgcgcaatccccggaccggtgaagcggtggaagttccggctcgtcgtgtcccggcattcaagccaggtgccgaactcaaacaggccgtgcaggtgtgatcacagcacagggacgccccctgtgccgactgcacgaacgaacatcgtgcggccggcagagggacgtgcgctaaacgatgtggagggcatatccgtggctatccaacttcgtccgtaccaacaggctgccgtcgacgcgttctttcaggctctggccgaaggtcgcaagcgccaactcatcgtccttccgacgggcgcaggcaagaccattgtgttcgggagtgtcgcgcggcgcttccacgaagaagtttcgcgcgagcggccgattctggtcatcgcgcatcgtacggaactgctcgaccaggcggaacagaaaatccacttcgtctggccggaggccttcatcggacgcatccaaggcgctcgcaacgagcagctgggcgacgtactgctcgcttccacgcaaacacttgtcgcaggtcgacggataccccaaccggggctcatcatctatgatgaatgccaccacagccgcgcagagggcgcgcttggcgtactggagcgcttgggtgtgtttgagtcggatggcccgccgttgcttggcgtaaccgcgacaccttcacgttcagatcggacggagttgggcgacatcttcgaacacctgacgtacgagcgcacgattctcgacatgatcatggacggatacctgtcggatgtgcgcggagtgaaggttgaggttccgggtctgaaccttggcgccattcggaccacggcgggtgactacaactcgaaagacctgtcgtacgtgatgcaaatcgaatcggcactcgatgcggtcgtggacgccgtggtcacgcacgcgcctgggcgcaaatgcctcgtcttcgcggtcgatgtcaagcacgcgcacgccctcgcggagcgatttcagaagcgtggcatcgcctgcgccgccgtagacggagctatgaaggcagaagaacgcgctgccatcctccaagcgttcgcggagaaccgcctgtgtgtcctcgtcaactgccagattctcaccgaaggctatgaccagccggacgtggactgcgtggtcattgcgcggccaacacgttcccaagcgctgtacgtgcagatggtcgggcgagccctgcgtctccatcctgacaaaacagatgcgctggtgctcgatcttacaggtgcgagcgacgataaatcgctccagacgtttgcgcgtctcatgcgcacccagagaaaaacggcgacacacgcgctggtcggagcggaagaaggcgaagatgccgtgcctatggaggacggggaaagcgtaggcgagtggctgacgcgcgtggcgcaaaagcgggaactcgcggagcaagtggcacaagccatcaatctgttcgcgaacagaagccggtatcgctgggtgcgggtcaaagacaacttcgcgatcgcgtatggccacgatggctgggcgtacttgtaccgcgacggggacgagttttggccggtgctcgaactgaagaacgagaagttcatgccactccatgaccgctccttgccgcttgaatatgcccaaggcgtggtcgaaggctttctctcgctcttcgaatcgtcgcttatcacgaaggaggccgactggcgaaatgctcccatgaccgagaggcagaagtacgtgctccagaagtatcgaatccgctacgatgatacgtggacgcgcggcatggcggcggatgcgctcggacaacgatttgcggcgaagcgggtgcgcgtgctgcagaagaacttcgacgcgcaaaaatggcgggatgtcttagcacagccgcatgggcaagcgtggctggaacatcggctcatggccttacgcgcgcgtgcacagtctcgagcacgcgtagcgcaaaccagctaa

SEQ ID NO: 1018 - DNA, 1953 bp, Artificial
  Alicyclobacillus acidocaldarius mutated SEQ ID NO 1005
gtgcggcccgtacagcgcgcaatccccggaccggtgaagcggtggaagttccggctcgtcgtgtcccggcattcaagccaggtgccgaactcaaacaggccgtgcaggtgtgatcacagcacagggacgccccctgtgccgactgcacgaacgaacatcgtgcggccggcagagggacgtgcgctaaacgatgtggagggcatatccgtggctatccaacttcgtccgtaccaacaggctgccgtcgacgcgttctttcaggctctggccgaaggtcgcaagcgccaactcatcgtccttccgacgggcgcaggcaagaccattgtgttcgggagtgtcgcgcggcgcttccacgaagaagtttcgcgcgagcggccgattctggtcatcgcgcatcgtacggaactgctcgaccaggcggaacagaaaatccacttcgtctggccggaggccttcatcggacgcatccaaggcgctcgcaacgagcagctgggcgacgtactgctcgcttccacgcaaacacttgtcgcaggtcgacggataccccaaccggggctcatcatctatgatgaatgccaccacagccgcgcagagggcgcgcttggcgtactggatcgcttgggtgtgtttgagtcggatggcccgccgttgcttggcgtaaccgcgacaccttcacgttcagatcggacggagttgggcgacatcttcgaacacctgacgtacgagcgcacgattctcgacatgatcatggacggatacctgtcggatgtgcgcggagtgaaggttgaggttccgggtctgaaccttggcgccattcggaccacggcgggtgactacaactcgaaagacctgtcgtacgtgatgaatatcgaatcggcactcgatgcggtcgtggacgccgtggtcacgcacgcgcctgggcgcaaatgcctcgtcttcgcggtcgatgtcaagcacgcgcacgccctcgcggagcgatttcagaagcgtggcatcgcctgcgccgccgtagacggagctatgaaggcagaagaacgcgctgccatcctccaagcgttcgcggagaaccgcctgtgtgtcctcgtcaactgccagattctcaccgaaggctatgaccagccggacgtggactgcgtggtcattgcgcggccaacacgttcccaagcgctgtacgtgcagatggtcgggcgagccctgcgtctccatcctgacaaaacagatgcgctggtgctcgatcttacaggtgcgagcgacgataaatcgctccagacgtttgcgcgtctcatgcgcacccagagaaaaacggcgacacacgcgctggtcggagcggaagaaggcgaagatgccgtgcctatggaggacggggaaagcgtaggcgagtggctgacgcgcgtggcgcaaaagcgggaactcgcggagcaagtggcacaagccatcaatctgttcgcgaacagaagccggtatcgctgggtgcgggtcaaagacaacttcgcgatcgcgtatggccacgatggctgggcgtacttgtaccgcgacggggacgagttttggccggtgctcgaactgaagaacgagaagttcatgccactccatgaccgctccttgccgcttgaatatgcccaaggcgtggtcgaaggctttctctcgctcttcgaatcgtcgcttatcacgaaggaggccgactggcgaaatgctcccatgaccgagaggcagaagtacgtgctccagaagtatcgaatccgctacgatgatacgtggacgcgcggcatggcggcggatgcgctcggacaacgatttgcggcgaagcgggtgcgcgtgctgcagaagaacttcgacgcgcaaaaatggcgggatgtcttagcacagccgcatgggcaagcgtggctggaacatcggctcatggccttacgcgcgcgtgcacagtctcgagcacgcgtagcgcaaaccagctaa

SEQ ID NO: 1019 - DNA, 1953 bp, Artificial
  Alicyclobacillus acidocaldarius mutated SEQ ID NO 1005
gtgcggcccgtacagcgcgcaatccccggaccggtgaagcggtggaagttccggctcgtcgtgtcccggcattcaagccaggtgccgaactcaaacaggccgtgcaggtgtgatcacagcacagggacgccccctgtgccgactgcacgaacgaacatcgtgcggccggcagagggacgtgcgctaaacgatgtggagggcatatccgtggctatccaacttcgtccgtaccaacaggctgccgtcgacgcgttctttcaggctctggccgaaggtcgcaagcgccaactcatcgtccttccgacgggcgcaggcaagaccattgtgttcgggagtgtcgcgcggcgcttccacgaagaagtttcgcgcgagcggccgattctggtcatcgcgcatcgtacggaactgctcgaccaggcggaacagaaaatccacttcgtctggccggaggccttcatcggacgcatccaaggcgctcgcaacgagcagctgggcgacgtactgctcgcttccacgcaaacacttgtcgcaggtcgacggataccccaaccggggctcatcatctatgatgaatgccaccacagccgcgcagagggcgcgcttggcgtactggagcgcttgggtgtgtttgagtcggatggcccgccgttgcttggcgtaaccgcgacaccttcacgttcagatcggacggagttgggcgacatcttcgaacacctgacgtacgagcgcacgattctcgacatgatcatggacggatacctgtcggatgtgcgcggagtgaaggttgaggttccgggtctgaaccttggcgccattcggaccacggcgggtgactacaactcgaaagaactgtcgtacgtgatgaatatcgaatcggcactcgatgcggtcgtggacgccgtggtcacgcacgcgcctgggcgcaaatgcctcgtcttcgcggtcgatgtcaagcacgcgcacgccctcgcggagcgatttcagaagcgtggcatcgcctgcgccgccgtagacggagctatgaaggcagaagaacgcgctgccatcctccaagcgttcgcggagaaccgcctgtgtgtcctcgtcaactgccagattctcaccgaaggctatgaccagccggacgtggactgcgtggtcattgcgcggccaacacgttcccaagcgctgtacgtgcagatggtcgggcgagccctgcgtctccatcctgacaaaacagatgcgctggtgctcgatcttacaggtgcgagcgacgataaatcgctccagacgtttgcgcgtctcatgcgcacccagagaaaaacggcgacacacgcgctggtcggagcggaagaaggcgaagatgccgtgcctatggaggacggggaaagcgtaggcgagtggctgacgcgcgtggcgcaaaagcgggaactcgcggagcaagtggcacaagccatcaatctgttcgcgaacagaagccggtatcgctgggtgcgggtcaaagacaacttcgcgatcgcgtatggccacgatggctgggcgtacttgtaccgcgacggggacgagttttggccggtgctcgaactgaagaacgagaagttcatgccactccatgaccgctccttgccgcttgaatatgcccaaggcgtggtcgaaggctttctctcgctcttcgaatcgtcgcttatcacgaaggaggccgactggcgaaatgctcccatgaccgagaggcagaagtacgtgctccagaagtatcgaatccgctacgatgatacgtggacgcgcggcatggcggcggatgcgctcggacaacgatttgcggcgaagcgggtgcgcgtgctgcagaagaacttcgacgcgcaaaaatggcgggatgtcttagcacagccgcatgggcaagcgtggctggaacatcggctcatggccttacgcgcgcgtgcacagtctcgagcacgcgtagcgcaaaccagctaa

SEQ ID NO: 1020 - DNA, 1953 bp, Artificial
  Alicyclobacillus acidocaldarius mutated SEQ ID NO 1005
gtgcggcccgtacagcgcgcaatccccggaccggtgaagcggtggaagttccggctcgtcgtgtcccggcattcaagccaggtgccgaactcaaacaggccgtgcaggtgtgatcacagcacagggacgccccctgtgccgactgcacgaacgaacatcgtgcggccggcagagggacgtgcgctaaacgatgtggagggcatatccgtggctatccaacttcgtccgtaccaacaggctgccgtcgacgcgttctttcaggctctggccgaaggtcgcaagcgccaactcatcgtccttccgacgggcgcaggcaagaccattgtgttcgggagtgtcgcgcggcgcttccacgaagaagtttcgcgcgagcggccgattctggtcatcgcgcatcgtacggaactgctcgaccaggcggaacagaaaatccacttcgtctggccggaggccttcatcggacgcatccaaggcgctcgcaacgagcagctgggcgacgtactgctcgcttccacgcaaacacttgtcgcaggtcgacggataccccaaccggggctcatcatctatgatgaatgccaccacagccgcgcagagggcgcgcttggcgtactggagcgcttgggtgtgtttgagtcggatggcccgccgttgcttggcgtaaccgcgacaccttcacgttcagatcggacggagttgggcgacatcttcgaacacctgacgtacgagcgcacgattctcgacatgatcatggacggatacctgtcggatgtgcgcggagtgaaggttgaggttccgggtctgaaccttggcgccattcggaccacggcgggtgactacaactcgaaagacctgtcgtacgtgatgaatatcgaatcggcactcgatgcggtcgtggacgccgtggtcacgcacgcgcctgggcgcaaatgcctcgtcttcgcggtcgatgtcaagcacgcgcacgccctcgcggagcgatttcagaagcgtggcatcgcctgcgccgccgtagacggagctatgaaggcagaagaacgcgctgccatcctccaagcgttcgcggagaaccgcctgtgtgtcctcgtcaactgccagattctcaccgaaggctatgaccagccggacgtggactgcgtggtcattgcgcggccaacacgttcccaagcgctgtacgtgcagatggtcgggcgagccctgcgtctccatcctgacaaaacagatgcgctggtgctcgatcttacaggtgcgagcgacgataaatcgctccagacgtttgcgcgtctcatgcgcacccagagaaaaacggcgacacacgcgctggtcggagcggaagaaggcgatgatgccgtgcctatggaggacggggaaagcgtaggcgagtggctgacgcgcgtggcgcaaaagcgggaactcgcggagcaagtggcacaagccatcaatctgttcgcgaacagaagccggtatcgctgggtgcgggtcaaagacaacttcgcgatcgcgtatggccacgatggctgggcgtacttgtaccgcgacggggacgagttttggccggtgctcgaactgaagaacgagaagttcatgccactccatgaccgctccttgccgcttgaatatgcccaaggcgtggtcgaaggctttctctcgctcttcgaatcgtcgcttatcacgaaggaggccgactggcgaaatgctcccatgaccgagaggcagaagtacgtgctccagaagtatcgaatccgctacgatgatacgtggacgcgcggcatggcggcggatgcgctcggacaacgatttgcggcgaagcgggtgcgcgtgctgcagaagaacttcgacgcgcaaaaatggcgggatgtcttagcacagccgcatgggcaagcgtggctggaacatcggctcatggccttacgcgcgcgtgcacagtctcgagcacgcgtagcgcaaaccagctaa

SEQ ID NO: 1021 - protein, 91 aa, Alicyclobacillus acidocaldarius
MNKRDLIRKTAEETGLSQKDCEAVINTLFDTIRKTVESGEKVQIIGFGTFELRERAARTARNPRTGEAVEVPARRVPAFKPGAELKQAVQV

SEQ ID NO: 1022 - DNA, 276 bp, Alicyclobacillus acidocaldarius
atgaacaaacgggacctcattcgaaaaaccgctgaagagacaggactatcccagaaagactgcgaagccgtgatcaacacgctctttgataccatccggaagacggtagagtccggcgagaaagtccaaatcatcggctttggaacgttcgagttgcgtgagcgtgcggcccgtacagcgcgcaatccccggaccggtgaagcggtggaagttccggctcgtcgtgtcccggcattcaagccaggtgccgaactcaaacaggccgtgcaggtgtga

SEQ ID NO: 1023 - protein, 90 aa, Bacillus cereus
MNKTELIKNVAQSADISQKDASAAVQSVFDTIANALQSGDKVQLIGFGTFEVRERSARTGRNPQTGEEIQIAAGKVPAFKAGKELKEAVK

SEQ ID NO: 1024 - protein, 90 aa, Bacillus weihenstephanensis
MNKTELVKNVAQSADISQKDASAAVQSVFDTIANALQSGDKVQLIGFGTFEVRERSARTGRNPQTGEEIQIAAGKVPAFKAGKELKEAVK

SEQ ID NO: 1025 - protein, 90 aa, Bacillus anthracis
MNKTELIKNVAQSADISQKDASAAVQSVFDTIATALQSGDKVQLIGFGTFEVRERSARTGRNPQTGEEIQIAAGKVPAFKAGKELKEAVK

SEQ ID NO: 1026 - protein, 90 aa, Bacillus cereus
MNKTELIKNVAQSADISQKDASVAVQSVFDTITNALQNGDKVQLIGFGTFEVRERAARTGRNPQTGEEIQIAAGKVPAFKAGKELKEAVK

SEQ ID NO: 1027 - protein, 89 aa, Lactobacillus salivarius
NKAALIERVAEKTGLTKKDATVAVDAVFETIQDALVDGEKVQLIGFGNFEVRERAARKGRNPQTGEEIEIPASKVPAFKPGKSLKDAVK

SEQ ID NO: 1028 - protein, 91 aa, Artificial
  Alicyclobacillus acidocaldarius mutated SEQ ID NO 1021
MNKRDLIRKTAEETGLSQKDCEAVINTLFDTIRKTVDSGEKVQIIGFGTFELRERAARTARNPRTGEAVEVPARRVPAFKPGAELKQAVQV

SEQ ID NO: 1029 - protein, 91 aa, Artificial
  Alicyclobacillus acidocaldarius mutated SEQ ID NO 1021
MNKRELIRKTAEETGLSQKDCEAVINTLFDTIRKTVESGEKVQIIGFGTFELRERAARTARNPRTGEAVEVPARRVPAFKPGAELKQAVQV

SEQ ID NO: 1030 - protein, 91 aa, Artificial
  Alicyclobacillus acidocaldarius mutated SEQ ID NO 1021
MNKKDLIRKTAEETGLSQKDCEAVINTLFDTIRKTVESGEKVQIIGFGTFELRERAARTARNPRTGEAVEVPARRVPAFKPGAELKQAVQV

SEQ ID NO: 1031 - protein, 91 aa, Artificial
  Alicyclobacillus acidocaldarius mutated SEQ ID NO 1021
MNKRDLIRKTAEETGLSQKDCDAVINTLFDTIRKTVESGEKVQIIGFGTFELRERAARTARNPRTGEAVEVPARRVPAFKPGAELKQAVQV

SEQ ID NO: 1032 - protein, 91 aa, Artificial
  Alicyclobacillus acidocaldarius mutated SEQ ID NO 1021
MNKRDLIRKTAEETGLSQKDCEAVINTLFDTIRKTVESGEKVQIIGFGTFELRERAARTARNPRTGEAVEVPAKRVPAFKPGAELKQAVQV

SEQ ID NO: 1033 - DNA, 276 bp, Artificial
  Alicyclobacillus acidocaldarius mutated SEQ ID NO 1022
atgaacaaacgggacctcattcgaaaaaccgctgaagagacaggactatcccagaaagactgcgaagccgtgatcaacacgctctttgataccatccggaagacggtagattccggcgagaaagtccaaatcatcggctttggaacgttcgagttgcgtgagcgtgcggcccgtacagcgcgcaatccccggaccggtgaagcggtggaagttccggctcgtcgtgtcccggcattcaagccaggtgccgaactcaaacaggccgtgcaggtgtga

SEQ ID NO: 1034 - DNA, 276 bp, Artificial
  Alicyclobacillus acidocaldarius mutated SEQ ID NO 1022
atgaacaaacgggaactcattcgaaaaaccgctgaagagacaggactatcccagaaagactgcgaagccgtgatcaacacgctctttgataccatccggaagacggtagagtccggcgagaaagtccaaatcatcggctttggaacgttcgagttgcgtgagcgtgcggcccgtacagcgcgcaatccccggaccggtgaagcggtggaagttccggctcgtcgtgtcccggcattcaagccaggtgccgaactcaaacaggccgtgcaggtgtga

SEQ ID NO: 1035 - DNA, 276 bp, Artificial
  Alicyclobacillus acidocaldarius mutated SEQ ID NO 1022
atgaacaaaaaagacctcattcgaaaaaccgctgaagagacaggactatcccagaaagactgcgaagccgtgatcaacacgctctttgataccatccggaagacggtagagtccggcgagaaagtccaaatcatcggctttggaacgttcgagttgcgtgagcgtgcggcccgtacagcgcgcaatccccggaccggtgaagcggtggaagttccggctcgtcgtgtcccggcattcaagccaggtgccgaactcaaacaggccgtgcaggtgtga

SEQ ID NO: 1036 - DNA, 276 bp, Artificial
  Alicyclobacillus acidocaldarius mutated SEQ ID NO 1022
atgaacaaacgggacctcattcgaaaaaccgctgaagagacaggactatcccagaaagactgcgatgccgtgatcaacacgctctttgataccatccggaagacggtagagtccggcgagaaagtccaaatcatcggctttggaacgttcgagttgcgtgagcgtgcggcccgtacagcgcgcaatccccggaccggtgaagcggtggaagttccggctcgtcgtgtcccggcattcaagccaggtgccgaactcaaacaggccgtgcaggtgtga

SEQ ID NO: 1037 - DNA, 276 bp, Artificial
  Alicyclobacillus acidocaldarius mutated SEQ ID NO 1022
atgaacaaacgggacctcattcgaaaaaccgctgaagagacaggactatcccagaaagactgcgaagccgtgatcaacacgctctttgataccatccggaagacggtagagtccggcgagaaagtccaaatcatcggctttggaacgttcgagttgcgtgagcgtgcggcccgtacagcgcgcaatccccggaccggtgaagcggtggaagttccggctaaacgtgtcccggcattcaagccaggtgccgaactcaaacaggccgtgcaggtgtga

SEQ ID NO: 1038 - protein, 706 aa, Alicyclobacillus acidocaldarius
MDTQCIEVRCGSARHHLSYEDLFTPEVQSLFEECYALGVEVRCLCNPDRPVPMHLRRVRIRPPTYTVVTNPLGIHHPNCPRFRQSRHPSASHKTRDAQAVETTPNHIEEWLPHRRIFVPTLDQLNDAQREAATHKNGPCMVVAAAGSGKTAMLIARIQHLINQGVRPGDILACTFTRKAAQEMTDRLLAAVGERGKAVTIGTIHSVAYRMVTPELGEDWRVLSDPTWMIERVLEEPSGKNPHGVGPVMKLGEAISAIAKAKADALGPHQVSDPLTKVYAAYETLKAERKTLDFEDMILHAIRLFRTDEAFAKRWRQRWRYVMVDEFQDTNTAQWLFLLELVKAHNNLFVVGDDWQSIYYFRGARPDLMKEFLRRFPDAKRVTLETNYRSHDLIVDVGRRIIRLNDGHQLPKRVVAHRSMPEGAIAQIVTVRSDLEEARFVAQELQRLRKEHGVSWSDCAVLYRTNIQSRLFEEALADADIPYHVVGDKHFYESPDVKIILDYLRTTQDTSDPTVWGHLLNRPKRYIPIDVVHEVQHGGWEAVVAHPKCRAFVTTIDTLRRIEEPSKAIQWLVDNHPGLVRQQDEDEPIKWVDSLIASASRYKTVASFLRFVDWIIEKSKEPKDEAVQLMTIHKAKGLEWTTVFVAGLAEGLLPHKKALKGEELREETRLCYVAATRARDNLYLMAAKWYGDKEREVSRYVNAVKNP

SEQ ID NO: 1039 - DNA, 2121 bp, Alicyclobacillus acidocaldarius
atggatacgcagtgcatcgaagttcgctgtggcagtgctcgtcatcacctgtcgtatgaggacttgttcactcctgaagttcaatccttgttcgaagaatgctacgcacttggcgtcgaagtgcgctgtctctgcaaccccgaccgtccagtccccatgcatctgcgccgcgtccgcatccgccctccgacgtacactgtcgtcacgaatcctctgggcatccatcacccgaactgtccgcggtttcgccaatcacgtcatccaagcgcgtctcacaaaacgcgtgacgcacaagccgtcgaaactacgccaaatcacatcgaagaatggcttccgcataggaggatctttgtgcccaccttagatcagctgaacgacgcacaacgagaagctgcaacgcacaaaaacggtccttgcatggtcgtcgccgcggccggttcaggaaagaccgccatgctcatcgcgcgcatccagcatctcatcaaccagggcgtaagacctggggacatcctcgcgtgcacgttcacgcgcaaggccgcgcaggagatgaccgaccgcctgcttgccgccgtgggcgaacggggaaaggccgtgaccatcgggacgattcattcggtcgcatatcgcatggtcacgccagaactcggggaggactggcgtgtgctgtcggaccccacgtggatgatcgagcgtgtgctggaggagccaagtggcaagaatccgcacggcgtcgggcccgtgatgaagctaggcgaggccatctccgccatcgccaaggccaaagcggacgcgcttgggccgcaccaggtgtctgaccctttgaccaaggtctacgcggcatatgagacgctgaaggctgagcgtaagaccctggacttcgaggacatgatcctccacgcgattcgcctgttccgcacggacgaagcgttcgcgaagcggtggcgtcagcgttggcgatacgtcatggtggacgagtttcaggacacgaacacggcgcagtggctgttcttgttggaactcgtcaaggcgcacaacaacctatttgtcgtaggggatgattggcagtccatttactacttccgcggggcacgcccggacctcatgaaagagttcctacgtcggtttccggacgcaaaaagggtcacgctggagaccaattatcgctcacacgaccttatcgtcgacgtagggcggcgcatcatccggttgaacgacgggcatcagctccctaaacgcgtggtcgcgcaccgctcaatgccggaaggcgcgatcgcacaaatcgtgacggtgcgctctgacctcgaggaagcgcgcttcgtcgcgcaggaactccagcgtctacggaaggagcacggagtatcctggagcgattgcgccgtgctctatcgaacgaacatccagtcgcggctctttgaagaagcgctcgccgacgcggacattccgtatcacgtggtcggagacaagcatttctacgagtcgccggacgtgaaaatcatcctggactatctgcgaacgacgcaggacacgtccgatccgaccgtgtgggggcacctgctcaatcgtcccaagcgctacatcccgatcgacgtcgtgcacgaggttcagcacggcggatgggaggcggtggtcgcgcaccccaaatgtcgtgcctttgtgaccacaatcgacacgcttcgccgtatagaggaaccttccaaagcgatacaatggttggtagacaaccacccgggtctagtacgccaacaagatgaggacgaacccatcaagtgggtggattcgctcatcgcttcggcgtccagatacaagaccgtcgcgtcgtttttgcgtttcgtggattggatcatcgagaagtcgaaggagccgaaggacgaggctgtgcaactcatgaccatccacaaggccaagggcttggaatggaccaccgtgttcgtcgcaggcctcgcggaaggcctgttgccgcacaagaaggccttgaagggtgaggaactgcgcgaagagacgcgcttgtgttacgtcgcggccacacgagcacgcgacaatctgtatctcatggcggccaagtggtacggagacaaggagcgggaagtctcacgttacgtgaacgcggttaaaaatccgtga

SEQ ID NO: 1040 - protein, 613 aa, Ruminococcus torques
DTLNKPQKEAVFHTEGPLLILAGAGSGKTRVLTHRIAYLIEEKGVNPWNILAITFTNKAAEEMRQRVDSLVGIGAESIWVSTFHSMCVRILRRYIDRLGYDNRFTIYDTDDQKTLMKEVCRKTDIDTKRFKERMLLSVISSAKNEMILPEEFELNAGGDFVQLKIAKVYKEYEAQMRANNALDFDDLLVKTVQLLETQPDVRENYQERFRYIMVDEYQDTNTVQFRLVSLLAGKYRNLCVVGDDDQSIYKFRGANIRNILDFEKEFSDAKVIKLEQNYRSVGNVLEVANSVIRNNKGRKEKTLWTDNEKGEKIRLRQFDTAYDEAQFIAEDIKDETAQGANYSDHAVLYRTNAQSRLLEEKFVAMNIPYKIVGGINFYSRREIKDVLSYLKTIDNGKDDLAVRRIINVPKRGIGLTTINRIQESAAARGIGFYDALSAPDLIPGIGRSASKLDSFAALIEYFKGRSEESGVTDLLTEVIEKTGYTESLEADDPEELEARVQNIDELVSKAAVYEESCSDRGERPTLSGFLEEVALVADIDSVAEDRDYVILMTLHSAKGLEFPHVYLAGMEDGLFPSYMSISGDDPEELEEERRLCYVGVTRAEEKLTLTCAR

SEQ ID NO: 1041 - protein, 621 aa, Clostridium difficile
LDTLNPAQREAVEKTEGPVLILAGAGSGKTKVLTTRIAYLIEDKGVQAPNILAITFTNKAANEMRERVEQNIGPETKDMWISTFHSCCVRILRKDINKIGYNRSFVIYDSADQVTLVKDCLKELNLSDKVFEPKAVISAISGAKDKLYTPKQFKDINMADNRMVKIADIYALYQDRLKRNSALDFDDLILKTVELFKANDEVLAYYRSRFRYIMVDEYQDTSKAQYELIKLLAREHQNICVVGDDDQSIYGWRGADIRNILEFEKDYDNVHVVKLEQNYRSTQVILDAANKVISNNIERKRKKLWSEKKEGELIKIQLTGSEIEEADFIADSIAQIARKENRPYKDFAVLYRANAQARPVEDALNRSQIPYNIYGGTKFYERKEIKDLLAYLRVIQNPQDDISIKRIINVPRRGIGLRTIEKIEDRANLKQESIYSVLIDIETNSDISTKARASISGFVDIIGTLRTIKEVYPVSKLIEKVLDTTGYMDELVEIRNKNEKDLTGKGEEAQDRIDNLREFISIALEFESSNDDTYENKDLETFLTSIALTSESNDEEDNDRVSLMTIHTSKGLEFPVVFLTGMEEGLFPISRAIKSMSDSQIEEERRLCYVGITRAKEELYM

SEQ ID NO: 1042 - protein, 621 aa, Clostridium difficile; identical to SEQ ID NO: 1041

SEQ ID NO: 1043 - protein, 607 aa, Heliobacterium modesticaldum
LHSLNPVQREAVLHQEGPLLLLAGAGSGKTRVLTHRIGHLIEQCRVSPFHILAITFTNKAAAEMRERLGRLIGPRAHDVWVSTFHSTCMRILRKDGEKLGYDRSFVIYDYDDQQRLLKECLKELNIDEKRFKPQAVGAAISSAKNRLVGPVAFERQAYDHFAQISAKVYHIYQKKLKAHNAMDFDDLLVNGVCLFREFPHVLDNYQDRFRYIHVDEYQDTNHAQYVLVKLLADKYRNLCVVGDDDQSIYGWRGADIQNILDFERDYPEAVVLKLEQNYRSTGKILEAANAVVGNNRGRKSKKLWTQNPSGQPIVAYQGETEHDEARYIVRTIKRLSESENRPYRDFAILYRTNAQSRVLEEHFMYAGIPYRIFGGLRFYERKEIKDIVAYLRFISNPADAVSFRRVVNVPKRGIGDATVQKLLEHADSEGWTVGEALARVGEVPGLSRAVKALSAFGQMIEELRREAPSLLVTQIVEAILNRTGYVRELEAEKTEEAKGRIENIKEFLSVTKEFDRTADDKTLEEFLAGVSLVSDTDNYNEDEDAVVLMTMHSAKGLEFPVVFVAGMEEGVFPHSRVQFEETQVEEERRLCYVAITRARERLYLARA

SEQ ID NO: 1044 - protein, 609 aa, Halothermothrix orenii
LTGLNPEQKKAVEHFEGPLLILAGAGSGKTRVLTHRIAYLIENYGVNPLQILAVTFTNKAAGEMKERVDNLLGGMAGDLWVSTFHSLCARILRKEIGKIGYDNNFVIFDTDDQQKLISRILKELNLDPKKTRPRAILSEISRAKNELIDPRSYANNVGDYFQDITARIYPLYQERLKESNALDFDDLIMKTIEVFVDNPMVLEYYQERFKYILVDEYQDVNFAQYKLVQLLANKYRNLCVVGDPDQGIYGFRGADIRNILNFEEDYPEARVIKLEQNYRSKEKILKAAHHVIRNNTARKEKRLWTKRGKGEDLKLYVAFDDKDEASYVCRKIKELKREKNYKFSDFAVLYRTNSQSRSVEEMMVKYAIPYQIVGGFRFYDRMEIKDILAYLRVIYNPSDEVSLLRIINRPKRGIGQGTISKLSRYARERGISLYKAGTEAESNPYLTASFKKRVKAFFDLLEELREKSETLSIDTLTHQVVTRTGYQRELNEEGTQQARNRLENIQELFSVIEEFMKGNENKTLGAFLEEVSLISDVDNMEDNQNVVTLMTLHSAKGLEFPVVFIIGMEEGLFPHANSMMDHEELEEERRLCYVGITRARDELYLTRAR

SEQ ID NO: 1045 - protein, 706 aa, Artificial
  Alicyclobacillus acidocaldarius mutated SEQ ID NO 1038
MDTQCIEVRCGSARHHLSYEDLFTPEVQSLFEECYALGVEVRCLCNPDRPVPMHLRRVRIRPPTYTVVTNPLGIHHPNCPRFRQSRHPSASHKTKDAQAVETTPNHIEEWLPHRRIFVPTLDQLNDAQREAATHKNGPCMVVAAAGSGKTAMLIARIQHLINQGVRPGDILACTFTRKAAQEMTDRLLAAVGERGKAVTIGTIHSVAYRMVTPELGEDWRVLSDPTWMIERVLEEPSGKNPHGVGPVMKLGEAISAIAKAKADALGPHQVSDPLTKVYAAYETLKAERKTLDFEDMILHAIRLFRTDEAFAKRWRQRWRYVMVDEFQDTNTAQWLFLLELVKAHNNLFVVGDDWQSIYYFRGARPDLMKEFLRRFPDAKRVTLETNYRSHDLIVDVGRRIIRLNDGHQLPKRVVAHRSMPEGAIAQIVTVRSDLEEARFVAQELQRLRKEHGVSWSDCAVLYRTNIQSRLFEEALADADIPYHVVGDKHFYESPDVKIILDYLRTTQDTSDPTVWGHLLNRPKRYIPIDVVHEVQHGGWEAVVAHPKCRAFVTTIDTLRRIEEPSKAIQWLVDNHPGLVRQQDEDEPIKWVDSLIASASRYKTVASFLRFVDWIIEKSKEPKDEAVQLMTIHKAKGLEWTTVFVAGLAEGLLPHKKALKGEELREETRLCYVAATRARDNLYLMAAKWYGDKEREVSRYVNAVKNP

SEQ ID NO: 1046 - protein, 706 aa, Artificial
  Alicyclobacillus acidocaldarius mutated SEQ ID NO 1038
MDTQCIEVRCGSARHHLSYEDLFTPEVQSLFEECYALGVEVRCLCNPDRPVPMHLRRVRIRPPTYTVVTNPLGIHHPNCPRFRQSRHPSASHKTRDAQAVETTPNHIEEWLPHRRIFVPTLDQLNDAQREAATHKNGPCMVVAAAGSGKTAMLIARIQHLINQGVRPGDILACTFTRKAAQEMTDRLLAAVGERGKAVTIGTIHSVAYRMVTPELGEDWRVLSDPTWMIERVLEEPSGKNPHGVGPVMKLGEAISAIAKAKADALGPHQVSDPLTKVYAAYETLKAERKTLDFEDMILHAIRLFRTDEAFAKKWRQRWRYVMVDEFQDTNTAQWLFLLELVKAHNNLFVVGDDWQSIYYFRGARPDLMKEFLRRFPDAKRVTLETNYRSHDLIVDVGRRIIRLNDGHQLPKRVVAHRSMPEGAIAQIVTVRSDLEEARFVAQELQRLRKEHGVSWSDCAVLYRTNIQSRLFEEALADADIPYHVVGDKHFYESPDVKIILDYLRTTQDTSDPTVWGHLLNRPKRYIPIDVVHEVQHGGWEAVVAHPKCRAFVTTIDTLRRIEEPSKAIQWLVDNHPGLVRQQDEDEPIKWVDSLIASASRYKTVASFLRFVDWIIEKSKEPKDEAVQLMTIHKAKGLEWTTVFVAGLAEGLLPHKKALKGEELREETRLCYVAATRARDNLYLMAAKWYGDKEREVSRYVNAVKNP

SEQ ID NO: 1047 - protein, 706 aa, Artificial
  Alicyclobacillus acidocaldarius mutated SEQ ID NO 1038
MDTQCIEVRCGSARHHLSYEDLFTPEVQSLFEECYALGVEVRCLCNPDRPVPMHLRRVRIRPPTYTVVTNPLGIHHPNCPRFRQSRHPSASHKTRDAQAVETTPNHIEEWLPHRRIFVPTLDQLNDAQREAATHKNGPCMVVAAAGSGKTAMLIARIQHLINQGVRPGDILACTFTRKAAQEMTDRLLAAVGERGKAVTIGTIHSVAYRMVTPELGEDWRVLSDPTWMIERVLEEPSGKNPHGVGPVMKLGEAISAIAKAKADALGPHQVSDPLTKVYAAYETLKAERKTLDFEDMILHAIRLFRTDEAFAKRWRQRWRYVMVDEFQDTNTAQWLFLLELVKAHNNLFVVGDDWQSIYYFRGARPDLMKEFLRRFPDAKRVTLETNYRSHDLIVDVGRRIIRLNDGHQLPKRVVAHRSMPEGAIAQIVTVRSDLEEARFVAQELQRLRKEHGVSWSDCAVLYRTNIQSRLFEEALADADIPYHVVGDKHFYESPDVKIILDYLRTTQDTSDPTVWGHLLNKPKRYIPIDVVHEVQHGGWEAVVAHPKCRAFVTTIDTLRRIEEPSKAIQWLVDNHPGLVRQQDEDEPIKWVDSLIASASRYKTVASFLRFVDWIIEKSKEPKDEAVQLMTIHKAKGLEWTTVFVAGLAEGLLPHKKALKGEELREETRLCYVAATRARDNLYLMAAKWYGDKEREVSRYVNAVKNP

SEQ ID NO: 1048 - protein, 706 aa, Artificial
  Alicyclobacillus acidocaldarius mutated SEQ ID NO 1038
MDTQCIEVRCGSARHHLSYEDLFTPDVQSLFEECYALGVEVRCLCNPDRPVPMHLRRVRIRPPTYTVVTNPLGIHHPNCPRFRQSRHPSASHKTRDAQAVETTPNHIEEWLPHRRIFVPTLDQLNDAQREAATHKNGPCMVVAAAGSGKTAMLIARIQHLINQGVRPGDILACTFTRKAAQEMTDRLLAAVGERGKAVTIGTIHSVAYRMVTPELGEDWRVLSDPTWMIERVLEEPSGKNPHGVGPVMKLGEAISAIAKAKADALGPHQVSDPLTKVYAAYETLKAERKTLDFEDMILHAIRLFRTDEAFAKRWRQRWRYVMVDEFQDTNTAQWLFLLELVKAHNNLFVVGDDWQSIYYFRGARPDLMKEFLRRFPDAKRVTLETNYRSHDLIVDVGRRIIRLNDGHQLPKRVVAHRSMPEGAIAQIVTVRSDLEEARFVAQELQRLRKEHGVSWSDCAVLYRTNIQSRLFEEALADADIPYHVVGDKHFYESPDVKIILDYLRTTQDTSDPTVWGHLLNRPKRYIPIDVVHEVQHGGWEAVVAHPKCRAFVTTIDTLRRIEEPSKAIQWLVDNHPGLVRQQDEDEPIKWVDSLIASASRYKTVASFLRFVDWIIEKSKEPKDEAVQLMTIHKAKGLEWTTVFVAGLAEGLLPHKKALKGEELREETRLCYVAATRARDNLYLMAAKWYGDKEREVSRYVNAVKNP

SEQ ID NO: 1049 - protein, 706 aa, Artificial
  Alicyclobacillus acidocaldarius mutated SEQ ID NO 1038
MDTQCIEVRCGSARHHLSYEDLFTPEVQSLFEECYALGVEVRCLCNPDRPVPMHLRRVRIRPPTYTVVTNPLGIHHPNCPRFKQSRHPSASHKTRDAQAVETTPNHIEEWLPHRRIFVPTLDQLNDAQREAATHKNGPCMVVAAAGSGKTAMLIARIQHLINQGVRPGDILACTFTRKAAQEMTDRLLAAVGERGKAVTIGTIHSVAYRMVTPELGEDWRVLSDPTWMIERVLEEPSGKNPHGVGPVMKLGEAISAIAKAKADALGPHQVSDPLTKVYAAYETLKAERKTLDFEDMILHAIRLFRTDEAFAKRWRQRWRYVMVDEFQDTNTAQWLFLLELVKAHNNLFVVGDDWQSIYYFRGARPDLMKEFLRRFPDAKRVTLETNYRSHDLIVDVGRRIIRLNDGHQLPKRVVAHRSMPEGAIAQIVTVRSDLEEARFVAQELQRLRKEHGVSWSDCAVLYRTNIQSRLFEEALADADIPYHVVGDKHFYESPDVKIILDYLRTTQDTSDPTVWGHLLNRPKRYIPIDVVHEVQHGGWEAVVAHPKCRAFVTTIDTLRRIEEPSKAIQWLVDNHPGLVRQQDEDEPIKWVDSLIASASRYKTVASFLRFVDWIIEKSKEPKDEAVQLMTIHKAKGLEWTTVFVAGLAEGLLPHKKALKGEELREETRLCYVAATRARDNLYLMAAKWYGDKEREVSRYVNAVKNP

SEQ ID NO: 1050 - DNA, 2121 bp, Artificial
  Alicyclobacillus acidocaldarius mutated SEQ ID NO 1039
atggatacgcagtgcatcgaagttcgctgtggcagtgctcgtcatcacctgtcgtatgaggacttgttcactcctgaagttcaatccttgttcgaagaatgctacgcacttggcgtcgaagtgcgctgtctctgcaaccccgaccgtccagtccccatgcatctgcgccgcgtccgcatccgccctccgacgtacactgtcgtcacgaatcctctgggcatccatcacccgaactgtccgcggtttcgccaatcacgtcatccaagcgcgtctcacaaaacgaaagacgcacaagccgtcgaaactacgccaaatcacatcgaagaatggcttccgcataggaggatctttgtgcccaccttagatcagctgaacgacgcacaacgagaagctgcaacgcacaaaaacggtccttgcatggtcgtcgccgcggccggttcaggaaagaccgccatgctcatcgcgcgcatccagcatctcatcaaccagggcgtaagacctggggacatcctcgcgtgcacgttcacgcgcaaggccgcgcaggagatgaccgaccgcctgcttgccgccgtgggcgaacggggaaaggccgtgaccatcgggacgattcattcggtcgcatatcgcatggtcacgccagaactcggggaggactggcgtgtgctgtcggaccccacgtggatgatcgagcgtgtgctggaggagccaagtggcaagaatccgcacggcgtcgggcccgtgatgaagctaggcgaggccatctccgccatcgccaaggccaaagcggacgcgcttgggccgcaccaggtgtctgaccctttgaccaaggtctacgcggcatatgagacgctgaaggctgagcgtaagaccctggacttcgaggacatgatcctccacgcgattcgcctgttccgcacggacgaagcgttcgcgaagcggtggcgtcagcgttggcgatacgtcatggtggacgagtttcaggacacgaacacggcgcagtggctgttcttgttggaactcgtcaaggcgcacaacaacctatttgtcgtaggggatgattggcagtccatttactacttccgcggggcacgcccggacctcatgaaagagttcctacgtcggtttccggacgcaaaaagggtcacgctggagaccaattatcgctcacacgaccttatcgtcgacgtagggcggcgcatcatccggttgaacgacgggcatcagctccctaaacgcgtggtcgcgcaccgctcaatgccggaaggcgcgatcgcacaaatcgtgacggtgcgctctgacctcgaggaagcgcgcttcgtcgcgcaggaactccagcgtctacggaaggagcacggagtatcctggagcgattgcgccgtgctctatcgaacgaacatccagtcgcggctctttgaagaagcgctcgccgacgcggacattccgtatcacgtggtcggagacaagcatttctacgagtcgccggacgtgaaaatcatcctggactatctgcgaacgacgcaggacacgtccgatccgaccgtgtgggggcacctgctcaatcgtcccaagcgctacatcccgatcgacgtcgtgcacgaggttcagcacggcggatgggaggcggtggtcgcgcaccccaaatgtcgtgcctttgtgaccacaatcgacacgcttcgccgtatagaggaaccttccaaagcgatacaatggttggtagacaaccacccgggtctagtacgccaacaagatgaggacgaacccatcaagtgggtggattcgctcatcgcttcggcgtccagatacaagaccgtcgcgtcgtttttgcgtttcgtggattggatcatcgagaagtcgaaggagccgaaggacgaggctgtgcaactcatgaccatccacaaggccaagggcttggaatggaccaccgtgttcgtcgcaggcctcgcggaaggcctgttgccgcacaagaaggccttgaagggtgaggaactgcgcgaagagacgcgcttgtgttacgtcgcggccacacgagcacgcgacaatctgtatctcatggcggccaagtggtacggagacaaggagcgggaagtctcacgttacgtgaacgcggttaaaaatccgtga

SEQ ID NO: 1051 - DNA, 2121 bp, Artificial
  Alicyclobacillus acidocaldarius mutated SEQ ID NO 1039
atggatacgcagtgcatcgaagttcgctgtggcagtgctcgtcatcacctgtcgtatgaggacttgttcactcctgaagttcaatccttgttcgaagaatgctacgcacttggcgtcgaagtgcgctgtctctgcaaccccgaccgtccagtccccatgcatctgcgccgcgtccgcatccgccctccgacgtacactgtcgtcacgaatcctctgggcatccatcacccgaactgtccgcggtttcgccaatcacgtcatccaagcgcgtctcacaaaacgcgtgacgcacaagccgtcgaaactacgccaaatcacatcgaagaatggcttccgcataggaggatctttgtgcccaccttagatcagctgaacgacgcacaacgagaagctgcaacgcacaaaaacggtccttgcatggtcgtcgccgcggccggttcaggaaagaccgccatgctcatcgcgcgcatccagcatctcatcaaccagggcgtaagacctggggacatcctcgcgtgcacgttcacgcgcaaggccgcgcaggagatgaccgaccgcctgcttgccgccgtgggcgaacggggaaaggccgtgaccatcgggacgattcattcggtcgcatatcgcatggtcacgccagaactcggggaggactggcgtgtgctgtcggaccccacgtggatgatcgagcgtgtgctggaggagccaagtggcaagaatccgcacggcgtcgggcccgtgatgaagctaggcgaggccatctccgccatcgccaaggccaaagcggacgcgcttgggccgcaccaggtgtctgaccctttgaccaaggtctacgcggcatatgagacgctgaaggctgagcgtaagaccctggacttcgaggacatgatcctccacgcgattcgcctgttccgcacggacgaagcgttcgcgaagaaatggcgtcagcgttggcgatacgtcatggtggacgagtttcaggacacgaacacggcgcagtggctgttcttgttggaactcgtcaaggcgcacaacaacctatttgtcgtaggggatgattggcagtccatttactacttccgcggggcacgcccggacctcatgaaagagttcctacgtcggtttccggacgcaaaaagggtcacgctggagaccaattatcgctcacacgaccttatcgtcgacgtagggcggcgcatcatccggttgaacgacgggcatcagctccctaaacgcgtggtcgcgcaccgctcaatgccggaaggcgcgatcgcacaaatcgtgacggtgcgctctgacctcgaggaagcgcgcttcgtcgcgcaggaactccagcgtctacggaaggagcacggagtatcctggagcgattgcgccgtgctctatcgaacgaacatccagtcgcggctctttgaagaagcgctcgccgacgcggacattccgtatcacgtggtcggagacaagcatttctacgagtcgccggacgtgaaaatcatcctggactatctgcgaacgacgcaggacacgtccgatccgaccgtgtgggggcacctgctcaatcgtcccaagcgctacatcccgatcgacgtcgtgcacgaggttcagcacggcggatgggaggcggtggtcgcgcaccccaaatgtcgtgcctttgtgaccacaatcgacacgcttcgccgtatagaggaaccttccaaagcgatacaatggttggtagacaaccacccgggtctagtacgccaacaagatgaggacgaacccatcaagtgggtggattcgctcatcgcttcggcgtccagatacaagaccgtcgcgtcgtttttgcgtttcgtggattggatcatcgagaagtcgaaggagccgaaggacgaggctgtgcaactcatgaccatccacaaggccaagggcttggaatggaccaccgtgttcgtcgcaggcctcgcggaaggcctgttgccgcacaagaaggccttgaagggtgaggaactgcgcgaagagacgcgcttgtgttacgtcgcggccacacgagcacgcgacaatctgtatctcatggcggccaagtggtacggagacaaggagcgggaagtctcacgttacgtgaacgcggttaaaaatccgtga

SEQ ID NO: 1052 - DNA, 2121 bp, Artificial
  Alicyclobacillus acidocaldarius mutated SEQ ID NO 1039
atggatacgcagtgcatcgaagttcgctgtggcagtgctcgtcatcacctgtcgtatgaggacttgttcactcctgaagttcaatccttgttcgaagaatgctacgcacttggcgtcgaagtgcgctgtctctgcaaccccgaccgtccagtccccatgcatctgcgccgcgtccgcatccgccctccgacgtacactgtcgtcacgaatcctctgggcatccatcacccgaactgtccgcggtttcgccaatcacgtcatccaagcgcgtctcacaaaacgcgtgacgcacaagccgtcgaaactacgccaaatcacatcgaagaatggcttccgcataggaggatctttgtgcccaccttagatcagctgaacgacgcacaacgagaagctgcaacgcacaaaaacggtccttgcatggtcgtcgccgcggccggttcaggaaagaccgccatgctcatcgcgcgcatccagcatctcatcaaccagggcgtaagacctggggacatcctcgcgtgcacgttcacgcgcaaggccgcgcaggagatgaccgaccgcctgcttgccgccgtgggcgaacggggaaaggccgtgaccatcgggacgattcattcggtcgcatatcgcatggtcacgccagaactcggggaggactggcgtgtgctgtcggaccccacgtggatgatcgagcgtgtgctggaggagccaagtggcaagaatccgcacggcgtcgggcccgtgatgaagctaggcgaggccatctccgccatcgccaaggccaaagcggacgcgcttgggccgcaccaggtgtctgaccctttgaccaaggtctacgcggcatatgagacgctgaaggctgagcgtaagaccctggacttcgaggacatgatcctccacgcgattcgcctgttccgcacggacgaagcgttcgcgaagcggtggcgtcagcgttggcgatacgtcatggtggacgagtttcaggacacgaacacggcgcagtggctgttcttgttggaactcgtcaaggcgcacaacaacctatttgtcgtaggggatgattggcagtccatttactacttccgcggggcacgcccggacctcatgaaagagttcctacgtcggtttccggacgcaaaaagggtcacgctggagaccaattatcgctcacacgaccttatcgtcgacgtagggcggcgcatcatccggttgaacgacgggcatcagctccctaaacgcgtggtcgcgcaccgctcaatgccggaaggcgcgatcgcacaaatcgtgacggtgcgctctgacctcgaggaagcgcgcttcgtcgcgcaggaactccagcgtctacggaaggagcacggagtatcctggagcgattgcgccgtgctctatcgaacgaacatccagtcgcggctctttgaagaagcgctcgccgacgcggacattccgtatcacgtggtcggagacaagcatttctacgagtcgccggacgtgaaaatcatcctggactatctgcgaacgacgcaggacacgtccgatccgaccgtgtgggggcacctgctcaataaacccaagcgctacatcccgatcgacgtcgtgcacgaggttcagcacggcggatgggaggcggtggtcgcgcaccccaaatgtcgtgcctttgtgaccacaatcgacacgcttcgccgtatagaggaaccttccaaagcgatacaatggttggtagacaaccacccgggtctagtacgccaacaagatgaggacgaacccatcaagtgggtggattcgctcatcgcttcggcgtccagatacaagaccgtcgcgtcgtttttgcgtttcgtggattggatcatcgagaagtcgaaggagccgaaggacgaggctgtgcaactcatgaccatccacaaggccaagggcttggaatggaccaccgtgttcgtcgcaggcctcgcggaaggcctgttgccgcacaagaaggccttgaagggtgaggaactgcgcgaagagacgcgcttgtgttacgtcgcggccacacgagcacgcgacaatctgtatctcatggcggccaagtggtacggagacaaggagcgggaagtctcacgttacgtgaacgcggttaaaaatccgtga

SEQ ID NO: 1053 - DNA, 2121 bp, Artificial
  Alicyclobacillus acidocaldarius mutated SEQ ID NO 1039
atggatacgcagtgcatcgaagttcgctgtggcagtgctcgtcatcacctgtcgtatgaggacttgttcactcctgatgttcaatccttgttcgaagaatgctacgcacttggcgtcgaagtgcgctgtctctgcaaccccgaccgtccagtccccatgcatctgcgccgcgtccgcatccgccctccgacgtacactgtcgtcacgaatcctctgggcatccatcacccgaactgtccgcggtttcgccaatcacgtcatccaagcgcgtctcacaaaacgcgtgacgcacaagccgtcgaaactacgccaaatcacatcgaagaatggcttccgcataggaggatctttgtgcccaccttagatcagctgaacgacgcacaacgagaagctgcaacgcacaaaaacggtccttgcatggtcgtcgccgcggccggttcaggaaagaccgccatgctcatcgcgcgcatccagcatctcatcaaccagggcgtaagacctggggacatcctcgcgtgcacgttcacgcgcaaggccgcgcaggagatgaccgaccgcctgcttgccgccgtgggcgaacggggaaaggccgtgaccatcgggacgattcattcggtcgcatatcgcatggtcacgccagaactcggggaggactggcgtgtgctgtcggaccccacgtggatgatcgagcgtgtgctggaggagccaagtggcaagaatccgcacggcgtcgggcccgtgatgaagctaggcgaggccatctccgccatcgccaaggccaaagcggacgcgcttgggccgcaccaggtgtctgaccctttgaccaaggtctacgcggcatatgagacgctgaaggctgagcgtaagaccctggacttcgaggacatgatcctccacgcgattcgcctgttccgcacggacgaagcgttcgcgaagcggtggcgtcagcgttggcgatacgtcatggtggacgagtttcaggacacgaacacggcgcagtggctgttcttgttggaactcgtcaaggcgcacaacaacctatttgtcgtaggggatgattggcagtccatttactacttccgcggggcacgcccggacctcatgaaagagttcctacgtcggtttccggacgcaaaaagggtcacgctggagaccaattatcgctcacacgaccttatcgtcgacgtagggcggcgcatcatccggttgaacgacgggcatcagctccctaaacgcgtggtcgcgcaccgctcaatgccggaaggcgcgatcgcacaaatcgtgacggtgcgctctgacctcgaggaagcgcgcttcgtcgcgcaggaactccagcgtctacggaaggagcacggagtatcctggagcgattgcgccgtgctctatcgaacgaacatccagtcgcggctctttgaagaagcgctcgccgacgcggacattccgtatcacgtggtcggagacaagcatttctacgagtcgccggacgtgaaaatcatcctggactatctgcgaacgacgcaggacacgtccgatccgaccgtgtgggggcacctgctcaatcgtcccaagcgctacatcccgatcgacgtcgtgcacgaggttcagcacggcggatgggaggcggtggtcgcgcaccccaaatgtcgtgcctttgtgaccacaatcgacacgcttcgccgtatagaggaaccttccaaagcgatacaatggttggtagacaaccacccgggtctagtacgccaacaagatgaggacgaacccatcaagtgggtggattcgctcatcgcttcggcgtccagatacaagaccgtcgcgtcgtttttgcgtttcgtggattggatcatcgagaagtcgaaggagccgaaggacgaggctgtgcaactcatgaccatccacaaggccaagggcttggaatggaccaccgtgttcgtcgcaggcctcgcggaaggcctgttgccgcacaagaaggccttgaagggtgaggaactgcgcgaagagacgcgcttgtgttacgtcgcggccacacgagcacgcgacaatctgtatctcatggcggccaagtggtacggagacaaggagcgggaagtctcacgttacgtgaacgcggttaaaaatccgtga

SEQ ID NO: 1054 - DNA, 2121 bp, Artificial
  Alicyclobacillus acidocaldarius mutated SEQ ID NO 1039
atggatacgcagtgcatcgaagttcgctgtggcagtgctcgtcatcacctgtcgtatgaggacttgttcactcctgaagttcaatccttgttcgaagaatgctacgcacttggcgtcgaagtgcgctgtctctgcaaccccgaccgtccagtccccatgcatctgcgccgcgtccgcatccgccctccgacgtacactgtcgtcacgaatcctctgggcatccatcacccgaactgtccgcggtttaaacaatcacgtcatccaagcgcgtctcacaaaacgcgtgacgcacaagccgtcgaaactacgccaaatcacatcgaagaatggcttccgcataggaggatctttgtgcccaccttagatcagctgaacgacgcacaacgagaagctgcaacgcacaaaaacggtccttgcatggtcgtcgccgcggccggttcaggaaagaccgccatgctcatcgcgcgcatccagcatctcatcaaccagggcgtaagacctggggacatcctcgcgtgcacgttcacgcgcaaggccgcgcaggagatgaccgaccgcctgcttgccgccgtgggcgaacggggaaaggccgtgaccatcgggacgattcattcggtcgcatatcgcatggtcacgccagaactcggggaggactggcgtgtgctgtcggaccccacgtggatgatcgagcgtgtgctggaggagccaagtggcaagaatccgcacggcgtcgggcccgtgatgaagctaggcgaggccatctccgccatcgccaaggccaaagcggacgcgcttgggccgcaccaggtgtctgaccctttgaccaaggtctacgcggcatatgagacgctgaaggctgagcgtaagaccctggacttcgaggacatgatcctccacgcgattcgcctgttccgcacggacgaagcgttcgcgaagcggtggcgtcagcgttggcgatacgtcatggtggacgagtttcaggacacgaacacggcgcagtggctgttcttgttggaactcgtcaaggcgcacaacaacctatttgtcgtaggggatgattggcagtccatttactacttccgcggggcacgcccggacctcatgaaagagttcctacgtcggtttccggacgcaaaaagggtcacgctggagaccaattatcgctcacacgaccttatcgtcgacgtagggcggcgcatcatccggttgaacgacgggcatcagctccctaaacgcgtggtcgcgcaccgctcaatgccggaaggcgcgatcgcacaaatcgtgacggtgcgctctgacctcgaggaagcgcgcttcgtcgcgcaggaactccagcgtctacggaaggagcacggagtatcctggagcgattgcgccgtgctctatcgaacgaacatccagtcgcggctctttgaagaagcgctcgccgacgcggacattccgtatcacgtggtcggagacaagcatttctacgagtcgccggacgtgaaaatcatcctggactatctgcgaacgacgcaggacacgtccgatccgaccgtgtgggggcacctgctcaatcgtcccaagcgctacatcccgatcgacgtcgtgcacgaggttcagcacggcggatgggaggcggtggtcgcgcaccccaaatgtcgtgcctttgtgaccacaatcgacacgcttcgccgtatagaggaaccttccaaagcgatacaatggttggtagacaaccacccgggtctagtacgccaacaagatgaggacgaacccatcaagtgggtggattcgctcatcgcttcggcgtccagatacaagaccgtcgcgtcgtttttgcgtttcgtggattggatcatcgagaagtcgaaggagccgaaggacgaggctgtgcaactcatgaccatccacaaggccaagggcttggaatggaccaccgtgttcgtcgcaggcctcgcggaaggcctgttgccgcacaagaaggccttgaagggtgaggaactgcgcgaagagacgcgcttgtgttacgtcgcggccacacgagcacgcgacaatctgtatctcatggcggccaagtggtacggagacaaggagcgggaagtctcacgttacgtgaacgcggttaaaaatccgtga

SEQ ID NO: 1055 - protein, 105 aa, Alicyclobacillus acidocaldarius
MFPVPYILLIRTYVRIRGVRMNRPTALLRQLLILELIQAHIVRERARVKAQMRAEGLHIVERQDGDMDIRVEFRVGDHYDEAVFMRKMLEAEAANRAKRTGMISR

SEQ ID NO: 1056 - DNA, 318 bp, Alicyclobacillus acidocaldarius
ttgttccccgtgccgtatatacttcttataagaacatatgttcgtatcaggggtgtccgtatgaaccggcctaccgccttactccgacaacttctcatcctcgaactcatccaagcgcacatcgtacgcgaacgtgcgcgcgtcaaggcacagatgcgtgcggaagggttacacatcgttgagcgtcaggacggagacatggacatccgcgtcgagtttcgtgtcggcgatcactacgacgaagcggtcttcatgcgtaagatgctggaggccgaagccgcgaatcgtgccaagcggacggggatgatttcgcgatga

SEQ ID NO: 1057 - protein, 80 aa, Azoarcus  EbN1
VQILDVRLKRVDLPLEVSESVYRRMEAERKRVANELRSEGGAIAEKIRADADRQREVIIAEAYRDAQQAKGAGDAKATGI

SEQ ID NO: 1058 - protein, 93 aa, Burkholderia pseudomallei
RRHARRRGGGDDRRIAVVEQRLHARQIVVVHVDRAHLMRIRAELAAEPRREVLLQEREREHVVQQPDVRVVRAHERDHVQPAFAQQQLQAERA

SEQ ID NO: 1059 - protein, 93 aa, Burkholderia pseudomallei; identical to SEQ ID NO: 1058

SEQ ID NO: 1060 - protein, 93 aa, Burkholderia pseudomallei; identical to SEQ ID NO: 1058

SEQ ID NO: 1061 - protein, 93 aa, Burkholderia pseudomallei; identical to SEQ ID NO: 1058

SEQ ID NO: 1062 - protein, 105 aa, Artificial
  Alicyclobacillus acidocaldarius mutated SEQ ID NO 1055
MFPVPYILLIRTYVRIRGVRMNRPTALLRQLLILEIIQAHIVRERARVKAQMRAEGLHIVERQDGDMDIRVEFRVGDHYDEAVFMRKMLEAEAANRAKRTGMISR

SEQ ID NO: 1063 - protein, 105 aa, Artificial
  Alicyclobacillus acidocaldarius mutated SEQ ID NO 1055
MFPIPYILLIRTYVRIRGVRMNRPTALLRQLLILELIQAHIVRERARVKAQMRAEGLHIVERQDGDMDIRVEFRVGDHYDEAVFMRKMLEAEAANRAKRTGMISR

SEQ ID NO: 1064 - protein, 105 aa, Artificial
  Alicyclobacillus acidocaldarius mutated SEQ ID NO 1055
MFPVPYILLIRTYVRIRGVRMNRPTALLRQLLILELIQAHIVRERARVKAQMRAEGLHIVERQEGDMDIRVEFRVGDHYDEAVFMRKMLEAEAANRAKRTGMISR

SEQ ID NO: 1065 - protein, 105 aa, Artificial
  Alicyclobacillus acidocaldarius mutated SEQ ID NO 1055
MFPVPYILLIRTYVRIRGVRMNRPTALLRQLLILELIQAHIVRERARVKAQMRAEGLHIVERQDGDMDIRVEFRVGDHYDEAVFMRKMLEAEAANRAKRTGMLSR

SEQ ID NO: 1066 - protein, 105 aa, Artificial
  Alicyclobacillus acidocaldarius mutated SEQ ID NO 1055
MFPVPYILLIRTYVRIRGVRMNRPTAILRQLLILELIQAHIVRERARVKAQMRAEGLHIVERQDGDMDIRVEFRVGDHYDEAVFMRKMLEAEAANRAKRTGMISR

SEQ ID NO: 1067 - DNA, 318 bp, Artificial
  Alicyclobacillus acidocaldarius mutated SEQ ID NO 1056
ttgttccccgtgccgtatatacttcttataagaacatatgttcgtatcaggggtgtccgtatgaaccggcctaccgccttactccgacaacttctcatcctcgaaattatccaagcgcacatcgtacgcgaacgtgcgcgcgtcaaggcacagatgcgtgcggaagggttacacatcgttgagcgtcaggacggagacatggacatccgcgtcgagtttcgtgtcggcgatcactacgacgaagcggtcttcatgcgtaagatgctggaggccgaagccgcgaatcgtgccaagcggacggggatgatttcgcgatga

SEQ ID NO: 1068 - DNA, 318 bp, Artificial
  Alicyclobacillus acidocaldarius mutated SEQ ID NO 1056
ttgttccccattccgtatatacttcttataagaacatatgttcgtatcaggggtgtccgtatgaaccggcctaccgccttactccgacaacttctcatcctcgaactcatccaagcgcacatcgtacgcgaacgtgcgcgcgtcaaggcacagatgcgtgcggaagggttacacatcgttgagcgtcaggacggagacatggacatccgcgtcgagtttcgtgtcggcgatcactacgacgaagcggtcttcatgcgtaagatgctggaggccgaagccgcgaatcgtgccaagcggacggggatgatttcgcgatga

SEQ ID NO: 1069 - DNA, 318 bp, Artificial
  Alicyclobacillus acidocaldarius mutated SEQ ID NO 1056
ttgttccccgtgccgtatatacttcttataagaacatatgttcgtatcaggggtgtccgtatgaaccggcctaccgccttactccgacaacttctcatcctcgaactcatccaagcgcacatcgtacgcgaacgtgcgcgcgtcaaggcacagatgcgtgcggaagggttacacatcgttgagcgtcaggaaggagacatggacatccgcgtcgagtttcgtgtcggcgatcactacgacgaagcggtcttcatgcgtaagatgctggaggccgaagccgcgaatcgtgccaagcggacggggatgatttcgcgatga

SEQ ID NO: 1070 - DNA, 318 bp, Artificial
  Alicyclobacillus acidocaldarius mutated SEQ ID NO 1056
ttgttccccgtgccgtatatacttcttataagaacatatgttcgtatcaggggtgtccgtatgaaccggcctaccgccttactccgacaacttctcatcctcgaactcatccaagcgcacatcgtacgcgaacgtgcgcgcgtcaaggcacagatgcgtgcggaagggttacacatcgttgagcgtcaggacggagacatggacatccgcgtcgagtttcgtgtcggcgatcactacgacgaagcggtcttcatgcgtaagatgctggaggccgaagccgcgaatcgtgccaagcggacggggatgttatcgcgatga

SEQ ID NO: 1071 - DNA, 318 bp, Artificial
  Alicyclobacillus acidocaldarius mutated SEQ ID NO 1056
ttgttccccgtgccgtatatacttcttataagaacatatgttcgtatcaggggtgtccgtatgaaccggcctaccgccattctccgacaacttctcatcctcgaactcatccaagcgcacatcgtacgcgaacgtgcgcgcgtcaaggcacagatgcgtgcggaagggttacacatcgttgagcgtcaggacggagacatggacatccgcgtcgagtttcgtgtcggcgatcactacgacgaagcggtcttcatgcgtaagatgctggaggccgaagccgcgaatcgtgccaagcggacggggatgatttcgcgatga

SEQ ID NO: 1072 - protein, 418 aa, Alicyclobacillus acidocaldarius
MTKLIYGLVDMQSFYASCEVASREEYAARRKEFDDSTDPPLVVSGDPARRSGIILAATPTAKRYGVENAMRLGEALRLYPRLIVVRPHMAFYLHVSVRIQMLMQQCFPFQEQFSVDEGFIAFPYPSNLFPDPIAAARNLQARIWDQFRIRARIGLAPNKWLAKMANKAAKKTPGGIVWWREEDIPSVLHPLPVEEMWGLKRRAEVLRRKFKCETIGDVARLPVGVLKAEFGVWGEVIHRWANGIDVSDINPDSYHAPHKGFSHRTTLPRDFYERSEIAVVILELLDEVCHRLRQAHQAGRRVGLGLTYEGLTGGFYRARTLPRATNDPAELYPVLLALLDEHWDGSGVRAVSVAVDMLQFRETLQLSLFENVPARTRLYETVDEIRARFGETSIMRAVSLTRAGQLRERSLRIGGHYA

SEQ ID NO: 1073 - DNA, 1257 bp, Alicyclobacillus acidocaldarius
atgaccaagctcatctacggcctggtggatatgcaaagcttctacgcctcgtgcgaggtggcgagccgcgaggagtatgcggcccggcgcaaggagttcgatgattccaccgacccgccgcttgtcgtatctggtgacccggcccgacgttcgggcattatcctcgccgcaacaccgacggcgaagcgatacggcgtcgagaatgcgatgcgcttgggagaagcgctccggctgtatccgcgtctcattgtcgtgcggccgcacatggccttctatttgcacgtgtcggttcggatccagatgctcatgcagcagtgcttcccgttccaggaacagttctcggtcgacgagggcttcatcgccttcccgtacccatcaaacttgttccccgacccgatcgcggcggcacgcaatctccaagcgcgcatctgggaccagtttcgcatccgcgcgcgcattgggcttgcgccgaataagtggcttgcgaaaatggcgaacaaagccgctaagaaaacgcccggcgggattgtgtggtggcgagaagaggacattccgtctgtgctccatccattgcccgttgaggagatgtggggcttgaagcggcgggcggaagtccttcgacgcaagttcaagtgcgagacgattggcgacgttgcacgcttgcctgtcggtgtgctcaaggccgagttcggcgtatggggcgaagtcatccatcgctgggcgaacgggatcgacgtgagcgacatcaatccggacagttatcacgcgccgcacaagggattctcccatcgcacgacgttgccgcgagacttctacgagcgcagtgaaatcgcggtcgtcatcctggaattgctggacgaagtgtgtcaccgactgcgccaagcccatcaggccggacgtcgtgtcggtctcgggctcacctacgagggattgacgggcgggttctaccgagcgaggacgttgccgcgcgccacaaacgacccagccgagctctacccggtgctcctggcgcttctggatgagcactgggacggttctggcgtgcgggccgtgtcggtggccgtcgacatgctgcaatttcgtgagaccttgcaattgtcgctgttcgagaacgtgccggcgcggacacgactgtacgagacggtggacgagattcgcgcacgctttggcgagacgtccatcatgcgcgccgtgagcctgacgcgcgcgggacagctgcgtgaacggagtctgcgaatcggaggtcactacgcatga

SEQ ID NO: 1074 - protein, 400 aa, Heliobacterium modesticaldum
LADMNSFYASVEMAHNPTLRGQPVLVCGDPERRHGIILAASREAKRRGVKTAMTVGEARAICPDAVCVRPRMSLYLEVSWQIQQIARTLSPLVEPYSVDELFIDVRGAEHIWGDAVEAAGIFRQRVWEAVKVPCSVGVGPNKFLSKMACDVEAKKSPSGVALWRVDDVEAKLHPLPIGKMFMVGSRMERHFRNMGLLTIGDLAHYPVDYLMRRFGLRGAVYHNLAWGRDGSPVRPDSLEQTKSVGHSVTLPRDYHHSDDIELVLLELTDEVCRRARKLGKAGRTVSVGLRAYDLTRGFYRQTTLPSPSNLSGPVFEKAQLLFRRHWDGRPVRTVTVDLSGLEEDGTLQQELFRDMDRQDRVSRTMDRIRDAMGTTAIVRASSLLPAGQARDRAVKIGGHY

SEQ ID NO: 1075 - protein, 405 aa, Bacillus clausii
LVDMESFYASIEHAANPQYDGRPLVVSGDVNRRSGVILAACPLAKAKGVRNAERLFEAQQKCPDLVVVKPHMQRYVDISLQISKILGTFTDLVEPYSIDEQFMDVTGSQKLFGPPYEIAEKVKQAIMDRFGVKARVGIGENKVLAKLACDNFAKKSSEGIYWLRKDSLDLDLWCLPIEKLFGVGRKMSVHLRNMGIRTIGQLAQTDGARIKKRFGVHGQVLWMSANGEDYSPVTRAAHARRKGYGNGMTLPRDYVKKEDICVVLLELCEEVCARLRQDGWMGSTVSLSVNGADFVEKRGFHRQYTIPFETNITMEVYEAACALLERFWDGYPIRRLSIGVSNLQSDQNWQLSLFDDNASRDRLSTIGYVMDGIRQKYGKLAIQRASSLQKASQLRDRSQKIGGHY

SEQ ID NO: 1076 - protein, 407 aa, Paenibacillus larvae
KRVIFLADCQSFYASVEKAHHPEYRNRPLVVAGDPARRSGIVLAACPLAKKYGITTAERLGEAINKCPDLVVVRPRMQEYIKVSLQITEILQSYTDLVEPLSVDEQHLDVTASIKLLGSPQEIAKSIQSRVWNETGVYTRIGISENKVLAKMACDNFAKKNGDGIFYLPKTEMEQKLWPLPVNKMYHIGSRMTRHLKRMGIHTIGDLACASVLRLQKRWGINGEVIWRIANGLDDSPVTPDTYIGQKGVGHQMTLPRDYMTINELLVPLLELSELVCQRCRAKGYMGQVVSVGCQGTDFDYPTGFHRQMKLEDPTNLSDEVNRAVVLLFKRHWNGLPVRKISVSLTGLVRDDTFQLVLFEDRMKKLALEKALDGIKDRFGNASIMRAVSLTAAGQAKDRSMKIGGHY

SEQ ID NO: 1077 - protein, 408 aa, Bacillus halodurans
MDKVIFMVDMESFFASVERANHPELSGRPLLVSGDPERRSGVILAACPVAKARGVTNGERLWEAQQKCPEAVVVRPHMQQYVTVSVQITEILERFTDLIEPFSIDEQFMDVTHSQRLFGAPREIAQKVQQAIWHETGVRARIGMGESKVLAKMACDNFAKKMPSGVFHLTKERMERLLWPLPIECLYGVGRQMTKYFRNQGIRTIGQLANTSLERIKGKWGVNGHVLWLTAHGIDPSPVTPHSHDKQKGIGHGMTLPHDYVKAEDIHVVLLELCEEVCKRARRAHLMGRTVAIGVSGANMETPTGFHRQMKLTNHTNITMEVYEGAATLFERFWDGKPIRRLHVNLSNLTSDEAWQLSFFGNRDRAHQLGYTMDTIKEKFGDTAIRRAVSFLSASQAEERAKKIGGHY

SEQ ID NO: 1078 - protein, 402 aa, Bacillus amyloliquefaciens
LVDMQSFYASVEKAEAPHLKSRPVIVSGDPERRSGVVLAACPLAKRYGVKNAERLWEAQAKCPDAVIVRPRMQRYIDVSVMITELFERYTDLVEPYSIDEQFLDVTGSRRLFGDPFTIAKSIQQAIMREFGIYARVGIGPNKALSKMACDHFAKKNASGIHRLDMSNIRQDLWPLPVGKLFGIGKRMEHHLRRMGISTIGGLAGHPAELLKKRWGINGELLQRTARGIDPSPVTVNTHSRQKAIGHNMTLPRDYSRFEDIKVVLLELSEEVARRARFKQYIGHTVSVSIRGADFEFPSDFHRQRKLVSPTNFGMDIFKTAVKLFKEHWNGEPVRSAGVSLSQLEPCDYVQLSLFDAQEKKISLGKVLDDIHERYGPASLLHAASLTEAGQAFHRAEKIGGHY

SEQ ID NO: 1079 - protein, 418 aa, Artificial
  Alicyclobacillus acidocaldarius mutated SEQ ID NO 1072
MTKLIYGLVDMQSFYASCEVASREEYAARRKEFDDSTDPPLVVSGDPARRSGIILAATPTAKRYGVENAMRLGEALRLYPRLIVVRPHMAFYLHVSVRIQMLMQQCFPFQEQFSVDEGFIAFPYPSNLFPDPIAAARNLQARIWDQFRIRARIGLAPNKWLAKMANKAAKKTPGGIVWWREEDIPSVLHPLPVEEMWGLKRRAEVLKRKFKCETIGDVARLPVGVLKAEFGVWGEVIHRWANGIDVSDINPDSYHAPHKGFSHRTTLPRDFYERSEIAVVILELLDEVCHRLRQAHQAGRRVGLGLTYEGLTGGFYRARTLPRATNDPAELYPVLLALLDEHWDGSGVRAVSVAVDMLQFRETLQLSLFENVPARTRLYETVDEIRARFGETSIMRAVSLTRAGQLRERSLRIGGHYA

SEQ ID NO: 1080 - protein, 418 aa, Artificial
  Alicyclobacillus acidocaldarius mutated SEQ ID NO 1072
MTKLIYGLVDMQSFYASCEVASREEYAARRKEFDDSTDPPLVVSGDPARRSGIILAATPTAKRYGVENAMRLGEALRLYPRLIVVRPHMAFYLHVSVRIQMLMQQCFPFQEQFSVDEGFIAFPYPSNLFPDPIAAARNLQAKIWDQFRIRARIGLAPNKWLAKMANKAAKKTPGGIVWWREEDIPSVLHPLPVEEMWGLKRRAEVLRRKFKCETIGDVARLPVGVLKAEFGVWGEVIHRWANGIDVSDINPDSYHAPHKGFSHRTTLPRDFYERSEIAVVILELLDEVCHRLRQAHQAGRRVGLGLTYEGLTGGFYRARTLPRATNDPAELYPVLLALLDEHWDGSGVRAVSVAVDMLQFRETLQLSLFENVPARTRLYETVDEIRARFGETSIMRAVSLTRAGQLRERSLRIGGHYA

SEQ ID NO: 1081 - protein, 418 aa, Artificial
  Alicyclobacillus acidocaldarius mutated SEQ ID NO 1072
MTKLIYGLVDMQSFYASCEVASREEYAARRKEFDDSTDPPLVVSGDPARRSGIILAATPTAKRYGVENAMRLGEALRLYPRLIVVRPHMAFYLHVSVKIQMLMQQCFPFQEQFSVDEGFIAFPYPSNLFPDPIAAARNLQARIWDQFRIRARIGLAPNKWLAKMANKAAKKTPGGIVWWREEDIPSVLHPLPVEEMWGLKRRAEVLRRKFKCETIGDVARLPVGVLKAEFGVWGEVIHRWANGIDVSDINPDSYHAPHKGFSHRTTLPRDFYERSEIAVVILELLDEVCHRLRQAHQAGRRVGLGLTYEGLTGGFYRARTLPRATNDPAELYPVLLALLDEHWDGSGVRAVSVAVDMLQFRETLQLSLFENVPARTRLYETVDEIRARFGETSIMRAVSLTRAGQLRERSLRIGGHYA

SEQ ID NO: 1082 - protein, 418 aa, Artificial
  Alicyclobacillus acidocaldarius mutated SEQ ID NO 1072
MTKLIYGLVDMQSFYASCEVASREEYAARRKEFDDSTDPPLVVSGDPARRSGIILAATPTAKRYGVENAMRLGEALRLYPRLIVVRPHMAFYLHVSVRIQMLMQQCFPFQEQFSVDEGFIAFPYPSNLFPDPIAAARNLQARIWDQFRIRARIGLAPNKWLAKMANKAAKKTPGGIVWWREEEIPSVLHPLPVEEMWGLKRRAEVLRRKFKCETIGDVARLPVGVLKAEFGVWGEVIHRWANGIDVSDINPDSYHAPHKGFSHRTTLPRDFYERSEIAVVILELLDEVCHRLRQAHQAGRRVGLGLTYEGLTGGFYRARTLPRATNDPAELYPVLLALLDEHWDGSGVRAVSVAVDMLQFRETLQLSLFENVPARTRLYETVDEIRARFGETSIMRAVSLTRAGQLRERSLRIGGHYA

SEQ ID NO: 1083 - protein, 418 aa, Artificial
  Alicyclobacillus acidocaldarius mutated SEQ ID NO 1072
MTKLIYGLVDMQSFYASCEVASREEYAARRKEFDDSTDPPLVVSGDPARRSGIILAATPTAKRYGVENAMRLGEALRLYPRLIVVRPHMAFYLHVSVRIQMLMQQCFPFQEQFSVDEGFIAFPYPSNLFPDPIAAARNLQARIWDQFRIRARIGLAPNKWLAKMANKAAKKTPGGIVWWREEDIPSILHPLPVEEMWGLKRRAEVLRRKFKCETIGDVARLPVGVLKAEFGVWGEVIHRWANGIDVSDINPDSYHAPHKGFSHRTTLPRDFYERSEIAVVILELLDEVCHRLRQAHQAGRRVGLGLTYEGLTGGFYRARTLPRATNDPAELYPVLLALLDEHWDGSGVRAVSVAVDMLQFRETLQLSLFENVPARTRLYETVDEIRARFGETSIMRAVSLTRAGQLRERSLRIGGHYA

SEQ ID NO: 1084 - DNA, 1257 bp, Artificial
  Alicyclobacillus acidocaldarius mutated SEQ ID NO 1073
atgaccaagctcatctacggcctggtggatatgcaaagcttctacgcctcgtgcgaggtggcgagccgcgaggagtatgcggcccggcgcaaggagttcgatgattccaccgacccgccgcttgtcgtatctggtgacccggcccgacgttcgggcattatcctcgccgcaacaccgacggcgaagcgatacggcgtcgagaatgcgatgcgcttgggagaagcgctccggctgtatccgcgtctcattgtcgtgcggccgcacatggccttctatttgcacgtgtcggttcggatccagatgctcatgcagcagtgcttcccgttccaggaacagttctcggtcgacgagggcttcatcgccttcccgtacccatcaaacttgttccccgacccgatcgcggcggcacgcaatctccaagcgcgcatctgggaccagtttcgcatccgcgcgcgcattgggcttgcgccgaataagtggcttgcgaaaatggcgaacaaagccgctaagaaaacgcccggcgggattgtgtggtggcgagaagaggacattccgtctgtgctccatccattgcccgttgaggagatgtggggcttgaagcggcgggcggaagtccttaaacgcaagttcaagtgcgagacgattggcgacgttgcacgcttgcctgtcggtgtgctcaaggccgagttcggcgtatggggcgaagtcatccatcgctgggcgaacgggatcgacgtgagcgacatcaatccggacagttatcacgcgccgcacaagggattctcccatcgcacgacgttgccgcgagacttctacgagcgcagtgaaatcgcggtcgtcatcctggaattgctggacgaagtgtgtcaccgactgcgccaagcccatcaggccggacgtcgtgtcggtctcgggctcacctacgagggattgacgggcgggttctaccgagcgaggacgttgccgcgcgccacaaacgacccagccgagctctacccggtgctcctggcgcttctggatgagcactgggacggttctggcgtgcgggccgtgtcggtggccgtcgacatgctgcaatttcgtgagaccttgcaattgtcgctgttcgagaacgtgccggcgcggacacgactgtacgagacggtggacgagattcgcgcacgctttggcgagacgtccatcatgcgcgccgtgagcctgacgcgcgcgggacagctgcgtgaacggagtctgcgaatcggaggtcactacgcatga

SEQ ID NO: 1085 - DNA, 1257 bp, Artificial
  Alicyclobacillus acidocaldarius mutated SEQ ID NO 1073
atgaccaagctcatctacggcctggtggatatgcaaagcttctacgcctcgtgcgaggtggcgagccgcgaggagtatgcggcccggcgcaaggagttcgatgattccaccgacccgccgcttgtcgtatctggtgacccggcccgacgttcgggcattatcctcgccgcaacaccgacggcgaagcgatacggcgtcgagaatgcgatgcgcttgggagaagcgctccggctgtatccgcgtctcattgtcgtgcggccgcacatggccttctatttgcacgtgtcggttcggatccagatgctcatgcagcagtgcttcccgttccaggaacagttctcggtcgacgagggcttcatcgccttcccgtacccatcaaacttgttccccgacccgatcgcggcggcacgcaatctccaagcgaaaatctgggaccagtttcgcatccgcgcgcgcattgggcttgcgccgaataagtggcttgcgaaaatggcgaacaaagccgctaagaaaacgcccggcgggattgtgtggtggcgagaagaggacattccgtctgtgctccatccattgcccgttgaggagatgtggggcttgaagcggcgggcggaagtccttcgacgcaagttcaagtgcgagacgattggcgacgttgcacgcttgcctgtcggtgtgctcaaggccgagttcggcgtatggggcgaagtcatccatcgctgggcgaacgggatcgacgtgagcgacatcaatccggacagttatcacgcgccgcacaagggattctcccatcgcacgacgttgccgcgagacttctacgagcgcagtgaaatcgcggtcgtcatcctggaattgctggacgaagtgtgtcaccgactgcgccaagcccatcaggccggacgtcgtgtcggtctcgggctcacctacgagggattgacgggcgggttctaccgagcgaggacgttgccgcgcgccacaaacgacccagccgagctctacccggtgctcctggcgcttctggatgagcactgggacggttctggcgtgcgggccgtgtcggtggccgtcgacatgctgcaatttcgtgagaccttgcaattgtcgctgttcgagaacgtgccggcgcggacacgactgtacgagacggtggacgagattcgcgcacgctttggcgagacgtccatcatgcgcgccgtgagcctgacgcgcgcgggacagctgcgtgaacggagtctgcgaatcggaggtcactacgcatga

SEQ ID NO: 1086 - DNA, 1257 bp, Artificial
  Alicyclobacillus acidocaldarius mutated SEQ ID NO 1073
atgaccaagctcatctacggcctggtggatatgcaaagcttctacgcctcgtgcgaggtggcgagccgcgaggagtatgcggcccggcgcaaggagttcgatgattccaccgacccgccgcttgtcgtatctggtgacccggcccgacgttcgggcattatcctcgccgcaacaccgacggcgaagcgatacggcgtcgagaatgcgatgcgcttgggagaagcgctccggctgtatccgcgtctcattgtcgtgcggccgcacatggccttctatttgcacgtgtcggttaaaatccagatgctcatgcagcagtgcttcccgttccaggaacagttctcggtcgacgagggcttcatcgccttcccgtacccatcaaacttgttccccgacccgatcgcggcggcacgcaatctccaagcgcgcatctgggaccagtttcgcatccgcgcgcgcattgggcttgcgccgaataagtggcttgcgaaaatggcgaacaaagccgctaagaaaacgcccggcgggattgtgtggtggcgagaagaggacattccgtctgtgctccatccattgcccgttgaggagatgtggggcttgaagcggcgggcggaagtccttcgacgcaagttcaagtgcgagacgattggcgacgttgcacgcttgcctgtcggtgtgctcaaggccgagttcggcgtatggggcgaagtcatccatcgctgggcgaacgggatcgacgtgagcgacatcaatccggacagttatcacgcgccgcacaagggattctcccatcgcacgacgttgccgcgagacttctacgagcgcagtgaaatcgcggtcgtcatcctggaattgctggacgaagtgtgtcaccgactgcgccaagcccatcaggccggacgtcgtgtcggtctcgggctcacctacgagggattgacgggcgggttctaccgagcgaggacgttgccgcgcgccacaaacgacccagccgagctctacccggtgctcctggcgcttctggatgagcactgggacggttctggcgtgcgggccgtgtcggtggccgtcgacatgctgcaatttcgtgagaccttgcaattgtcgctgttcgagaacgtgccggcgcggacacgactgtacgagacggtggacgagattcgcgcacgctttggcgagacgtccatcatgcgcgccgtgagcctgacgcgcgcgggacagctgcgtgaacggagtctgcgaatcggaggtcactacgcatga

SEQ ID NO: 1087 - DNA, 1257 bp, Artificial
  Alicyclobacillus acidocaldarius mutated SEQ ID NO 1073
atgaccaagctcatctacggcctggtggatatgcaaagcttctacgcctcgtgcgaggtggcgagccgcgaggagtatgcggcccggcgcaaggagttcgatgattccaccgacccgccgcttgtcgtatctggtgacccggcccgacgttcgggcattatcctcgccgcaacaccgacggcgaagcgatacggcgtcgagaatgcgatgcgcttgggagaagcgctccggctgtatccgcgtctcattgtcgtgcggccgcacatggccttctatttgcacgtgtcggttcggatccagatgctcatgcagcagtgcttcccgttccaggaacagttctcggtcgacgagggcttcatcgccttcccgtacccatcaaacttgttccccgacccgatcgcggcggcacgcaatctccaagcgcgcatctgggaccagtttcgcatccgcgcgcgcattgggcttgcgccgaataagtggcttgcgaaaatggcgaacaaagccgctaagaaaacgcccggcgggattgtgtggtggcgagaagaggaaattccgtctgtgctccatccattgcccgttgaggagatgtggggcttgaagcggcgggcggaagtccttcgacgcaagttcaagtgcgagacgattggcgacgttgcacgcttgcctgtcggtgtgctcaaggccgagttcggcgtatggggcgaagtcatccatcgctgggcgaacgggatcgacgtgagcgacatcaatccggacagttatcacgcgccgcacaagggattctcccatcgcacgacgttgccgcgagacttctacgagcgcagtgaaatcgcggtcgtcatcctggaattgctggacgaagtgtgtcaccgactgcgccaagcccatcaggccggacgtcgtgtcggtctcgggctcacctacgagggattgacgggcgggttctaccgagcgaggacgttgccgcgcgccacaaacgacccagccgagctctacccggtgctcctggcgcttctggatgagcactgggacggttctggcgtgcgggccgtgtcggtggccgtcgacatgctgcaatttcgtgagaccttgcaattgtcgctgttcgagaacgtgccggcgcggacacgactgtacgagacggtggacgagattcgcgcacgctttggcgagacgtccatcatgcgcgccgtgagcctgacgcgcgcgggacagctgcgtgaacggagtctgcgaatcggaggtcactacgcatga

SEQ ID NO: 1088 - DNA, 1257 bp, Artificial
  Alicyclobacillus acidocaldarius mutated SEQ ID NO 1073
atgaccaagctcatctacggcctggtggatatgcaaagcttctacgcctcgtgcgaggtggcgagccgcgaggagtatgcggcccggcgcaaggagttcgatgattccaccgacccgccgcttgtcgtatctggtgacccggcccgacgttcgggcattatcctcgccgcaacaccgacggcgaagcgatacggcgtcgagaatgcgatgcgcttgggagaagcgctccggctgtatccgcgtctcattgtcgtgcggccgcacatggccttctatttgcacgtgtcggttcggatccagatgctcatgcagcagtgcttcccgttccaggaacagttctcggtcgacgagggcttcatcgccttcccgtacccatcaaacttgttccccgacccgatcgcggcggcacgcaatctccaagcgcgcatctgggaccagtttcgcatccgcgcgcgcattgggcttgcgccgaataagtggcttgcgaaaatggcgaacaaagccgctaagaaaacgcccggcgggattgtgtggtggcgagaagaggacattccgtctattctccatccattgcccgttgaggagatgtggggcttgaagcggcgggcggaagtccttcgacgcaagttcaagtgcgagacgattggcgacgttgcacgcttgcctgtcggtgtgctcaaggccgagttcggcgtatggggcgaagtcatccatcgctgggcgaacgggatcgacgtgagcgacatcaatccggacagttatcacgcgccgcacaagggattctcccatcgcacgacgttgccgcgagacttctacgagcgcagtgaaatcgcggtcgtcatcctggaattgctggacgaagtgtgtcaccgactgcgccaagcccatcaggccggacgtcgtgtcggtctcgggctcacctacgagggattgacgggcgggttctaccgagcgaggacgttgccgcgcgccacaaacgacccagccgagctctacccggtgctcctggcgcttctggatgagcactgggacggttctggcgtgcgggccgtgtcggtggccgtcgacatgctgcaatttcgtgagaccttgcaattgtcgctgttcgagaacgtgccggcgcggacacgactgtacgagacggtggacgagattcgcgcacgctttggcgagacgtccatcatgcgcgccgtgagcctgacgcgcgcgggacagctgcgtgaacggagtctgcgaatcggaggtcactacgcatga

SEQ ID NO: 1089 - protein, 108 aa, Alicyclobacillus acidocaldarius
MNIRDGNIFEAMRLVLPEHRALMAQIQRERMKRKRPMLTEERLEEMQYVLSEAIREGRIVRVTMFTPERDVVLVGRVSARGRELRVRTAAGVHIVDVRDVVGVEMERS

SEQ ID NO: 1090 - DNA, 327 bp, Alicyclobacillus acidocaldarius
atgaacatccgggacgggaacatcttcgaggccatgcggcttgtgttgccagagcatcgagcgctcatggcgcaaatccagcgtgaacggatgaaacggaagcgaccgatgctcaccgaggagcgcttggaggagatgcagtatgtgctcagcgaggcgattcgcgaggggcgcatcgtgcgcgtgacgatgtttacgccggaacgggatgtggtgctggtgggccgcgtgtcggcgcgcggtagggaattgcgcgtgaggacggcggcaggcgtgcatatcgtggatgtgcgggatgtggtcggagtggagatggagagaagttaa

SEQ ID NO: 1091 - protein, 108 aa, Bacillus licheniformis
LRDRGSIKWVSMMLPEHVELLREYHESFQKIKKPILDEQKYEEFNEIICEAMAENRFLQFAYYRQGEVKTLAGRIHYADALKRELRIVSRADEICILKIEDIIEIEYD

SEQ ID NO: 1092 - protein, 103 aa, Paenibacillus larvae
LWESSRMMLPEHREQLLEQRRELKKHAKPLLDEQRLEELSTILNYALATKHKVRFTVYDVYEDQHIAGVLIKYDPLTRSLGVISEANKAMHIMLENIIDVRLE

SEQ ID NO: 1093 - protein, 74 aa, Bacillus  SG-1
RDRGRIKWTSMMLPEHVKVLRDWAKEDSYEQRKEIDEQHLEELSEITAEAMEYGRLVTITHYVGRRHELLIGRI

SEQ ID NO: 1094 - protein, 105 aa, Bacillus  NRRL B-14911
IRDRGRIKWTSMMLPEHVKLLRDWAKEDTYEKPKELDEQQLEQMNETLAEAMEFGQAVAITHFRTHRHELVIGNIHYWDEIGQKLHVIDHFGEVHRIPLNTVADV

SEQ ID NO: 1095 - protein, 95 aa, Bacillus pumilus
MWESSRMMLPEHREQLLAQKRKKKEYTPPPLSTDQLEEMNFLITQSITEDQAICVTYAAAGRKEQFWGWVKTIHYETQRIKIVNDEDVLNLSLQQ

SEQ ID NO: 1096 - protein, 108 aa, Artificial
  Alicyclobacillus acidocaldarius mutated SEQ ID NO 1089
MNIRDGNIFEAMRLVLPEHRALMAQIQRERMKRKRPMLTEERLEEMQYVLSEAIREGRIVRVTMFTPERDVVLVGRVSARGKELRVRTAAGVHIVDVRDVVGVEMERS

SEQ ID NO: 1097 - protein, 108 aa, Artificial
  Alicyclobacillus acidocaldarius mutated SEQ ID NO 1089
MNIRDGNLFEAMRLVLPEHRALMAQIQRERMKRKRPMLTEERLEEMQYVLSEAIREGRIVRVTMFTPERDVVLVGRVSARGRELRVRTAAGVHIVDVRDVVGVEMERS

SEQ ID NO: 1098 - protein, 108 aa, Artificial
  Alicyclobacillus acidocaldarius mutated SEQ ID NO 1089
MNIRDGNIFEAMRLVLPEHRALMAQIQRERMKRKRPMLTEERLEEMQYVLSDAIREGRIVRVTMFTPERDVVLVGRVSARGRELRVRTAAGVHIVDVRDVVGVEMERS

SEQ ID NO: 1099 - protein, 108 aa, Artificial
  Alicyclobacillus acidocaldarius mutated SEQ ID NO 1089
MNIRDGNIFEAMRLVLPEHRALMAQIQRERMKRKRPMLTEERLEEMQYVLSEAIRDGRIVRVTMFTPERDVVLVGRVSARGRELRVRTAAGVHIVDVRDVVGVEMERS

SEQ ID NO: 1100 - protein, 108 aa, Artificial
  Alicyclobacillus acidocaldarius mutated SEQ ID NO 1089
MNIRDGNIFEAMRLVLPEHRALMAQIQRERMKRKRPMLTEERLEEMQYVLSEAIREGRIVRVTMFTPERDVVLVGRVSARGRELRVKTAAGVHIVDVRDVVGVEMERS

SEQ ID NO: 1101 - DNA, 327 bp, Artificial
  Alicyclobacillus acidocaldarius mutated SEQ ID NO 1090
atgaacatccgggacgggaacatcttcgaggccatgcggcttgtgttgccagagcatcgagcgctcatggcgcaaatccagcgtgaacggatgaaacggaagcgaccgatgctcaccgaggagcgcttggaggagatgcagtatgtgctcagcgaggcgattcgcgaggggcgcatcgtgcgcgtgacgatgtttacgccggaacgggatgtggtgctggtgggccgcgtgtcggcgcgcggtaaagaattgcgcgtgaggacggcggcaggcgtgcatatcgtggatgtgcgggatgtggtcggagtggagatggagagaagttaa

SEQ ID NO: 1102 - DNA, 327 bp, Artificial
  Alicyclobacillus acidocaldarius mutated SEQ ID NO 1090
atgaacatccgggacgggaacttattcgaggccatgcggcttgtgttgccagagcatcgagcgctcatggcgcaaatccagcgtgaacggatgaaacggaagcgaccgatgctcaccgaggagcgcttggaggagatgcagtatgtgctcagcgaggcgattcgcgaggggcgcatcgtgcgcgtgacgatgtttacgccggaacgggatgtggtgctggtgggccgcgtgtcggcgcgcggtagggaattgcgcgtgaggacggcggcaggcgtgcatatcgtggatgtgcgggatgtggtcggagtggagatggagagaagttaa

SEQ ID NO: 1103 - DNA, 327 bp, Artificial
  Alicyclobacillus acidocaldarius mutated SEQ ID NO 1090
atgaacatccgggacgggaacatcttcgaggccatgcggcttgtgttgccagagcatcgagcgctcatggcgcaaatccagcgtgaacggatgaaacggaagcgaccgatgctcaccgaggagcgcttggaggagatgcagtatgtgctcagcgatgcgattcgcgaggggcgcatcgtgcgcgtgacgatgtttacgccggaacgggatgtggtgctggtgggccgcgtgtcggcgcgcggtagggaattgcgcgtgaggacggcggcaggcgtgcatatcgtggatgtgcgggatgtggtcggagtggagatggagagaagttaa

SEQ ID NO: 1104 - DNA, 327 bp, Artificial
  Alicyclobacillus acidocaldarius mutated SEQ ID NO 1090
atgaacatccgggacgggaacatcttcgaggccatgcggcttgtgttgccagagcatcgagcgctcatggcgcaaatccagcgtgaacggatgaaacggaagcgaccgatgctcaccgaggagcgcttggaggagatgcagtatgtgctcagcgaggcgattcgcgatgggcgcatcgtgcgcgtgacgatgtttacgccggaacgggatgtggtgctggtgggccgcgtgtcggcgcgcggtagggaattgcgcgtgaggacggcggcaggcgtgcatatcgtggatgtgcgggatgtggtcggagtggagatggagagaagttaa

SEQ ID NO: 1105 - DNA, 327 bp, Artificial
  Alicyclobacillus acidocaldarius mutated SEQ ID NO 1090
atgaacatccgggacgggaacatcttcgaggccatgcggcttgtgttgccagagcatcgagcgctcatggcgcaaatccagcgtgaacggatgaaacggaagcgaccgatgctcaccgaggagcgcttggaggagatgcagtatgtgctcagcgaggcgattcgcgaggggcgcatcgtgcgcgtgacgatgtttacgccggaacgggatgtggtgctggtgggccgcgtgtcggcgcgcggtagggaattgcgcgtgaaaacggcggcaggcgtgcatatcgtggatgtgcgggatgtggtcggagtggagatggagagaagttaa

SEQ ID NO: 1106 - protein, 441 aa, Alicyclobacillus acidocaldarius
MRSSKTMHKEGDLLVVDTWTGREERFSYDEASAKRSEWLSQYENRERYRFYCLCRGHERIRLHLVKREHWHLASNPGQARLHAPHCGFYRNEVVRIVERRKKQFGIETVETVNEKGERVASLIFHVDDFFSADQEQTEEHEPPTPNMSSAAETERTILPEKRIIVRGERKERGKLTFSGFLREWYRVGLQWYEHHQQRQAKNVSELLYGMWRVMLDGTITFHDGKDPRALLFIPNRYVEPWHGERQKIVVGQLGDRSRSGSGEFWRVDGIYAKGTSLRANWNVLVSEVHLCPNPHIGALVALRVKHETDQLMSVCPAKQALIVERDGCAWVDSLVEYQFHEILMNGLQRRPDVKVEKPLEGLVEYDGRRPDYVLRMEGKPPLIIEIWGMSGKTDYDESKEKRQAFYRQLEKRGELRFLEWDSRNPRERAAVLRNIGLWMKK

SEQ ID NO: 1107 - DNA, 1326 bp, Alicyclobacillus acidocaldarius
ttgaggagttcgaagaccatgcataaggaaggagacctgctcgtcgtcgatacatggacagggcgagaagaacgcttttcttatgacgaggcgtcagccaagcgatctgaatggttaagccagtatgaaaatcgagagcgctatcggttttattgcttatgtcgcggtcacgaacggatccgactccatttggtaaaacgcgagcattggcacttggcgtcaaatccgggacaggcaagactacatgcgcctcattgcggtttttatcggaatgaggttgttcgaatcgtggaacgccgaaaaaagcagtttggcattgagacggttgaaacggtgaatgaaaaaggagagcgcgttgcatcgctaattttccacgttgatgactttttttcggcagatcaagagcaaacagaagagcatgaaccaccgactccgaacatgagttcagctgcggagacagagcgcacaattcttccagaaaaacgtatcatcgtgcgcggagagcggaaagaacgtgggaagctgacgttttcgggtttcctacgcgaatggtatcgagttgggttgcaatggtacgagcatcatcaacagcgccaagcgaaaaatgtttccgaattgctgtatggtatgtggcgagtgatgctcgacggaacgatcacgttccacgacggcaaagacccacgtgcattgctcttcatccccaaccgctacgttgaaccttggcacggagagcgccagaaaattgtcgtgggtcaactcggcgatcggagtcgaagtggctcgggcgaattctggcgtgtggacgggatttacgcaaaaggcacgtcgctgcgcgccaattggaacgtcctcgtaagtgaagtccacttgtgtcccaatccgcatatcggcgcactagtggcgctgcgagtcaaacatgagacggatcaactcatgagcgtctgcccggccaaacaagcgttgatcgtagagcgagatggatgcgcttgggtggatagcttggttgaatatcaattccacgaaatattgatgaacggcttgcagcgtcgaccggatgtcaaggtggaaaaacctctggaagggttggttgagtacgatggacgcagacctgattacgtattgcggatggaaggcaaaccgccactcatcatagagatttggggaatgagtgggaagacggactatgatgagagcaaagaaaaacggcaagcattctatagacaactcgagaaacggggcgaactccgttttcttgagtgggattcacggaacccgagagaaagggctgccgtacttcgcaacatcggcttatggatgaagaaataa

SEQ ID NO: 1108 - protein, 72 aa, Alteromonadales bacterium
YRNEVMWLYQHKNKHYRVKNLQDALEQGYTVAAHVGSYYGEQFEHLKNIYPKQIIFTGAAKTRFALLAKQRV

SEQ ID NO: 1109 - protein, 99 aa, Bos grunniens
EQTEKSHPRSPNVLSVALSQRTTAPEEELNPKILALQNAQRKRKIEHDGSLFQAVGIGTLLQQPDDRATTTSLSWKRVKGCKSSEQNGMEQKTIIFIPS

SEQ ID NO: 1110 - protein, 41 aa, Enterobacter aerogenes
EEQTKGAITFESVAREWHAANKKWTEEHSRRVLKSLEDNLF

SEQ ID NO: 1111 - protein, 47 aa, Ralstonia metallidurans
PDFILTDVAPEVVIEVLGMSGNADYDARIAEKRAHYLASGIPLLEWD

SEQ ID NO: 1112 - protein, 78 aa, Bradyrhizobium ORS278
DNLSEYHSILMTSEDPDPDLEGEAAKEAREKDEADDRRLSYLGTQLDLLLNQKKPLQKALWGISDEILALDTKEERQA

SEQ ID NO: 1113 - protein, 441 aa, Artificial
  Alicyclobacillus acidocaldarius mutated SEQ ID NO 1106
MRSSKTMHKEGDLLVVDTWTGREERFSYDEASAKRSEWLSQYENRERYRFYCLCRGHERIRLHLVKREHWHLASNPGNARLHAPHCGFYRNEVVRIVERRKKQFGIETVETVNEKGERVASLIFHVDDFFSADQEQTEEHEPPTPNMSSAAETERTILPEKRIIVRGERKERGKLTFSGFLREWYRVGLQWYEHHQQRQAKNVSELLYGMWRVMLDGTITFHDGKDPRALLFIPNRYVEPWHGERQKIVVGQLGDRSRSGSGEFWRVDGIYAKGTSLRANWNVLVSEVHLCPNPHIGALVALRVKHETDQLMSVCPAKQALIVERDGCAWVDSLVEYQFHEILMNGLQRRPDVKVEKPLEGLVEYDGRRPDYVLRMEGKPPLIIEIWGMSGKTDYDESKEKRQAFYRQLEKRGELRFLEWDSRNPRERAAVLRNIGLWMKK

SEQ ID NO: 1114 - protein, 441 aa, Artificial
  Alicyclobacillus acidocaldarius mutated SEQ ID NO 1106
MRSSKTMHKEGDLLVVDTWTGREERFSYDEASAKRSEWLSQYENRERYRFYCLCRGHERIRLHLVKREHWHLASNPGQARLHAPHCGFYRNEVVRIVERRKKQFGIETVETVNEKGERVASLIFHVDDFFSADQEQTEEHEPPTPNMSSAAETERTILPEKRIIVRGERKERGKLTFSGFLREWYRVGLQWYEHHQQRQAKNVSELLYGMWRVMLDGTITFHDGKDPRALLFIPNRYVEPWHGERQKIVVGQLGDRSRSGSGEFWRVDGIYAKGTSLRANWNVLVSEVHLCPNPHIGALVALRVKHETDQLMSVCPAKQALIVERDGCAWVDSLVEYQFHEILMNGLQRRPDVKVEKPLEGLVEYDGRRPDYVLRMEGKPPLIIEIWGMSGKTDYDESREKRQAFYRQLEKRGELRFLEWDSRNPRERAAVLRNIGLWMKK

SEQ ID NO: 1115 - protein, 441 aa, Artificial
  Alicyclobacillus acidocaldarius mutated SEQ ID NO 1106
MRSSKTMHKEGDLLVVDTWTGREERFSYDEASAKRSEWLSQYENRERYRFYCLCRGHERIRLHLVKREHWHLASNPGQARLHAPHCGFYRNEVVRIVERRKKQFGIETVETVNEKGERVASLIFHVDDFFSADQEQTEEHEPPTPNMSSAAETERTILPEKRIIVRGERKERGKLTFSGFLREWYRVGLQWYEHHQQRQAKNVSELLYGMWRVMLDGTITFHDGKDPRALLFIPNRYVEPWHGERQKIVVGQLGDRSRSGSGEFWRVDGIYAKGTSLRANWNVLVSEVHLCPNPHIGALVALRVKHETDQLMSVCPAKQALIVERDGCAWVDSLVEYQFHELLMNGLQRRPDVKVEKPLEGLVEYDGRRPDYVLRMEGKPPLIIEIWGMSGKTDYDESKEKRQAFYRQLEKRGELRFLEWDSRNPRERAAVLRNIGLWMKK

SEQ ID NO: 1116 - protein, 441 aa, Artificial
  Alicyclobacillus acidocaldarius mutated SEQ ID NO 1106
MRSSKTMHKEGDLLVVDTWTGREERFSYDEASAKRSEWLSQYENRERYRFYCLCRGHERIRLHLVKREHWHLASNPGQARLHAPHCGFYRNEVVRIVERRKKQFGIETVETVNEKGERVASLIFHVDDFFSADQEQTEEHEPPTPNMSSAAETERTILPEKRIIVRGERKERGKLTFSGFLREWYRVGLQWYEHHQQRQAKNVSELLYGMWRVMLDGTITFHDGKDPRALLFIPNRYVEPWHGERQKIVVGQLGDRSRSGSGEFWRVDGIYAKGTSLRANWNVLVSEVHLCPNPHIGALVALRVKHETDQLMSVCPAKQALIVERDGCAWVDSLVEYQFHEILMNGLQRRPDVKVEKPLEGLVEYDGRRPDYVLRMEGKPPLIIEIWGMSGKTDYDESKEKRQAFYRQLEKRGELRFIEWDSRNPRERAAVLRNIGLWMKK

SEQ ID NO: 1117 - protein, 441 aa, Artificial
  Alicyclobacillus acidocaldarius mutated SEQ ID NO 1106
MRSSKTMHKEGDLLVVDTWTGREERFSYDEASAKRSEWLSQYENRERYRFYCLCRGHERIRLHLVKREHWHLASNPGQARLHAPHCGFYRNEVVRIVERRKKQFGIETVETVNEKGERVASLIFHVDDFFSADQEQTEEHEPPTPNMSSAAETERTILPEKRIIVRGERKERGKLTFSGFLREWYRVGLQWYEHHQQRQAKNVSELLYGMWRVMLDGTITFHDGKDPRALLFIPNRYVEPWHGERQKIVVGNLGDRSRSGSGEFWRVDGIYAKGTSLRANWNVLVSEVHLCPNPHIGALVALRVKHETDQLMSVCPAKQALIVERDGCAWVDSLVEYQFHEILMNGLQRRPDVKVEKPLEGLVEYDGRRPDYVLRMEGKPPLIIEIWGMSGKTDYDESKEKRQAFYRQLEKRGELRFLEWDSRNPRERAAVLRNIGLWMKK

SEQ ID NO: 1118 - DNA, 1326 bp, Artificial
  Alicyclobacillus acidocaldarius mutated SEQ ID NO 1107
ttgaggagttcgaagaccatgcataaggaaggagacctgctcgtcgtcgatacatggacagggcgagaagaacgcttttcttatgacgaggcgtcagccaagcgatctgaatggttaagccagtatgaaaatcgagagcgctatcggttttattgcttatgtcgcggtcacgaacggatccgactccatttggtaaaacgcgagcattggcacttggcgtcaaatccgggaaatgcaagactacatgcgcctcattgcggtttttatcggaatgaggttgttcgaatcgtggaacgccgaaaaaagcagtttggcattgagacggttgaaacggtgaatgaaaaaggagagcgcgttgcatcgctaattttccacgttgatgactttttttcggcagatcaagagcaaacagaagagcatgaaccaccgactccgaacatgagttcagctgcggagacagagcgcacaattcttccagaaaaacgtatcatcgtgcgcggagagcggaaagaacgtgggaagctgacgttttcgggtttcctacgcgaatggtatcgagttgggttgcaatggtacgagcatcatcaacagcgccaagcgaaaaatgtttccgaattgctgtatggtatgtggcgagtgatgctcgacggaacgatcacgttccacgacggcaaagacccacgtgcattgctcttcatccccaaccgctacgttgaaccttggcacggagagcgccagaaaattgtcgtgggtcaactcggcgatcggagtcgaagtggctcgggcgaattctggcgtgtggacgggatttacgcaaaaggcacgtcgctgcgcgccaattggaacgtcctcgtaagtgaagtccacttgtgtcccaatccgcatatcggcgcactagtggcgctgcgagtcaaacatgagacggatcaactcatgagcgtctgcccggccaaacaagcgttgatcgtagagcgagatggatgcgcttgggtggatagcttggttgaatatcaattccacgaaatattgatgaacggcttgcagcgtcgaccggatgtcaaggtggaaaaacctctggaagggttggttgagtacgatggacgcagacctgattacgtattgcggatggaaggcaaaccgccactcatcatagagatttggggaatgagtgggaagacggactatgatgagagcaaagaaaaacggcaagcattctatagacaactcgagaaacggggcgaactccgttttcttgagtgggattcacggaacccgagagaaagggctgccgtacttcgcaacatcggcttatggatgaagaaataa

SEQ ID NO: 1119 - DNA, 1326 bp, Artificial
  Alicyclobacillus acidocaldarius mutated SEQ ID NO 1107
ttgaggagttcgaagaccatgcataaggaaggagacctgctcgtcgtcgatacatggacagggcgagaagaacgcttttcttatgacgaggcgtcagccaagcgatctgaatggttaagccagtatgaaaatcgagagcgctatcggttttattgcttatgtcgcggtcacgaacggatccgactccatttggtaaaacgcgagcattggcacttggcgtcaaatccgggacaggcaagactacatgcgcctcattgcggtttttatcggaatgaggttgttcgaatcgtggaacgccgaaaaaagcagtttggcattgagacggttgaaacggtgaatgaaaaaggagagcgcgttgcatcgctaattttccacgttgatgactttttttcggcagatcaagagcaaacagaagagcatgaaccaccgactccgaacatgagttcagctgcggagacagagcgcacaattcttccagaaaaacgtatcatcgtgcgcggagagcggaaagaacgtgggaagctgacgttttcgggtttcctacgcgaatggtatcgagttgggttgcaatggtacgagcatcatcaacagcgccaagcgaaaaatgtttccgaattgctgtatggtatgtggcgagtgatgctcgacggaacgatcacgttccacgacggcaaagacccacgtgcattgctcttcatccccaaccgctacgttgaaccttggcacggagagcgccagaaaattgtcgtgggtcaactcggcgatcggagtcgaagtggctcgggcgaattctggcgtgtggacgggatttacgcaaaaggcacgtcgctgcgcgccaattggaacgtcctcgtaagtgaagtccacttgtgtcccaatccgcatatcggcgcactagtggcgctgcgagtcaaacatgagacggatcaactcatgagcgtctgcccggccaaacaagcgttgatcgtagagcgagatggatgcgcttgggtggatagcttggttgaatatcaattccacgaaatattgatgaacggcttgcagcgtcgaccggatgtcaaggtggaaaaacctctggaagggttggttgagtacgatggacgcagacctgattacgtattgcggatggaaggcaaaccgccactcatcatagagatttggggaatgagtgggaagacggactatgatgagagccgtgaaaaacggcaagcattctatagacaactcgagaaacggggcgaactccgttttcttgagtgggattcacggaacccgagagaaagggctgccgtacttcgcaacatcggcttatggatgaagaaataa

SEQ ID NO: 1120 - DNA, 1326 bp, Artificial
  Alicyclobacillus acidocaldarius mutated SEQ ID NO 1107
ttgaggagttcgaagaccatgcataaggaaggagacctgctcgtcgtcgatacatggacagggcgagaagaacgcttttcttatgacgaggcgtcagccaagcgatctgaatggttaagccagtatgaaaatcgagagcgctatcggttttattgcttatgtcgcggtcacgaacggatccgactccatttggtaaaacgcgagcattggcacttggcgtcaaatccgggacaggcaagactacatgcgcctcattgcggtttttatcggaatgaggttgttcgaatcgtggaacgccgaaaaaagcagtttggcattgagacggttgaaacggtgaatgaaaaaggagagcgcgttgcatcgctaattttccacgttgatgactttttttcggcagatcaagagcaaacagaagagcatgaaccaccgactccgaacatgagttcagctgcggagacagagcgcacaattcttccagaaaaacgtatcatcgtgcgcggagagcggaaagaacgtgggaagctgacgttttcgggtttcctacgcgaatggtatcgagttgggttgcaatggtacgagcatcatcaacagcgccaagcgaaaaatgtttccgaattgctgtatggtatgtggcgagtgatgctcgacggaacgatcacgttccacgacggcaaagacccacgtgcattgctcttcatccccaaccgctacgttgaaccttggcacggagagcgccagaaaattgtcgtgggtcaactcggcgatcggagtcgaagtggctcgggcgaattctggcgtgtggacgggatttacgcaaaaggcacgtcgctgcgcgccaattggaacgtcctcgtaagtgaagtccacttgtgtcccaatccgcatatcggcgcactagtggcgctgcgagtcaaacatgagacggatcaactcatgagcgtctgcccggccaaacaagcgttgatcgtagagcgagatggatgcgcttgggtggatagcttggttgaatatcaattccacgaattattgatgaacggcttgcagcgtcgaccggatgtcaaggtggaaaaacctctggaagggttggttgagtacgatggacgcagacctgattacgtattgcggatggaaggcaaaccgccactcatcatagagatttggggaatgagtgggaagacggactatgatgagagcaaagaaaaacggcaagcattctatagacaactcgagaaacggggcgaactccgttttcttgagtgggattcacggaacccgagagaaagggctgccgtacttcgcaacatcggcttatggatgaagaaataa

SEQ ID NO: 1121 - DNA, 1326 bp, Artificial
  Alicyclobacillus acidocaldarius mutated SEQ ID NO 1107
ttgaggagttcgaagaccatgcataaggaaggagacctgctcgtcgtcgatacatggacagggcgagaagaacgcttttcttatgacgaggcgtcagccaagcgatctgaatggttaagccagtatgaaaatcgagagcgctatcggttttattgcttatgtcgcggtcacgaacggatccgactccatttggtaaaacgcgagcattggcacttggcgtcaaatccgggacaggcaagactacatgcgcctcattgcggtttttatcggaatgaggttgttcgaatcgtggaacgccgaaaaaagcagtttggcattgagacggttgaaacggtgaatgaaaaaggagagcgcgttgcatcgctaattttccacgttgatgactttttttcggcagatcaagagcaaacagaagagcatgaaccaccgactccgaacatgagttcagctgcggagacagagcgcacaattcttccagaaaaacgtatcatcgtgcgcggagagcggaaagaacgtgggaagctgacgttttcgggtttcctacgcgaatggtatcgagttgggttgcaatggtacgagcatcatcaacagcgccaagcgaaaaatgtttccgaattgctgtatggtatgtggcgagtgatgctcgacggaacgatcacgttccacgacggcaaagacccacgtgcattgctcttcatccccaaccgctacgttgaaccttggcacggagagcgccagaaaattgtcgtgggtcaactcggcgatcggagtcgaagtggctcgggcgaattctggcgtgtggacgggatttacgcaaaaggcacgtcgctgcgcgccaattggaacgtcctcgtaagtgaagtccacttgtgtcccaatccgcatatcggcgcactagtggcgctgcgagtcaaacatgagacggatcaactcatgagcgtctgcccggccaaacaagcgttgatcgtagagcgagatggatgcgcttgggtggatagcttggttgaatatcaattccacgaaatattgatgaacggcttgcagcgtcgaccggatgtcaaggtggaaaaacctctggaagggttggttgagtacgatggacgcagacctgattacgtattgcggatggaaggcaaaccgccactcatcatagagatttggggaatgagtgggaagacggactatgatgagagcaaagaaaaacggcaagcattctatagacaactcgagaaacggggcgaactccgttttattgagtgggattcacggaacccgagagaaagggctgccgtacttcgcaacatcggcttatggatgaagaaataa

SEQ ID NO: 1122 - DNA, 1326 bp, Artificial
  Alicyclobacillus acidocaldarius mutated SEQ ID NO 1107
ttgaggagttcgaagaccatgcataaggaaggagacctgctcgtcgtcgatacatggacagggcgagaagaacgcttttcttatgacgaggcgtcagccaagcgatctgaatggttaagccagtatgaaaatcgagagcgctatcggttttattgcttatgtcgcggtcacgaacggatccgactccatttggtaaaacgcgagcattggcacttggcgtcaaatccgggacaggcaagactacatgcgcctcattgcggtttttatcggaatgaggttgttcgaatcgtggaacgccgaaaaaagcagtttggcattgagacggttgaaacggtgaatgaaaaaggagagcgcgttgcatcgctaattttccacgttgatgactttttttcggcagatcaagagcaaacagaagagcatgaaccaccgactccgaacatgagttcagctgcggagacagagcgcacaattcttccagaaaaacgtatcatcgtgcgcggagagcggaaagaacgtgggaagctgacgttttcgggtttcctacgcgaatggtatcgagttgggttgcaatggtacgagcatcatcaacagcgccaagcgaaaaatgtttccgaattgctgtatggtatgtggcgagtgatgctcgacggaacgatcacgttccacgacggcaaagacccacgtgcattgctcttcatccccaaccgctacgttgaaccttggcacggagagcgccagaaaattgtcgtgggtaatctcggcgatcggagtcgaagtggctcgggcgaattctggcgtgtggacgggatttacgcaaaaggcacgtcgctgcgcgccaattggaacgtcctcgtaagtgaagtccacttgtgtcccaatccgcatatcggcgcactagtggcgctgcgagtcaaacatgagacggatcaactcatgagcgtctgcccggccaaacaagcgttgatcgtagagcgagatggatgcgcttgggtggatagcttggttgaatatcaattccacgaaatattgatgaacggcttgcagcgtcgaccggatgtcaaggtggaaaaacctctggaagggttggttgagtacgatggacgcagacctgattacgtattgcggatggaaggcaaaccgccactcatcatagagatttggggaatgagtgggaagacggactatgatgagagcaaagaaaaacggcaagcattctatagacaactcgagaaacggggcgaactccgttttcttgagtgggattcacggaacccgagagaaagggctgccgtacttcgcaacatcggcttatggatgaagaaataa

SEQ ID NO: 1123 - protein, 425 aa, Alicyclobacillus acidocaldarius
MYDGRQTVVREATALQQPQWTRDIVMVNPNELVPHPRRDEAGERYDTPEAMDNLPTNLVSLQANILQNGIREPLLVQRSTNILMTGHFRRAVAIQAGWTEVPVQYLDVTDEEAYAIMLADNWERNTGIMEDYMAVARNMFYFALRLKLLNEIDDDSVDISPSRKQEGTVPSFSSEIVHLVSKKFERSRAVVRKHFALLKLIPELQHWISEKKIGFEGGAMLAGMSEQAQRDFMRDYADWPKISDSDIKAFRNTWESIVERQTNGLGAAEKPISIPEPSSETLVAEWEEMRSDESVPHITKYASDAYELSVVADGGRHQPMYSAEKRSISIVDVPEHKTLLARNRLALLVKKQRRAMERMTNELSQQAEALMEEIKEGGLQEMMEDIEQLEFHTKGMLALIENLKLHDREAVQRLSDIFEEFEDHA

SEQ ID NO: 1124 - DNA, 1278 bp, Alicyclobacillus acidocaldarius
gtgtacgatggtagacaaaccgttgtacgggaggcgactgcgttgcaacagccacaatggacgcgcgacatcgtgatggtcaacccgaacgaacttgtacctcatccacgacgggacgaagctggcgaacggtacgatacccccgaagccatggacaacttgccgacgaaccttgtttctctccaagcgaacattctccaaaacggaatccgcgaaccgctgttggtgcaacgttcgaccaacatcctgatgacagggcattttcgtcgcgctgtcgcgatacaagctggctggacagaagtgcccgtgcagtacttggacgtgacggacgaagaagcctacgcaatcatgctcgcggacaactgggagcgtaacacgggtatcatggaggactacatggctgtggctcggaacatgttttactttgcattgcggttgaagttgttaaatgaaatagatgatgattccgtggatatatctccctctcggaagcaagagggaaccgtacccagtttttcttcggaaatcgtccatttagtcagcaaaaaatttgagcgttcgagagcagtagtgcgcaagcatttcgcgttgttaaagctaattcctgaacttcagcattggattagcgagaaaaagattggtttcgagggcggcgccatgcttgccggtatgagtgaacaagcccagcgcgatttcatgcgcgactatgcggactggcccaagatttcggacagcgacatcaaggcgtttcggaatacatgggaaagcatcgtagaacgccaaaccaacggattgggcgcggcggagaagccgatatcgataccagaaccttcatcggaaacgctggttgcagaatgggaagaaatgcgatccgacgagagcgtaccacacatcacgaaatacgcctcggatgcttacgagctgtctgtggttgcagatgggggccgtcatcagccaatgtactctgcagaaaagcgttcgatttctatcgtggacgttccggaacacaagacgttgctggccagaaataggttggctttgctcgtcaaaaagcaaagaagagccatggaacgaatgacgaacgagctgagtcagcaggccgaggccttgatggaagagattaaagagggcggtctccaagagatgatggaggacattgagcagttggagttccacacgaagggcatgttggcgttgatcgaaaatttgaagttgcacgaccgggaagcggtgcaacgactgagcgatatctttgaggagttcgaagaccatgcataa

SEQ ID NO: 1125 - protein, 174 aa, Faecalibacterium prausnitzii
SVEQYGVLSPLIARPRPEGGYEIISGHRRQHAAQLAGLDTLPVIVRQMDDDAAVLLMVDSNLQRENILPSERAFAYKMKLEALKNQGARSDLTSVQVAPKLSTEKIGEEVGMSKDNVKRYIRLTNLVPELLDMVDEKKIAFNPAVELSYLDEAQQRDFLEAMNDTQNAPSLSQA

SEQ ID NO: 1126 - protein, 231 aa, Eubacterium ventriosum
LTESIRERGVLLPILVRKTNDEEYEIISGHRRTHAARLAGLEKVPVIIRELSNDDATIVMVDSNIQREEILPSEKAYAFQMKLEAIHHKGIKGAESREVVGEANGLSGRQVSRYIKLTNLLPELLEMVDKKKIAIKLAVEIAELSESEQQEILDYFNLGYKVSLEQVKAIKNKEKSTDIIERPEEKTKESTKVTISRKKLKQYFPENYTKAEMENIIYQLLEKWKSDGYDI

SEQ ID NO: 1127 - protein, 201 aa, Geobacillus thermodenitrificans
PEAIEELKQSILQHGILQPLIVRRSLKGFEIVVGERRYRAAKEANLPSVPVVVRELTDEQMMEFALLENLQREDLNPIEEAMAYKMLMDKLHLTQEEIASRVGKSRPHIANHLRLLSLPPEVQKLLIDGTLSMGHGRALLGLKKKGKMKSIVERTVREGLNVRQLEKLVQQMNENVSRETSKRKPPEKSVFIRESESLLRE

SEQ ID NO: 1128 - protein, 177 aa, Faecalibacterium prausnitzii
SVEQYGVLSPLIARPRPEGGYEIISGHRRQHAAQLAGLDTLPVIVRQMDDDAAVLLMVDSNLQRENILPSERAFAYKMKLEAIERTVGRPKNVGQVVPDYFGKRSTEIVAEGTGESYKQVQRFIRLTNLIPELLDMVDEKKIAFNPAVELSYLDESQQRDFLEAMQDTQNAPSLSQA

SEQ ID NO: 1129 - protein, 165 aa, Eubacterium siraeum
ALAESIKMHGVVSPIIVRPLENTADEYEIISGHRRVMASRKAGITEVPALVVSLDRDAAAIVLVDSNLHREHILPSEKAFAYKMKAEALAHKGYRTDLTSVQVAPKLATEQIAEDAGTSKDTIKRYIRLTNLIPEILQYVDDGRIAFTPAVELSYLNEQEQYDLL

SEQ ID NO: 1130 - protein, 425 aa, Artificial
  Alicyclobacillus acidocaldarius mutated SEQ ID NO 1123
MYDGRQTVVREATALQQPQWTRDIVMVNPNELVPHPRRDEAGERYDTPEAMDNLPTNLVSLQANILQNGIREPLLVQRSTNILMTGHFRRAVAIQAGWTEVPVQYLDVTDEEAYAIMLADNWERNTGIMEDYMAVARNMFYFALRLKLLNEIDDDSVDISPSRKQEGTVPSFSSEIVHLVSKKFERSRAVVRKHFALLKLIPELQHWISEKKIGFEGGAMLAGMSEQAQRDFMRDYADWPKISDSDIKAFRNTWESIVERQTNGLGAAEKPISIPEPSSETLVAEWEEMRSDESVPHITKYASDAYELSVVADGGRHQPMYSAEKRSISIVDVPEHKTLLARNRLALLVKKNRRAMERMTNELSQQAEALMEEIKEGGLQEMMEDIEQLEFHTKGMLALIENLKLHDREAVQRLSDIFEEFEDHA

SEQ ID NO: 1131 - protein, 425 aa, Artificial
  Alicyclobacillus acidocaldarius mutated SEQ ID NO 1123
MYDGRQTVVREATALQQPQWTRDIVMVNPNELVPHPRRDEAGERYDTPEAMDNLPTNLVSLQANILQNGIREPLLVQRSTNILMTGHFRRAVAIQAGWTEVPVQYLDVTDEEAYAIMLADNWERNTGIMEDYMAVARNMFYFALRLKLLNEIDDDSVDISPSRKQEGTVPSFSSEIVHLVSKKFERSRAVVRKHFALLKLIPELQHWISEKKIGFEGGAMLAGMSEQAQRDFMRDYADWPKISDSDIKAFRNTWESIVERQTNGLGAAEKPISIPEPSSETLVAEWEEMRSDESVPHITKYASDAYELSVVADGGRHQPMYSAEKRSISIVDVPEHKTLLARNRLALLVKKQRRAMEKMTNELSQQAEALMEEIKEGGLQEMMEDIEQLEFHTKGMLALIENLKLHDREAVQRLSDIFEEFEDHA

SEQ ID NO: 1132 - protein, 425 aa, Artificial
  Alicyclobacillus acidocaldarius mutated SEQ ID NO 1123
MYDGRQTVVREATALQQPQWTRDIVMVNPNELVPHPRRDEAGERYDTPEAMDNLPTNLVSLQANILQNGIREPLLVQRSTNILMTGHFRRAVAIQAGWTEVPVQYLDVTDEEAYAIMLADNWERNTGIMEDYMAVARNMFYFALRLKLLNEIDDDSVDISPSRKQEGTVPSFSSEIVHLVSKKFERSRAVVRKHFALLKLIPELQHWISEKKIGFEGGAMLAGMSEQAQRDFMRDYADWPKISDSDIKAFRNTWESIVERQTNGLGAAERPISIPEPSSETLVAEWEEMRSDESVPHITKYASDAYELSVVADGGRHQPMYSAEKRSISIVDVPEHKTLLARNRLALLVKKQRRAMERMTNELSQQAEALMEEIKEGGLQEMMEDIEQLEFHTKGMLALIENLKLHDREAVQRLSDIFEEFEDHA

SEQ ID NO: 1133 - protein, 425 aa, Artificial
  Alicyclobacillus acidocaldarius mutated SEQ ID NO 1123
MYDGRQTVVREATALQQPQWTRDIVMVNPNELVPHPRRDEAGERYDTPEAMDNLPTNLVSLQANILQNGIREPLLVQRSTNILMTGHFRRAVAIQAGWTEVPVQYLDVTDEEAYAIMLADNWERNTGIMEDYMAVARNMFYFALRLKLLNEIDDDSVDISPSRKQEGTVPSFSSEIVHLVSKKFERSRAVVRKHFALLKLIPELQHWISEKKIGFEGGAMLAGMSEQAQRDFMRDYADWPKISDSDIKAFRNTWESIVERQTNGLGAADKPISIPEPSSETLVAEWEEMRSDESVPHITKYASDAYELSVVADGGRHQPMYSAEKRSISIVDVPEHKTLLARNRLALLVKKQRRAMERMTNELSQQAEALMEEIKEGGLQEMMEDIEQLEFHTKGMLALIENLKLHDREAVQRLSDIFEEFEDHA

SEQ ID NO: 1134 - protein, 425 aa, Artificial
  Alicyclobacillus acidocaldarius mutated SEQ ID NO 1123
MYDGRQTVVREATALQQPQWTRDIVMVNPNELVPHPRRDEAGERYDTPEAMDNLPTNLVSLQANILQNGIREPLLVQRSTNILMTGHFRRAVAIQAGWTEVPVQYLDVTDEEAYAIMLADNWERNTGIMEDYMAVARNMFYFALRLKLLNEIDDDSIDISPSRKQEGTVPSFSSEIVHLVSKKFERSRAVVRKHFALLKLIPELQHWISEKKIGFEGGAMLAGMSEQAQRDFMRDYADWPKISDSDIKAFRNTWESIVERQTNGLGAAEKPISIPEPSSETLVAEWEEMRSDESVPHITKYASDAYELSVVADGGRHQPMYSAEKRSISIVDVPEHKTLLARNRLALLVKKQRRAMERMTNELSQQAEALMEEIKEGGLQEMMEDIEQLEFHTKGMLALIENLKLHDREAVQRLSDIFEEFEDHA

SEQ ID NO: 1135 - DNA, 1278 bp, Artificial
  Alicyclobacillus acidocaldarius mutated SEQ ID NO 1124
gtgtacgatggtagacaaaccgttgtacgggaggcgactgcgttgcaacagccacaatggacgcgcgacatcgtgatggtcaacccgaacgaacttgtacctcatccacgacgggacgaagctggcgaacggtacgatacccccgaagccatggacaacttgccgacgaaccttgtttctctccaagcgaacattctccaaaacggaatccgcgaaccgctgttggtgcaacgttcgaccaacatcctgatgacagggcattttcgtcgcgctgtcgcgatacaagctggctggacagaagtgcccgtgcagtacttggacgtgacggacgaagaagcctacgcaatcatgctcgcggacaactgggagcgtaacacgggtatcatggaggactacatggctgtggctcggaacatgttttactttgcattgcggttgaagttgttaaatgaaatagatgatgattccgtggatatatctccctctcggaagcaagagggaaccgtacccagtttttcttcggaaatcgtccatttagtcagcaaaaaatttgagcgttcgagagcagtagtgcgcaagcatttcgcgttgttaaagctaattcctgaacttcagcattggattagcgagaaaaagattggtttcgagggcggcgccatgcttgccggtatgagtgaacaagcccagcgcgatttcatgcgcgactatgcggactggcccaagatttcggacagcgacatcaaggcgtttcggaatacatgggaaagcatcgtagaacgccaaaccaacggattgggcgcggcggagaagccgatatcgataccagaaccttcatcggaaacgctggttgcagaatgggaagaaatgcgatccgacgagagcgtaccacacatcacgaaatacgcctcggatgcttacgagctgtctgtggttgcagatgggggccgtcatcagccaatgtactctgcagaaaagcgttcgatttctatcgtggacgttccggaacacaagacgttgctggccagaaataggttggctttgctcgtcaaaaagaatagaagagccatggaacgaatgacgaacgagctgagtcagcaggccgaggccttgatggaagagattaaagagggcggtctccaagagatgatggaggacattgagcagttggagttccacacgaagggcatgttggcgttgatcgaaaatttgaagttgcacgaccgggaagcggtgcaacgactgagcgatatctttgaggagttcgaagaccatgcataa

SEQ ID NO: 1136 - DNA, 1278 bp, Artificial
  Alicyclobacillus acidocaldarius mutated SEQ ID NO 1124
gtgtacgatggtagacaaaccgttgtacgggaggcgactgcgttgcaacagccacaatggacgcgcgacatcgtgatggtcaacccgaacgaacttgtacctcatccacgacgggacgaagctggcgaacggtacgatacccccgaagccatggacaacttgccgacgaaccttgtttctctccaagcgaacattctccaaaacggaatccgcgaaccgctgttggtgcaacgttcgaccaacatcctgatgacagggcattttcgtcgcgctgtcgcgatacaagctggctggacagaagtgcccgtgcagtacttggacgtgacggacgaagaagcctacgcaatcatgctcgcggacaactgggagcgtaacacgggtatcatggaggactacatggctgtggctcggaacatgttttactttgcattgcggttgaagttgttaaatgaaatagatgatgattccgtggatatatctccctctcggaagcaagagggaaccgtacccagtttttcttcggaaatcgtccatttagtcagcaaaaaatttgagcgttcgagagcagtagtgcgcaagcatttcgcgttgttaaagctaattcctgaacttcagcattggattagcgagaaaaagattggtttcgagggcggcgccatgcttgccggtatgagtgaacaagcccagcgcgatttcatgcgcgactatgcggactggcccaagatttcggacagcgacatcaaggcgtttcggaatacatgggaaagcatcgtagaacgccaaaccaacggattgggcgcggcggagaagccgatatcgataccagaaccttcatcggaaacgctggttgcagaatgggaagaaatgcgatccgacgagagcgtaccacacatcacgaaatacgcctcggatgcttacgagctgtctgtggttgcagatgggggccgtcatcagccaatgtactctgcagaaaagcgttcgatttctatcgtggacgttccggaacacaagacgttgctggccagaaataggttggctttgctcgtcaaaaagcaaagaagagccatggaaaaaatgacgaacgagctgagtcagcaggccgaggccttgatggaagagattaaagagggcggtctccaagagatgatggaggacattgagcagttggagttccacacgaagggcatgttggcgttgatcgaaaatttgaagttgcacgaccgggaagcggtgcaacgactgagcgatatctttgaggagttcgaagaccatgcataa

SEQ ID NO: 1137 - DNA, 1278 bp, Artificial
  Alicyclobacillus acidocaldarius mutated SEQ ID NO 1124
gtgtacgatggtagacaaaccgttgtacgggaggcgactgcgttgcaacagccacaatggacgcgcgacatcgtgatggtcaacccgaacgaacttgtacctcatccacgacgggacgaagctggcgaacggtacgatacccccgaagccatggacaacttgccgacgaaccttgtttctctccaagcgaacattctccaaaacggaatccgcgaaccgctgttggtgcaacgttcgaccaacatcctgatgacagggcattttcgtcgcgctgtcgcgatacaagctggctggacagaagtgcccgtgcagtacttggacgtgacggacgaagaagcctacgcaatcatgctcgcggacaactgggagcgtaacacgggtatcatggaggactacatggctgtggctcggaacatgttttactttgcattgcggttgaagttgttaaatgaaatagatgatgattccgtggatatatctccctctcggaagcaagagggaaccgtacccagtttttcttcggaaatcgtccatttagtcagcaaaaaatttgagcgttcgagagcagtagtgcgcaagcatttcgcgttgttaaagctaattcctgaacttcagcattggattagcgagaaaaagattggtttcgagggcggcgccatgcttgccggtatgagtgaacaagcccagcgcgatttcatgcgcgactatgcggactggcccaagatttcggacagcgacatcaaggcgtttcggaatacatgggaaagcatcgtagaacgccaaaccaacggattgggcgcggcggagcgtccgatatcgataccagaaccttcatcggaaacgctggttgcagaatgggaagaaatgcgatccgacgagagcgtaccacacatcacgaaatacgcctcggatgcttacgagctgtctgtggttgcagatgggggccgtcatcagccaatgtactctgcagaaaagcgttcgatttctatcgtggacgttccggaacacaagacgttgctggccagaaataggttggctttgctcgtcaaaaagcaaagaagagccatggaacgaatgacgaacgagctgagtcagcaggccgaggccttgatggaagagattaaagagggcggtctccaagagatgatggaggacattgagcagttggagttccacacgaagggcatgttggcgttgatcgaaaatttgaagttgcacgaccgggaagcggtgcaacgactgagcgatatctttgaggagttcgaagaccatgcataa

SEQ ID NO: 1138 - DNA, 1278 bp, Artificial
  Alicyclobacillus acidocaldarius mutated SEQ ID NO 1124
gtgtacgatggtagacaaaccgttgtacgggaggcgactgcgttgcaacagccacaatggacgcgcgacatcgtgatggtcaacccgaacgaacttgtacctcatccacgacgggacgaagctggcgaacggtacgatacccccgaagccatggacaacttgccgacgaaccttgtttctctccaagcgaacattctccaaaacggaatccgcgaaccgctgttggtgcaacgttcgaccaacatcctgatgacagggcattttcgtcgcgctgtcgcgatacaagctggctggacagaagtgcccgtgcagtacttggacgtgacggacgaagaagcctacgcaatcatgctcgcggacaactgggagcgtaacacgggtatcatggaggactacatggctgtggctcggaacatgttttactttgcattgcggttgaagttgttaaatgaaatagatgatgattccgtggatatatctccctctcggaagcaagagggaaccgtacccagtttttcttcggaaatcgtccatttagtcagcaaaaaatttgagcgttcgagagcagtagtgcgcaagcatttcgcgttgttaaagctaattcctgaacttcagcattggattagcgagaaaaagattggtttcgagggcggcgccatgcttgccggtatgagtgaacaagcccagcgcgatttcatgcgcgactatgcggactggcccaagatttcggacagcgacatcaaggcgtttcggaatacatgggaaagcatcgtagaacgccaaaccaacggattgggcgcggcggataagccgatatcgataccagaaccttcatcggaaacgctggttgcagaatgggaagaaatgcgatccgacgagagcgtaccacacatcacgaaatacgcctcggatgcttacgagctgtctgtggttgcagatgggggccgtcatcagccaatgtactctgcagaaaagcgttcgatttctatcgtggacgttccggaacacaagacgttgctggccagaaataggttggctttgctcgtcaaaaagcaaagaagagccatggaacgaatgacgaacgagctgagtcagcaggccgaggccttgatggaagagattaaagagggcggtctccaagagatgatggaggacattgagcagttggagttccacacgaagggcatgttggcgttgatcgaaaatttgaagttgcacgaccgggaagcggtgcaacgactgagcgatatctttgaggagttcgaagaccatgcataa

SEQ ID NO: 1139 - DNA, 1278 bp, Artificial
  Alicyclobacillus acidocaldarius mutated SEQ ID NO 1124
gtgtacgatggtagacaaaccgttgtacgggaggcgactgcgttgcaacagccacaatggacgcgcgacatcgtgatggtcaacccgaacgaacttgtacctcatccacgacgggacgaagctggcgaacggtacgatacccccgaagccatggacaacttgccgacgaaccttgtttctctccaagcgaacattctccaaaacggaatccgcgaaccgctgttggtgcaacgttcgaccaacatcctgatgacagggcattttcgtcgcgctgtcgcgatacaagctggctggacagaagtgcccgtgcagtacttggacgtgacggacgaagaagcctacgcaatcatgctcgcggacaactgggagcgtaacacgggtatcatggaggactacatggctgtggctcggaacatgttttactttgcattgcggttgaagttgttaaatgaaatagatgatgattccattgatatatctccctctcggaagcaagagggaaccgtacccagtttttcttcggaaatcgtccatttagtcagcaaaaaatttgagcgttcgagagcagtagtgcgcaagcatttcgcgttgttaaagctaattcctgaacttcagcattggattagcgagaaaaagattggtttcgagggcggcgccatgcttgccggtatgagtgaacaagcccagcgcgatttcatgcgcgactatgcggactggcccaagatttcggacagcgacatcaaggcgtttcggaatacatgggaaagcatcgtagaacgccaaaccaacggattgggcgcggcggagaagccgatatcgataccagaaccttcatcggaaacgctggttgcagaatgggaagaaatgcgatccgacgagagcgtaccacacatcacgaaatacgcctcggatgcttacgagctgtctgtggttgcagatgggggccgtcatcagccaatgtactctgcagaaaagcgttcgatttctatcgtggacgttccggaacacaagacgttgctggccagaaataggttggctttgctcgtcaaaaagcaaagaagagccatggaacgaatgacgaacgagctgagtcagcaggccgaggccttgatggaagagattaaagagggcggtctccaagagatgatggaggacattgagcagttggagttccacacgaagggcatgttggcgttgatcgaaaatttgaagttgcacgaccgggaagcggtgcaacgactgagcgatatctttgaggagttcgaagaccatgcataa

SEQ ID NO: 1140 - protein, 300 aa, Alicyclobacillus acidocaldarius
MPRLSKDALVPPEKRDTFIAWLINKRDELGFTQKDMADFLGLSLSYYNAIENRKRNLSAKLVIQLASKLPQGPRFAVQLLGPEVVGKYMNLIQLPPEKEEEYEAEDALLDAIQQREKSATDYLGLLRSVLHHSNAVMAVSVQPNLCWFGLTPEDVAIITPVTDLKALIPGQLVYVVDRTAQAGEFAFVRALHGKELTSVESTLMMMLDLPRDTTQLFEWGIDPRRALMSWNADDPNLMVCEVVTICKASPSRIVPLTSPGYEEWSLLERKTILQQGIVYNRLRQEMKETLQKFRRIMATQ

SEQ ID NO: 1141 - DNA, 903 bp, Alicyclobacillus acidocaldarius
atgcccagactttcgaaagatgcgctggttccaccggaaaagcgcgataccttcattgcatggctcatcaacaagcgagatgagctgggatttacgcagaaagacatggccgactttctcgggctttcgctttcctactacaacgccattgagaatcggaaacggaacctgagtgccaagctggtcatccagttggcgtcgaaactgccccagggcccgcgttttgcggtgcagttattggggccggaagtcgtcgggaagtacatgaacttgattcagcttccgccggagaaggaagaggagtatgaggcggaggatgccctattggacgcgattcagcagcgtgagaagtcggccaccgactatctcggcctgttacggagcgtcttgcatcactccaatgcggtcatggctgtgagcgtacaaccgaacctgtgctggtttgggttgacgccggaggatgtcgccatcattacgccggtgaccgatctcaaagcgttgatacccggacagctggtgtatgtagtcgaccgaacggcccaagcaggcgagtttgcgtttgtgcgggcactgcatgggaaggaactcacgagtgtcgaatcgaccctcatgatgatgctcgaccttccacgggatacgacgcaactgtttgaatggggtattgaccctcgacgtgcgcttatgtcttggaatgctgacgatcccaacctcatggtctgcgaagtcgtcaccatctgcaaggcttcaccgtcacgtatcgttccgcttacatcgccaggatatgaggagtggagtttactcgagcgcaaaaccattctccagcaaggtatcgtgtataaccgactgcggcaagagatgaaggagacgcttcagaaatttcgccgtatcatggcaacgcaatag

SEQ ID NO: 1142 - protein, 66 aa, Roseovarius nubinhibens
PQICKGAPMAPRKLYAGAKLRETRSRLGLTQKDFAARLGVSLPYLNQMENNNRPVSTTVVLALAQE

SEQ ID NO: 1143 - protein, 49 aa, Roseovarius  217
AKLRETRQRLGLTQKDFAGKLGVSLPYLNQMENNNRPLSTTVVLALAQE

SEQ ID NO: 1144 - protein, 49 aa, Roseobacter  AzwK-3b
AKLRETRQRLGLTQKDFATKLGVSLPYLNQMENNNRPVSTTVVLALAQE

SEQ ID NO: 1145 - protein, 49 aa, Roseovarius  TM1035
AKLRETRQRLGLTQKDFAGKLGVSLPYLNQMENNNRPVSTTVVLALAQE

SEQ ID NO: 1146 - protein, 85 aa, Rhodobacterales bacterium
RRIDLGLRQGDLALKVGISPAYLNLIEHNKRRIGGKLLVSLAATLAVEPIALTQGGAAAVVAGLKNAASNAPQIDVEEANVDQFL

SEQ ID NO: 1147 - protein, 300 aa, Artificial
  Alicyclobacillus acidocaldarius mutated SEQ ID NO 1140
MPRLSKDALVPPEKRDTFIAWLINKRDELGFTQKDMADFLGLSLSYYNAIENRKRNLSAKLVIQLASKLPQGPRFAVQLLGPEVVGKYMNLIQLPPEKEEEYEAEDALLDAIQQREKSATDYLGLLRSVIHHSNAVMAVSVQPNLCWFGLTPEDVAIITPVTDLKALIPGQLVYVVDRTAQAGEFAFVRALHGKELTSVESTLMMMLDLPRDTTQLFEWGIDPRRALMSWNADDPNLMVCEVVTICKASPSRIVPLTSPGYEEWSLLERKTILQQGIVYNRLRQEMKETLQKFRRIMATQ

SEQ ID NO: 1148 - protein, 300 aa, Artificial
  Alicyclobacillus acidocaldarius mutated SEQ ID NO 1140
MPRLSKDALVPPEKRDTFIAWLINKRDELGFTQRDMADFLGLSLSYYNAIENRKRNLSAKLVIQLASKLPQGPRFAVQLLGPEVVGKYMNLIQLPPEKEEEYEAEDALLDAIQQREKSATDYLGLLRSVLHHSNAVMAVSVQPNLCWFGLTPEDVAIITPVTDLKALIPGQLVYVVDRTAQAGEFAFVRALHGKELTSVESTLMMMLDLPRDTTQLFEWGIDPRRALMSWNADDPNLMVCEVVTICKASPSRIVPLTSPGYEEWSLLERKTILQQGIVYNRLRQEMKETLQKFRRIMATQ

SEQ ID NO: 1149 - protein, 300 aa, Artificial
  Alicyclobacillus acidocaldarius mutated SEQ ID NO 1140
MPRLSKDALVPPEKRDTFIAWLINKRDELGFTQKDMADFLGLSLSYYNAIENRKRNLSAKLVIQLASKLPQGPRFAVQLLGPEVVGKYMNLIQLPPEKEEEYEAEDALLDAIQQREKSATDYLGLLKSVLHHSNAVMAVSVQPNLCWFGLTPEDVAIITPVTDLKALIPGQLVYVVDRTAQAGEFAFVRALHGKELTSVESTLMMMLDLPRDTTQLFEWGIDPRRALMSWNADDPNLMVCEVVTICKASPSRIVPLTSPGYEEWSLLERKTILQQGIVYNRLRQEMKETLQKFRRIMATQ

SEQ ID NO: 1150 - protein, 300 aa, Artificial
  Alicyclobacillus acidocaldarius mutated SEQ ID NO 1140
MPRLSKDALVPPEKRDTFIAWLINKRDELGFTQKDMADFLGLSLSYYNAIENRKRNLSAKLVIQLASKLPQGPRFAVQLLGPEVVGKYMNLIQLPPEKEEEYEAEDALLDAIQQREKSATDYLGLLRSVLHHSNAVMAVSIQPNLCWFGLTPEDVAIITPVTDLKALIPGQLVYVVDRTAQAGEFAFVRALHGKELTSVESTLMMMLDLPRDTTQLFEWGIDPRRALMSWNADDPNLMVCEVVTICKASPSRIVPLTSPGYEEWSLLERKTILQQGIVYNRLRQEMKETLQKFRRIMATQ

SEQ ID NO: 1151 - protein, 300 aa, Artificial
  Alicyclobacillus acidocaldarius mutated SEQ ID NO 1140
MPRLSKDALVPPEKRDTFIAWLINKRDELGFTQKDMADFLGLSLSYYNAIENRKRNLSAKLVIQLASKLPQGPRFAVQLLGPEVVGKYMNLIQLPPEKEEEYEAEDALLDAIQQREKSATDYLGLLRSVLHHSNAVMAVSVQPNLCWFGLTPEDVAIITPVTDLKALIPGQLVYVVDRTAQAGEFAFVRALHGKELTSVESTLMMMLDLPRDTTQLFEWGIDPRRALMSWNADDPNLMVCEVVTICKASPSRIVPITSPGYEEWSLLERKTILQQGIVYNRLRQEMKETLQKFRRIMATQ

SEQ ID NO: 1152 - DNA, 903 bp, Artificial
  Alicyclobacillus acidocaldarius mutated SEQ ID NO 1141
atgcccagactttcgaaagatgcgctggttccaccggaaaagcgcgataccttcattgcatggctcatcaacaagcgagatgagctgggatttacgcagaaagacatggccgactttctcgggctttcgctttcctactacaacgccattgagaatcggaaacggaacctgagtgccaagctggtcatccagttggcgtcgaaactgccccagggcccgcgttttgcggtgcagttattggggccggaagtcgtcgggaagtacatgaacttgattcagcttccgccggagaaggaagaggagtatgaggcggaggatgccctattggacgcgattcagcagcgtgagaagtcggccaccgactatctcggcctgttacggagcgtcattcatcactccaatgcggtcatggctgtgagcgtacaaccgaacctgtgctggtttgggttgacgccggaggatgtcgccatcattacgccggtgaccgatctcaaagcgttgatacccggacagctggtgtatgtagtcgaccgaacggcccaagcaggcgagtttgcgtttgtgcgggcactgcatgggaaggaactcacgagtgtcgaatcgaccctcatgatgatgctcgaccttccacgggatacgacgcaactgtttgaatggggtattgaccctcgacgtgcgcttatgtcttggaatgctgacgatcccaacctcatggtctgcgaagtcgtcaccatctgcaaggcttcaccgtcacgtatcgttccgcttacatcgccaggatatgaggagtggagtttactcgagcgcaaaaccattctccagcaaggtatcgtgtataaccgactgcggcaagagatgaaggagacgcttcagaaatttcgccgtatcatggcaacgcaatag

SEQ ID NO: 1153 - DNA, 903 bp, Artificial
  Alicyclobacillus acidocaldarius mutated SEQ ID NO 1141
atgcccagactttcgaaagatgcgctggttccaccggaaaagcgcgataccttcattgcatggctcatcaacaagcgagatgagctgggatttacgcagcgtgacatggccgactttctcgggctttcgctttcctactacaacgccattgagaatcggaaacggaacctgagtgccaagctggtcatccagttggcgtcgaaactgccccagggcccgcgttttgcggtgcagttattggggccggaagtcgtcgggaagtacatgaacttgattcagcttccgccggagaaggaagaggagtatgaggcggaggatgccctattggacgcgattcagcagcgtgagaagtcggccaccgactatctcggcctgttacggagcgtcttgcatcactccaatgcggtcatggctgtgagcgtacaaccgaacctgtgctggtttgggttgacgccggaggatgtcgccatcattacgccggtgaccgatctcaaagcgttgatacccggacagctggtgtatgtagtcgaccgaacggcccaagcaggcgagtttgcgtttgtgcgggcactgcatgggaaggaactcacgagtgtcgaatcgaccctcatgatgatgctcgaccttccacgggatacgacgcaactgtttgaatggggtattgaccctcgacgtgcgcttatgtcttggaatgctgacgatcccaacctcatggtctgcgaagtcgtcaccatctgcaaggcttcaccgtcacgtatcgttccgcttacatcgccaggatatgaggagtggagtttactcgagcgcaaaaccattctccagcaaggtatcgtgtataaccgactgcggcaagagatgaaggagacgcttcagaaatttcgccgtatcatggcaacgcaatag

SEQ ID NO: 1154 - DNA, 903 bp, Artificial
  Alicyclobacillus acidocaldarius mutated SEQ ID NO 1141
atgcccagactttcgaaagatgcgctggttccaccggaaaagcgcgataccttcattgcatggctcatcaacaagcgagatgagctgggatttacgcagaaagacatggccgactttctcgggctttcgctttcctactacaacgccattgagaatcggaaacggaacctgagtgccaagctggtcatccagttggcgtcgaaactgccccagggcccgcgttttgcggtgcagttattggggccggaagtcgtcgggaagtacatgaacttgattcagcttccgccggagaaggaagaggagtatgaggcggaggatgccctattggacgcgattcagcagcgtgagaagtcggccaccgactatctcggcctgttaaaaagcgtcttgcatcactccaatgcggtcatggctgtgagcgtacaaccgaacctgtgctggtttgggttgacgccggaggatgtcgccatcattacgccggtgaccgatctcaaagcgttgatacccggacagctggtgtatgtagtcgaccgaacggcccaagcaggcgagtttgcgtttgtgcgggcactgcatgggaaggaactcacgagtgtcgaatcgaccctcatgatgatgctcgaccttccacgggatacgacgcaactgtttgaatggggtattgaccctcgacgtgcgcttatgtcttggaatgctgacgatcccaacctcatggtctgcgaagtcgtcaccatctgcaaggcttcaccgtcacgtatcgttccgcttacatcgccaggatatgaggagtggagtttactcgagcgcaaaaccattctccagcaaggtatcgtgtataaccgactgcggcaagagatgaaggagacgcttcagaaatttcgccgtatcatggcaacgcaatag

SEQ ID NO: 1155 - DNA, 903 bp, Artificial
  Alicyclobacillus acidocaldarius mutated SEQ ID NO 1141
atgcccagactttcgaaagatgcgctggttccaccggaaaagcgcgataccttcattgcatggctcatcaacaagcgagatgagctgggatttacgcagaaagacatggccgactttctcgggctttcgctttcctactacaacgccattgagaatcggaaacggaacctgagtgccaagctggtcatccagttggcgtcgaaactgccccagggcccgcgttttgcggtgcagttattggggccggaagtcgtcgggaagtacatgaacttgattcagcttccgccggagaaggaagaggagtatgaggcggaggatgccctattggacgcgattcagcagcgtgagaagtcggccaccgactatctcggcctgttacggagcgtcttgcatcactccaatgcggtcatggctgtgagcattcaaccgaacctgtgctggtttgggttgacgccggaggatgtcgccatcattacgccggtgaccgatctcaaagcgttgatacccggacagctggtgtatgtagtcgaccgaacggcccaagcaggcgagtttgcgtttgtgcgggcactgcatgggaaggaactcacgagtgtcgaatcgaccctcatgatgatgctcgaccttccacgggatacgacgcaactgtttgaatggggtattgaccctcgacgtgcgcttatgtcttggaatgctgacgatcccaacctcatggtctgcgaagtcgtcaccatctgcaaggcttcaccgtcacgtatcgttccgcttacatcgccaggatatgaggagtggagtttactcgagcgcaaaaccattctccagcaaggtatcgtgtataaccgactgcggcaagagatgaaggagacgcttcagaaatttcgccgtatcatggcaacgcaatag

SEQ ID NO: 1156 - DNA, 903 bp, Artificial
  Alicyclobacillus acidocaldarius mutated SEQ ID NO 1141
atgcccagactttcgaaagatgcgctggttccaccggaaaagcgcgataccttcattgcatggctcatcaacaagcgagatgagctgggatttacgcagaaagacatggccgactttctcgggctttcgctttcctactacaacgccattgagaatcggaaacggaacctgagtgccaagctggtcatccagttggcgtcgaaactgccccagggcccgcgttttgcggtgcagttattggggccggaagtcgtcgggaagtacatgaacttgattcagcttccgccggagaaggaagaggagtatgaggcggaggatgccctattggacgcgattcagcagcgtgagaagtcggccaccgactatctcggcctgttacggagcgtcttgcatcactccaatgcggtcatggctgtgagcgtacaaccgaacctgtgctggtttgggttgacgccggaggatgtcgccatcattacgccggtgaccgatctcaaagcgttgatacccggacagctggtgtatgtagtcgaccgaacggcccaagcaggcgagtttgcgtttgtgcgggcactgcatgggaaggaactcacgagtgtcgaatcgaccctcatgatgatgctcgaccttccacgggatacgacgcaactgtttgaatggggtattgaccctcgacgtgcgcttatgtcttggaatgctgacgatcccaacctcatggtctgcgaagtcgtcaccatctgcaaggcttcaccgtcacgtatcgttccgattacatcgccaggatatgaggagtggagtttactcgagcgcaaaaccattctccagcaaggtatcgtgtataaccgactgcggcaagagatgaaggagacgcttcagaaatttcgccgtatcatggcaacgcaatag

SEQ ID NO: 1157 - protein, 388 aa, Alicyclobacillus acidocaldarius
MRMGKADEWEARSEQRADEVSRALVRMGVMTHGQLTRLLGINPKSERDLIRRWWDRFEEQHNVAKWVASSRYSVPGNRVMRLVRLTDAALTEWAEREGIRRARNRVKPRMLAQTINMGEVLIALRRDGALYDEWDMMLPQDGDEGLHAWLVKQDDPDYRMGLFLLPTRLTQEEQGKKGLIYHGVIRRVIQNTKIRDTLFLVPRKYYTVALRLLSYIEQVGGGLYVLPFEAFLKNPGWYLDSIYRGESQQRASLIDVLRPVRKLNMPLQYQFAALVQLPDGRYRMIDTYTSGDVKRVQNWIRFVLGYQVPNTGQVAGADVYVFDETMREGLDAVLRMKSKKRFDVSMVEVHAWPEGMVTPKPGRDELRDAFDEVDDSHIDWDAWLNEPW

SEQ ID NO: 1158 - DNA, 1167 bp, Alicyclobacillus acidocaldarius
atgcggatggggaaagcggacgaatgggaagcgcgatcggagcagcgagccgacgaggtgagccgcgcattggtgcgaatgggcgtgatgacgcacggacagctgacgcgcttactcggaatcaacccgaagagcgaacgtgacctcatacggcggtggtgggacagattcgaggagcagcacaacgtggcgaagtgggtggcgtcaagtcgatacagcgttcctggcaatcgcgtgatgcggttggtgcgattgacagatgctgcgttgaccgagtgggcggaacgagaaggaattcgacgcgcgcgcaaccgggtaaagccacgcatgctcgcacagaccatcaacatgggtgaagtgcttatcgcactacgtcgagatggtgcgctgtatgacgagtgggacatgatgctcccgcaggacggggacgaaggactccacgcatggcttgtgaaacaggatgacccagactatcgcatggggttgttcttattgccgacacgcctcacgcaagaagaacagggtaagaagggcctcatttatcatggcgtgattcgacgcgtaattcaaaacacgaaaatacgggacacgctgtttctggtgccgagaaagtattacacggtggcgctccggttgttgtcgtacattgagcaagttggcggcgggctgtatgtgttgccctttgaagcgtttctcaagaaccctggttggtatttggacagcatttacagaggtgagtcgcagcaacgcgcgtcgctcatagatgtccttcgcccggttcgaaagttgaatatgcctctccaatatcagtttgcagcgctggtgcaattgccagatggtcgttatcgaatgatcgatacgtacacgagcggggatgtgaagcgggtacagaattggattcgctttgtgctcggctaccaagtcccgaacaccggccaggtcgcgggcgcggacgtgtacgtgttcgacgagacgatgcgcgaggggcttgatgccgtcttgcggatgaaatcgaagaagcgcttcgacgtgagcatggtcgaggtccacgcctggccggagggcatggtgacaccaaagccgggtcgagatgagctgcgggatgcgttcgacgaggtggacgattcgcacatcgactgggacgcgtggctgaatgagccgtggtaa

SEQ ID NO: 1159 - protein, 106 aa, Clostridium difficile
YAIIGKRIRNYRKRAGYSQEALAKKAGLFHAYLGQIERGESKASLRSIFKIANALEMPLEILFENIIQNEKDPETLSSEAYELIDSLTSKEQKAIIKLLKEIIEYR

SEQ ID NO: 1160 - protein, 112 aa, Salmonella enterica
MADLQAPEWVGAECARRTLSRLSPRKLSTMKAPVIFANEVATGLFGHLVGAIAGGAVYRKSTFLLDSLGKQILPEWLTIEEHPHLRKGLASSPFDSEGVRTERRDIVKDGVL

SEQ ID NO: 1161 - protein, 105 aa, Rhodoferax ferrireducens
MNIGMAREQDKLAMQSSLPTEAQRVLVREHPCKSVELLRLMGVSDEDQLDIVRWHHEVNESHGLAHNVMARRLLRLADGFVAKMAARKTRLAMSPLGAAKSVFLG

SEQ ID NO: 1162 - protein, 120 aa, Methylophilales bacterium
IKQNNFSEAIKLGESLIANSGQLDHIRINKKLIECSMMLSQIDKANLYLKKLSLNDPDYKFYQALIYQKLSRNEKAMKIYQELIRSGYRNASIYQNLGYEFASLGQHKLAQNYYTEAINI

SEQ ID NO: 1163 - protein, 103 aa, Mycobacterium smegmatis
KNPRLADDIVSAVAELGPATAGQIEAHLEAEPRGRKGPWWDRSDTKWVAEALFAAGILTTATRVGFARHYDLAENVLPPEVLAREVGDEEAVRELALRAATAL

SEQ ID NO: 1164 - protein, 388 aa, Artificial
  Alicyclobacillus acidocaldarius mutated SEQ ID NO 1157
MRMGKADEWEARSEQRADEVSRALVRMGVMTHGQLTRLLGINPKSERDLIRRWWDRFEEQHNVAKWVASSRYSVPGNRVMRLVRLTDAALTEWAEREGIRRARNRVKPRMLAQTINMGEVLIALRRDGALYDEWDMMLPQDGDEGLHAWLVKQDDPDYRMGLFLLPTRLTQEEQGKKGLIYHGVIRRVIQNTKIRDTLFLVPRKYYTVALRLLSYLEQVGGGLYVLPFEAFLKNPGWYLDSIYRGESQQRASLIDVLRPVRKLNMPLQYQFAALVQLPDGRYRMIDTYTSGDVKRVQNWIRFVLGYQVPNTGQVAGADVYVFDETMREGLDAVLRMKSKKRFDVSMVEVHAWPEGMVTPKPGRDELRDAFDEVDDSHIDWDAWLNEPW

SEQ ID NO: 1165 - protein, 388 aa, Artificial
  Alicyclobacillus acidocaldarius mutated SEQ ID NO 1157
MRMGKADEWEARSEQRADEVSRALVRMGVMTHGQLTRLLGINPKSERDLIRRWWDRFEEQHNVAKWVASSRYSVPGNRVMRLVRLTDAALTEWAEREGIRRARNRVKPRMLAQTINMGEVLIALRRDGALYDEWDMMLPQDGDEGLHAWLVKQDDPDYRMGLFLLPTRLTQEEQGKKGLIYHGVIRRIIQNTKIRDTLFLVPRKYYTVALRLLSYIEQVGGGLYVLPFEAFLKNPGWYLDSIYRGESQQRASLIDVLRPVRKLNMPLQYQFAALVQLPDGRYRMIDTYTSGDVKRVQNWIRFVLGYQVPNTGQVAGADVYVFDETMREGLDAVLRMKSKKRFDVSMVEVHAWPEGMVTPKPGRDELRDAFDEVDDSHIDWDAWLNEPW

SEQ ID NO: 1166 - protein, 388 aa, Artificial
  Alicyclobacillus acidocaldarius mutated SEQ ID NO 1157
MRMGKADEWEARSEQRADEVSRALVRMGVMTHGQLTRLLGINPKSERDLIRRWWDRFEEQHNVAKWVASSRYSVPGNRVMRLVRLTDAALTEWAEREGIRRARNRVKPRMLAQTINMGEVLIALRRDGALYDEWDMMLPQDGDEGLHAWLVKQDDPDYRMGLFLLPTRLTQEEQGKKGLIYHGVIRRVIQNTKIRDTLFLVPRKYYTVAIRLLSYIEQVGGGLYVLPFEAFLKNPGWYLDSIYRGESQQRASLIDVLRPVRKLNMPLQYQFAALVQLPDGRYRMIDTYTSGDVKRVQNWIRFVLGYQVPNTGQVAGADVYVFDETMREGLDAVLRMKSKKRFDVSMVEVHAWPEGMVTPKPGRDELRDAFDEVDDSHIDWDAWLNEPW

SEQ ID NO: 1167 - protein, 388 aa, Artificial
  Alicyclobacillus acidocaldarius mutated SEQ ID NO 1157
MRMGKADEWEARSEQRADEVSRALVRMGVMTHGQLTRLLGINPKSERDLIRRWWDRFEEQHNVAKWVASSRYSVPGNRVMRLVRLTDAALTEWAEREGIRRARNRVKPRMLAQTINMGEVLIALRRDGALYDEWDMMLPQDGDEGLHAWLVKQDDPDYRMGLFLLPTRLTQEEQGKKGLIYHGVIRRVIQNTKIRDTLFLVPRKYYTVALRLLSYIEQVGGGLYVLPFEAFLKNPGWYLDSIYRGESQQRASLIDVLRPVRKLNMPLQYNFAALVQLPDGRYRMIDTYTSGDVKRVQNWIRFVLGYQVPNTGQVAGADVYVFDETMREGLDAVLRMKSKKRFDVSMVEVHAWPEGMVTPKPGRDELRDAFDEVDDSHIDWDAWLNEPW

SEQ ID NO: 1168 - protein, 388 aa, Artificial
  Alicyclobacillus acidocaldarius mutated SEQ ID NO 1157
MRMGKADEWEARSEQRADEVSRALVRMGVMTHGQLTRLLGINPKSERDLIRRWWDRFEEQHNVAKWVASSRYSVPGNRVMRLVRLTDAALTEWAEREGIRRARNRVKPRMLAQTINMGEVLIALRRDGALYDEWDMMLPNDGDEGLHAWLVKQDDPDYRMGLFLLPTRLTQEEQGKKGLIYHGVIRRVIQNTKIRDTLFLVPRKYYTVALRLLSYIEQVGGGLYVLPFEAFLKNPGWYLDSIYRGESQQRASLIDVLRPVRKLNMPLQYQFAALVQLPDGRYRMIDTYTSGDVKRVQNWIRFVLGYQVPNTGQVAGADVYVFDETMREGLDAVLRMKSKKRFDVSMVEVHAWPEGMVTPKPGRDELRDAFDEVDDSHIDWDAWLNEPW

SEQ ID NO: 1169 - DNA, 1167 bp, Artificial
  Alicyclobacillus acidocaldarius mutated SEQ ID NO 1158
atgcggatggggaaagcggacgaatgggaagcgcgatcggagcagcgagccgacgaggtgagccgcgcattggtgcgaatgggcgtgatgacgcacggacagctgacgcgcttactcggaatcaacccgaagagcgaacgtgacctcatacggcggtggtgggacagattcgaggagcagcacaacgtggcgaagtgggtggcgtcaagtcgatacagcgttcctggcaatcgcgtgatgcggttggtgcgattgacagatgctgcgttgaccgagtgggcggaacgagaaggaattcgacgcgcgcgcaaccgggtaaagccacgcatgctcgcacagaccatcaacatgggtgaagtgcttatcgcactacgtcgagatggtgcgctgtatgacgagtgggacatgatgctcccgcaggacggggacgaaggactccacgcatggcttgtgaaacaggatgacccagactatcgcatggggttgttcttattgccgacacgcctcacgcaagaagaacagggtaagaagggcctcatttatcatggcgtgattcgacgcgtaattcaaaacacgaaaatacgggacacgctgtttctggtgccgagaaagtattacacggtggcgctccggttgttgtcgtacttagagcaagttggcggcgggctgtatgtgttgccctttgaagcgtttctcaagaaccctggttggtatttggacagcatttacagaggtgagtcgcagcaacgcgcgtcgctcatagatgtccttcgcccggttcgaaagttgaatatgcctctccaatatcagtttgcagcgctggtgcaattgccagatggtcgttatcgaatgatcgatacgtacacgagcggggatgtgaagcgggtacagaattggattcgctttgtgctcggctaccaagtcccgaacaccggccaggtcgcgggcgcggacgtgtacgtgttcgacgagacgatgcgcgaggggcttgatgccgtcttgcggatgaaatcgaagaagcgcttcgacgtgagcatggtcgaggtccacgcctggccggagggcatggtgacaccaaagccgggtcgagatgagctgcgggatgcgttcgacgaggtggacgattcgcacatcgactgggacgcgtggctgaatgagccgtggtaa

SEQ ID NO: 1170 - DNA, 1167 bp, Artificial
  Alicyclobacillus acidocaldarius mutated SEQ ID NO 1158
atgcggatggggaaagcggacgaatgggaagcgcgatcggagcagcgagccgacgaggtgagccgcgcattggtgcgaatgggcgtgatgacgcacggacagctgacgcgcttactcggaatcaacccgaagagcgaacgtgacctcatacggcggtggtgggacagattcgaggagcagcacaacgtggcgaagtgggtggcgtcaagtcgatacagcgttcctggcaatcgcgtgatgcggttggtgcgattgacagatgctgcgttgaccgagtgggcggaacgagaaggaattcgacgcgcgcgcaaccgggtaaagccacgcatgctcgcacagaccatcaacatgggtgaagtgcttatcgcactacgtcgagatggtgcgctgtatgacgagtgggacatgatgctcccgcaggacggggacgaaggactccacgcatggcttgtgaaacaggatgacccagactatcgcatggggttgttcttattgccgacacgcctcacgcaagaagaacagggtaagaagggcctcatttatcatggcgtgattcgacgcattattcaaaacacgaaaatacgggacacgctgtttctggtgccgagaaagtattacacggtggcgctccggttgttgtcgtacattgagcaagttggcggcgggctgtatgtgttgccctttgaagcgtttctcaagaaccctggttggtatttggacagcatttacagaggtgagtcgcagcaacgcgcgtcgctcatagatgtccttcgcccggttcgaaagttgaatatgcctctccaatatcagtttgcagcgctggtgcaattgccagatggtcgttatcgaatgatcgatacgtacacgagcggggatgtgaagcgggtacagaattggattcgctttgtgctcggctaccaagtcccgaacaccggccaggtcgcgggcgcggacgtgtacgtgttcgacgagacgatgcgcgaggggcttgatgccgtcttgcggatgaaatcgaagaagcgcttcgacgtgagcatggtcgaggtccacgcctggccggagggcatggtgacaccaaagccgggtcgagatgagctgcgggatgcgttcgacgaggtggacgattcgcacatcgactgggacgcgtggctgaatgagccgtggtaa

SEQ ID NO: 1171 - DNA, 1167 bp, Artificial
  Alicyclobacillus acidocaldarius mutated SEQ ID NO 1158
atgcggatggggaaagcggacgaatgggaagcgcgatcggagcagcgagccgacgaggtgagccgcgcattggtgcgaatgggcgtgatgacgcacggacagctgacgcgcttactcggaatcaacccgaagagcgaacgtgacctcatacggcggtggtgggacagattcgaggagcagcacaacgtggcgaagtgggtggcgtcaagtcgatacagcgttcctggcaatcgcgtgatgcggttggtgcgattgacagatgctgcgttgaccgagtgggcggaacgagaaggaattcgacgcgcgcgcaaccgggtaaagccacgcatgctcgcacagaccatcaacatgggtgaagtgcttatcgcactacgtcgagatggtgcgctgtatgacgagtgggacatgatgctcccgcaggacggggacgaaggactccacgcatggcttgtgaaacaggatgacccagactatcgcatggggttgttcttattgccgacacgcctcacgcaagaagaacagggtaagaagggcctcatttatcatggcgtgattcgacgcgtaattcaaaacacgaaaatacgggacacgctgtttctggtgccgagaaagtattacacggtggcgattcggttgttgtcgtacattgagcaagttggcggcgggctgtatgtgttgccctttgaagcgtttctcaagaaccctggttggtatttggacagcatttacagaggtgagtcgcagcaacgcgcgtcgctcatagatgtccttcgcccggttcgaaagttgaatatgcctctccaatatcagtttgcagcgctggtgcaattgccagatggtcgttatcgaatgatcgatacgtacacgagcggggatgtgaagcgggtacagaattggattcgctttgtgctcggctaccaagtcccgaacaccggccaggtcgcgggcgcggacgtgtacgtgttcgacgagacgatgcgcgaggggcttgatgccgtcttgcggatgaaatcgaagaagcgcttcgacgtgagcatggtcgaggtccacgcctggccggagggcatggtgacaccaaagccgggtcgagatgagctgcgggatgcgttcgacgaggtggacgattcgcacatcgactgggacgcgtggctgaatgagccgtggtaa

SEQ ID NO: 1172 - DNA, 1167 bp, Artificial
  Alicyclobacillus acidocaldarius mutated SEQ ID NO 1158
atgcggatggggaaagcggacgaatgggaagcgcgatcggagcagcgagccgacgaggtgagccgcgcattggtgcgaatgggcgtgatgacgcacggacagctgacgcgcttactcggaatcaacccgaagagcgaacgtgacctcatacggcggtggtgggacagattcgaggagcagcacaacgtggcgaagtgggtggcgtcaagtcgatacagcgttcctggcaatcgcgtgatgcggttggtgcgattgacagatgctgcgttgaccgagtgggcggaacgagaaggaattcgacgcgcgcgcaaccgggtaaagccacgcatgctcgcacagaccatcaacatgggtgaagtgcttatcgcactacgtcgagatggtgcgctgtatgacgagtgggacatgatgctcccgcaggacggggacgaaggactccacgcatggcttgtgaaacaggatgacccagactatcgcatggggttgttcttattgccgacacgcctcacgcaagaagaacagggtaagaagggcctcatttatcatggcgtgattcgacgcgtaattcaaaacacgaaaatacgggacacgctgtttctggtgccgagaaagtattacacggtggcgctccggttgttgtcgtacattgagcaagttggcggcgggctgtatgtgttgccctttgaagcgtttctcaagaaccctggttggtatttggacagcatttacagaggtgagtcgcagcaacgcgcgtcgctcatagatgtccttcgcccggttcgaaagttgaatatgcctctccaatataattttgcagcgctggtgcaattgccagatggtcgttatcgaatgatcgatacgtacacgagcggggatgtgaagcgggtacagaattggattcgctttgtgctcggctaccaagtcccgaacaccggccaggtcgcgggcgcggacgtgtacgtgttcgacgagacgatgcgcgaggggcttgatgccgtcttgcggatgaaatcgaagaagcgcttcgacgtgagcatggtcgaggtccacgcctggccggagggcatggtgacaccaaagccgggtcgagatgagctgcgggatgcgttcgacgaggtggacgattcgcacatcgactgggacgcgtggctgaatgagccgtggtaa

SEQ ID NO: 1173 - DNA, 1167 bp, Artificial
  Alicyclobacillus acidocaldarius mutated SEQ ID NO 1158
atgcggatggggaaagcggacgaatgggaagcgcgatcggagcagcgagccgacgaggtgagccgcgcattggtgcgaatgggcgtgatgacgcacggacagctgacgcgcttactcggaatcaacccgaagagcgaacgtgacctcatacggcggtggtgggacagattcgaggagcagcacaacgtggcgaagtgggtggcgtcaagtcgatacagcgttcctggcaatcgcgtgatgcggttggtgcgattgacagatgctgcgttgaccgagtgggcggaacgagaaggaattcgacgcgcgcgcaaccgggtaaagccacgcatgctcgcacagaccatcaacatgggtgaagtgcttatcgcactacgtcgagatggtgcgctgtatgacgagtgggacatgatgctcccgaatgacggggacgaaggactccacgcatggcttgtgaaacaggatgacccagactatcgcatggggttgttcttattgccgacacgcctcacgcaagaagaacagggtaagaagggcctcatttatcatggcgtgattcgacgcgtaattcaaaacacgaaaatacgggacacgctgtttctggtgccgagaaagtattacacggtggcgctccggttgttgtcgtacattgagcaagttggcggcgggctgtatgtgttgccctttgaagcgtttctcaagaaccctggttggtatttggacagcatttacagaggtgagtcgcagcaacgcgcgtcgctcatagatgtccttcgcccggttcgaaagttgaatatgcctctccaatatcagtttgcagcgctggtgcaattgccagatggtcgttatcgaatgatcgatacgtacacgagcggggatgtgaagcgggtacagaattggattcgctttgtgctcggctaccaagtcccgaacaccggccaggtcgcgggcgcggacgtgtacgtgttcgacgagacgatgcgcgaggggcttgatgccgtcttgcggatgaaatcgaagaagcgcttcgacgtgagcatggtcgaggtccacgcctggccggagggcatggtgacaccaaagccgggtcgagatgagctgcgggatgcgttcgacgaggtggacgattcgcacatcgactgggacgcgtggctgaatgagccgtggtaa

SEQ ID NO: 1174 - protein, 252 aa, Alicyclobacillus acidocaldarius
MAKRMHPVNKLNLEMLKNSNDPLDMLRQWGILMSTVYETLTQLTMNEDDELVTEYLSGIEELDDKIQEYLYEEAAARIAHFDERTSKVVFDQWPTGLCLVPSNFGFEIRNLPVWMLGHGAKRKHHPLYHRDRPFIRRRQLWYWLVHELKWNYLNSVASWDDSLLPKNPPRYAHMNIRFMSRNDYEIRDLDNYVVSLPMIVNALVANGLIQSDRPGYFTYSVEWVQKHEQDEVQEPTTTLRVRYLERPNVSTL

SEQ ID NO: 1175 - DNA, 759 bp, Alicyclobacillus acidocaldarius
atggcaaagaggatgcaccctgtgaacaagctcaatttggagatgcttaagaactcgaatgatccgctggatatgctgaggcaatggggcattttgatgtccacggtctatgaaactctcacgcagctcacgatgaatgaagatgatgaacttgtgacggaatacttatctgggatcgaagagctcgacgataagatccaagagtatctgtacgaagaagcggccgctagaatcgcgcatttcgatgaaaggacgagcaaagtagttttcgaccaatggccgaccgggctgtgcctggttccatccaattttggcttcgagattcggaacctccctgtatggatgctcggacatggggcaaagagaaagcatcatccgttgtatcaccgagaccgtccatttatacgtcggaggcaattgtggtattggcttgttcatgaattgaagtggaattatctgaactccgttgcatcttgggacgatagcttgctcccgaaaaacccgccgagatatgcacatatgaacatccgatttatgtctaggaacgattatgagatccgcgatttggacaactatgtcgtctctctcccaatgatagtaaatgctttggtcgccaatggactgattcaaagtgatcgacctgggtatttcacatattccgtggagtgggtacagaaacacgaacaggatgaagttcaagagccgacgaccactctaagagtgcgctaccttgaaagaccgaatgtctctacgttgtaa

SEQ ID NO: 1176 - protein, 106 aa, Xenopus laevis
GLLSETYLESHRLVKMNKTEDDELGTEELSEEELRQITEEDFYEKLAASIAPEIYGHEDVKKALLLLLVGGVDHSPRGMKIRGNINVCLMGDPGVAKSQLLSYIDR

SEQ ID NO: 1177 - protein, 18 aa, Anabaena variabilis
HGSKDQQHPLYNRDRPFI

SEQ ID NO: 1178 - protein, 18 aa, Nostoc  PCC 7120
HGSKDQQHPLYNRDRPFI

SEQ ID NO: 1179 - protein, 73 aa, Aspergillus nidulans
SRNDQELAKYGAVALRLAMLVGALVDAEERRQELQGNGRSVSYSIAWMSEEQQQRLQEILGQRHPETYLSVRY

SEQ ID NO: 1180 - protein, 84 aa, Flavobacteria bacterium
NPVHHYKMNVGLLQQNDYADFIVVEDLVNFKVSKTFINGELVAENGISNVKHVPFDRPNNFNITTKTISDFEIESTASKIRVIE

SEQ ID NO: 1181 - protein, 252 aa, Artificial
  Alicyclobacillus acidocaldarius mutated SEQ ID NO 1174
MAKRMHPVNKLNLEMLKNSNDPLDMLRQWGILMSTVYETLTQLTMNEDDELVTEYLSGIEELDDKIQEYLYEEAAARIAHFDERTSKVVFDQWPTGLCLVPSNFGFEIKNLPVWMLGHGAKRKHHPLYHRDRPFIRRRQLWYWLVHELKWNYLNSVASWDDSLLPKNPPRYAHMNIRFMSRNDYEIRDLDNYVVSLPMIVNALVANGLIQSDRPGYFTYSVEWVQKHEQDEVQEPTTTLRVRYLERPNVSTL

SEQ ID NO: 1182 - protein, 252 aa, Artificial
  Alicyclobacillus acidocaldarius mutated SEQ ID NO 1174
MAKRMHPVNKLNLEMLKNSNDPLDMLRQWGILMSTVYETLTQLTMNEDDELVTEYLSGIEELDDKIQEYLYEEAAARIAHFDERTSKVVFDQWPTGLCLVPSNFGFEIRNLPVWMLGHGAKRKHHPLYHRDRPFIRRRQLWYWLVHELKWQYLNSVASWDDSLLPKNPPRYAHMNIRFMSRNDYEIRDLDNYVVSLPMIVNALVANGLIQSDRPGYFTYSVEWVQKHEQDEVQEPTTTLRVRYLERPNVSTL

SEQ ID NO: 1183 - protein, 252 aa, Artificial
  Alicyclobacillus acidocaldarius mutated SEQ ID NO 1174
MAKRMHPVNKLNLEMLRNSNDPLDMLRQWGILMSTVYETLTQLTMNEDDELVTEYLSGIEELDDKIQEYLYEEAAARIAHFDERTSKVVFDQWPTGLCLVPSNFGFEIRNLPVWMLGHGAKRKHHPLYHRDRPFIRRRQLWYWLVHELKWNYLNSVASWDDSLLPKNPPRYAHMNIRFMSRNDYEIRDLDNYVVSLPMIVNALVANGLIQSDRPGYFTYSVEWVQKHEQDEVQEPTTTLRVRYLERPNVSTL

SEQ ID NO: 1184 - protein, 252 aa, Artificial
  Alicyclobacillus acidocaldarius mutated SEQ ID NO 1174
MAKRMHPVNKLNLEMLKNSNDPLDMLRQWGILMSTVYETLTQLTMNEDDELVTEYLSGIEELDDKIQEYLYEEAAARIAHFDERTSKVVFDQWPTGLCLVPSNFGFEIRNLPVWMLGHGAKRKHHPLYHRDRPFIRRRQLWYWLVHELKWNYLNSIASWDDSLLPKNPPRYAHMNIRFMSRNDYEIRDLDNYVVSLPMIVNALVANGLIQSDRPGYFTYSVEWVQKHEQDEVQEPTTTLRVRYLERPNVSTL

SEQ ID NO: 1185 - protein, 252 aa, Artificial
  Alicyclobacillus acidocaldarius mutated SEQ ID NO 1174
MAKRMHPVNKLNLEMLKNSNDPLDMLRQWGILMSTVYETLTQLTMNEDDELVTEYLSGIEELDDKIQEYLYEEAAARIAHFDERTSKVVFDQWPTGLCLVPSNFGFEIRNLPVWMLGHGAKRKHHPLYHRDRPFIRRRQLWYWLVHELKWNYLNSVASWDDSLLPKNPPRYAHMNIRFMSRNDYEIRDLDNYVVSLPMIVNALVANGLIQSDRPGYFTYSVEWIQKHEQDEVQEPTTTLRVRYLERPNVSTL

SEQ ID NO: 1186 - DNA, 759 bp, Artificial
  Alicyclobacillus acidocaldarius mutated SEQ ID NO 1175
atggcaaagaggatgcaccctgtgaacaagctcaatttggagatgcttaagaactcgaatgatccgctggatatgctgaggcaatggggcattttgatgtccacggtctatgaaactctcacgcagctcacgatgaatgaagatgatgaacttgtgacggaatacttatctgggatcgaagagctcgacgataagatccaagagtatctgtacgaagaagcggccgctagaatcgcgcatttcgatgaaaggacgagcaaagtagttttcgaccaatggccgaccgggctgtgcctggttccatccaattttggcttcgagattaaaaacctccctgtatggatgctcggacatggggcaaagagaaagcatcatccgttgtatcaccgagaccgtccatttatacgtcggaggcaattgtggtattggcttgttcatgaattgaagtggaattatctgaactccgttgcatcttgggacgatagcttgctcccgaaaaacccgccgagatatgcacatatgaacatccgatttatgtctaggaacgattatgagatccgcgatttggacaactatgtcgtctctctcccaatgatagtaaatgctttggtcgccaatggactgattcaaagtgatcgacctgggtatttcacatattccgtggagtgggtacagaaacacgaacaggatgaagttcaagagccgacgaccactctaagagtgcgctaccttgaaagaccgaatgtctctacgttgtaa

SEQ ID NO: 1187 - DNA, 759 bp, Artificial
  Alicyclobacillus acidocaldarius mutated SEQ ID NO 1175
atggcaaagaggatgcaccctgtgaacaagctcaatttggagatgcttaagaactcgaatgatccgctggatatgctgaggcaatggggcattttgatgtccacggtctatgaaactctcacgcagctcacgatgaatgaagatgatgaacttgtgacggaatacttatctgggatcgaagagctcgacgataagatccaagagtatctgtacgaagaagcggccgctagaatcgcgcatttcgatgaaaggacgagcaaagtagttttcgaccaatggccgaccgggctgtgcctggttccatccaattttggcttcgagattcggaacctccctgtatggatgctcggacatggggcaaagagaaagcatcatccgttgtatcaccgagaccgtccatttatacgtcggaggcaattgtggtattggcttgttcatgaattgaagtggcaatatctgaactccgttgcatcttgggacgatagcttgctcccgaaaaacccgccgagatatgcacatatgaacatccgatttatgtctaggaacgattatgagatccgcgatttggacaactatgtcgtctctctcccaatgatagtaaatgctttggtcgccaatggactgattcaaagtgatcgacctgggtatttcacatattccgtggagtgggtacagaaacacgaacaggatgaagttcaagagccgacgaccactctaagagtgcgctaccttgaaagaccgaatgtctctacgttgtaa

SEQ ID NO: 1188 - DNA, 759 bp, Artificial
  Alicyclobacillus acidocaldarius mutated SEQ ID NO 1175
atggcaaagaggatgcaccctgtgaacaagctcaatttggagatgcttcgtaactcgaatgatccgctggatatgctgaggcaatggggcattttgatgtccacggtctatgaaactctcacgcagctcacgatgaatgaagatgatgaacttgtgacggaatacttatctgggatcgaagagctcgacgataagatccaagagtatctgtacgaagaagcggccgctagaatcgcgcatttcgatgaaaggacgagcaaagtagttttcgaccaatggccgaccgggctgtgcctggttccatccaattttggcttcgagattcggaacctccctgtatggatgctcggacatggggcaaagagaaagcatcatccgttgtatcaccgagaccgtccatttatacgtcggaggcaattgtggtattggcttgttcatgaattgaagtggaattatctgaactccgttgcatcttgggacgatagcttgctcccgaaaaacccgccgagatatgcacatatgaacatccgatttatgtctaggaacgattatgagatccgcgatttggacaactatgtcgtctctctcccaatgatagtaaatgctttggtcgccaatggactgattcaaagtgatcgacctgggtatttcacatattccgtggagtgggtacagaaacacgaacaggatgaagttcaagagccgacgaccactctaagagtgcgctaccttgaaagaccgaatgtctctacgttgtaa

SEQ ID NO: 1189 - DNA, 759 bp, Artificial
  Alicyclobacillus acidocaldarius mutated SEQ ID NO 1175
atggcaaagaggatgcaccctgtgaacaagctcaatttggagatgcttaagaactcgaatgatccgctggatatgctgaggcaatggggcattttgatgtccacggtctatgaaactctcacgcagctcacgatgaatgaagatgatgaacttgtgacggaatacttatctgggatcgaagagctcgacgataagatccaagagtatctgtacgaagaagcggccgctagaatcgcgcatttcgatgaaaggacgagcaaagtagttttcgaccaatggccgaccgggctgtgcctggttccatccaattttggcttcgagattcggaacctccctgtatggatgctcggacatggggcaaagagaaagcatcatccgttgtatcaccgagaccgtccatttatacgtcggaggcaattgtggtattggcttgttcatgaattgaagtggaattatctgaactccattgcatcttgggacgatagcttgctcccgaaaaacccgccgagatatgcacatatgaacatccgatttatgtctaggaacgattatgagatccgcgatttggacaactatgtcgtctctctcccaatgatagtaaatgctttggtcgccaatggactgattcaaagtgatcgacctgggtatttcacatattccgtggagtgggtacagaaacacgaacaggatgaagttcaagagccgacgaccactctaagagtgcgctaccttgaaagaccgaatgtctctacgttgtaa

SEQ ID NO: 1190 - DNA, 759 bp, Artificial
  Alicyclobacillus acidocaldarius mutated SEQ ID NO 1175
atggcaaagaggatgcaccctgtgaacaagctcaatttggagatgcttaagaactcgaatgatccgctggatatgctgaggcaatggggcattttgatgtccacggtctatgaaactctcacgcagctcacgatgaatgaagatgatgaacttgtgacggaatacttatctgggatcgaagagctcgacgataagatccaagagtatctgtacgaagaagcggccgctagaatcgcgcatttcgatgaaaggacgagcaaagtagttttcgaccaatggccgaccgggctgtgcctggttccatccaattttggcttcgagattcggaacctccctgtatggatgctcggacatggggcaaagagaaagcatcatccgttgtatcaccgagaccgtccatttatacgtcggaggcaattgtggtattggcttgttcatgaattgaagtggaattatctgaactccgttgcatcttgggacgatagcttgctcccgaaaaacccgccgagatatgcacatatgaacatccgatttatgtctaggaacgattatgagatccgcgatttggacaactatgtcgtctctctcccaatgatagtaaatgctttggtcgccaatggactgattcaaagtgatcgacctgggtatttcacatattccgtggagtggattcagaaacacgaacaggatgaagttcaagagccgacgaccactctaagagtgcgctaccttgaaagaccgaatgtctctacgttgtaa

SEQ ID NO: 1191 - protein, 97 aa, Alicyclobacillus acidocaldarius
MGEFMCHPPVLRIGARREIRGRRIREGRHPGLSDLREFLLTEPHIRHRQADHDDHHEQPDDDLPHPPRLLSCSTIRFESEHFTPRVRHIFIHLHSRA

SEQ ID NO: 1192 - DNA, 294 bp, Alicyclobacillus acidocaldarius
atgggtgagttcatgtgtcatccccctgttttaagaattggagcgagacgcgagattcgcggtcggcgcattcgcgagggtcgacaccccggcttgtccgatttgcgcgagttcctgcttaccgaacctcacattcgtcaccgccaagccgatcacgatgaccatcacgagcaacccgatgatgatctgccgcatcctccgcgcctcctctcatgctccacgatacggtttgaaagcgagcattttacgccaagagtgcgccatattttcatccacctgcactcgcgcgcatga

SEQ ID NO: 1193 - protein, 51 aa, Leishmania braziliensis
HLSSHVAERNDQHERVDDWRGVPPKLPGSSYRYEERHPQQRHMAHHHHQPA

SEQ ID NO: 1194 - protein, 69 aa, Plasmodium vivax
KSSLKGAKKKKGRGSYTDDLAEHETTWENKKRRRSAEGDNHDEQEDDEEYEPKRKVPRKDMDDDYEHNT

SEQ ID NO: 1195 - protein, 53 aa, Bradyrhizobium  BTAi1
VVRTGAAMTIRFRRITDGDLPAIRNWLHQPHIRQWWGDPDEQYGLIDGDRDEP

SEQ ID NO: 1196 - protein, 94 aa, Geobacter bemidjiensis
LCQPPRLHDRRRHRGRRLREQGRPGQIRGVLDLHQDGRQQPLEAERDQPEVTAPPDIGLKPPLKGTGSARCRSPFSELAARLRPKKWRLFVELH

SEQ ID NO: 1197 - protein, 57 aa, Burkholderia cenocepacia
RREQHDQRQHGRRADFHPVLLADEHHGQRAADEQDHRPREPREQPHPQRQVRAARFE

SEQ ID NO: 1198 - protein, 97 aa, Artificial
  Alicyclobacillus acidocaldarius mutated SEQ ID NO 1191
MGEFMCHPPVLRIGARREIRGRRIREGRHPGLSDLREFLLTEPHIRHRQADHDDHHEQPDEDLPHPPRLLSCSTIRFESEHFTPRVRHIFIHLHSRA

SEQ ID NO: 1199 - protein, 97 aa, Artificial
  Alicyclobacillus acidocaldarius mutated SEQ ID NO 1191
MGEFMCHPPVLRIGARREIRGRRIREGRHPGLSDLREFLLTEPHIRHRQADHDDHHEQPDDDLPHPPRLLSCSTIRFESEHFTPRVRHIFIHIHSRA

SEQ ID NO: 1200 - protein, 97 aa, Artificial
  Alicyclobacillus acidocaldarius mutated SEQ ID NO 1191
MGEFMCHPPVLRIGARREIRGRRIREGRHPGLSDLREFLLTEPHIRHRQADHDDHHEQPDDDLPHPPRLLSCSTIRFESEHFTPRVRHLFIHLHSRA

SEQ ID NO: 1201 - protein, 97 aa, Artificial
  Alicyclobacillus acidocaldarius mutated SEQ ID NO 1191
MGEFMCHPPVLRIGARREIRGRRIREGRHPGLSDLREFILTEPHIRHRQADHDDHHEQPDDDLPHPPRLLSCSTIRFESEHFTPRVRHIFIHLHSRA

SEQ ID NO: 1202 - protein, 97 aa, Artificial
  Alicyclobacillus acidocaldarius mutated SEQ ID NO 1191
MGEFMCHPPVLRIGARREIRGRRIREGRHPGLSDLRDFLLTEPHIRHRQADHDDHHEQPDDDLPHPPRLLSCSTIRFESEHFTPRVRHIFIHLHSRA

SEQ ID NO: 1203 - DNA, 294 bp, Artificial
  Alicyclobacillus acidocaldarius mutated SEQ ID NO 1192
atgggtgagttcatgtgtcatccccctgttttaagaattggagcgagacgcgagattcgcggtcggcgcattcgcgagggtcgacaccccggcttgtccgatttgcgcgagttcctgcttaccgaacctcacattcgtcaccgccaagccgatcacgatgaccatcacgagcaacccgatgaagatctgccgcatcctccgcgcctcctctcatgctccacgatacggtttgaaagcgagcattttacgccaagagtgcgccatattttcatccacctgcactcgcgcgcatga

SEQ ID NO: 1204 - DNA, 294 bp, Artificial
  Alicyclobacillus acidocaldarius mutated SEQ ID NO 1192
atgggtgagttcatgtgtcatccccctgttttaagaattggagcgagacgcgagattcgcggtcggcgcattcgcgagggtcgacaccccggcttgtccgatttgcgcgagttcctgcttaccgaacctcacattcgtcaccgccaagccgatcacgatgaccatcacgagcaacccgatgatgatctgccgcatcctccgcgcctcctctcatgctccacgatacggtttgaaagcgagcattttacgccaagagtgcgccatattttcatccacattcactcgcgcgcatga

SEQ ID NO: 1205 - DNA, 294 bp, Artificial
  Alicyclobacillus acidocaldarius mutated SEQ ID NO 1192
atgggtgagttcatgtgtcatccccctgttttaagaattggagcgagacgcgagattcgcggtcggcgcattcgcgagggtcgacaccccggcttgtccgatttgcgcgagttcctgcttaccgaacctcacattcgtcaccgccaagccgatcacgatgaccatcacgagcaacccgatgatgatctgccgcatcctccgcgcctcctctcatgctccacgatacggtttgaaagcgagcattttacgccaagagtgcgccatttattcatccacctgcactcgcgcgcatga

SEQ ID NO: 1206 - DNA, 294 bp, Artificial
  Alicyclobacillus acidocaldarius mutated SEQ ID NO 1192
atgggtgagttcatgtgtcatccccctgttttaagaattggagcgagacgcgagattcgcggtcggcgcattcgcgagggtcgacaccccggcttgtccgatttgcgcgagttcattcttaccgaacctcacattcgtcaccgccaagccgatcacgatgaccatcacgagcaacccgatgatgatctgccgcatcctccgcgcctcctctcatgctccacgatacggtttgaaagcgagcattttacgccaagagtgcgccatattttcatccacctgcactcgcgcgcatga

SEQ ID NO: 1207 - DNA, 294 bp, Artificial
  Alicyclobacillus acidocaldarius mutated SEQ ID NO 1192
atgggtgagttcatgtgtcatccccctgttttaagaattggagcgagacgcgagattcgcggtcggcgcattcgcgagggtcgacaccccggcttgtccgatttgcgcgatttcctgcttaccgaacctcacattcgtcaccgccaagccgatcacgatgaccatcacgagcaacccgatgatgatctgccgcatcctccgcgcctcctctcatgctccacgatacggtttgaaagcgagcattttacgccaagagtgcgccatattttcatccacctgcactcgcgcgcatga

SEQ ID NO: 1208 - protein, 347 aa, Alicyclobacillus acidocaldarius
MLTIGLDVGNGSIGLCVRDGDTLVQDTTPSVYGRVDPTRQVLSVPGKSAPRKVDVFTFGGEHFVLGYKNVHAMHSTPIGAYDREQRYASRQFETLAKLALLDAATRTGRTGVIEVVVACGTPSEDFTTRTVEIMQRWFSEPVTGAKNGEQVVVMIKRLEVIPQPFGVFLDAYLDQDGLVVDEELEKQDVLVIDSGSGTLDLSEIHRLELTRQTSIPAGLNDVYQLILEEIRREEPKVYATAYDLEAQLRAQDGAQEFWFEYGALRMNITNLRERAMRQVWDRMQQGIQYAYPDRSSFGRVILAGGSGEAFRNYFLAWMPSIRIAPEPQLAVARGLYKYALAQGAEES

SEQ ID NO: 1209 - DNA, 1044 bp, Alicyclobacillus acidocaldarius
atgttgaccattggtctggacgtaggaaacggcagtatcggtttgtgcgtgcgcgacggggacaccctcgtccaagacaccacgccctcggtgtatggccgcgtggacccaacgaggcaggtgttgtccgtgcctggcaagtcggcaccgcgcaaagtggacgtgttcacgtttgggggcgaacacttcgtcctcggctataagaacgtccatgcgatgcacagcacgccgattggcgcttacgaccgcgagcaacgctatgcgagccggcagtttgagacgctggcgaagctggcactactggatgcggccacacggacggggcgtaccggggtgatcgaagtcgtcgtcgcgtgtggcacgccgtcagaggacttcaccacgcgcaccgtggaaatcatgcagcgctggttctctgaacccgtcaccggggcaaagaacggcgaacaagtggtggtcatgattaagcgcttggaggtcatcccgcagccatttggggtcttcctcgatgcgtatctcgaccaagatggtcttgtggtggatgaggagcttgaaaaacaagacgtactcgtgatcgacagtggctccggcacgctcgacttgagcgagattcaccgattggagctcacacgtcaaaccagcattcctgcaggcctgaacgacgtgtatcagctcatcctggaggaaatccggcgtgaagagccgaaagtgtacgcaaccgcgtacgacctggaagctcaattgagagcacaagacggagcacaagaattttggttcgaatacggcgcacttcggatgaacatcaccaatcttcgcgagcgcgccatgcggcaggtctgggatcgcatgcaacagggcatccaatatgcgtaccctgaccgttcgagttttgggcgcgtgattctcgcaggcggctccggcgaggccttccgcaactacttcctcgcttggatgccgagtattcgtatcgctcctgaaccgcaattggcggtggcaaggggactgtacaagtacgcattggcacaaggggcggaagaatcatga

SEQ ID NO: 1210 - protein, 289 aa, Bacillus cereus
KLKTYKVEGTEYVWGDDIIKVNNTLNTYAQQNRYKTNQYKTLSKIALAEMAAKTNVKSYDEILVITGVPSEEIGTKAVDEIKEVYQGAHDLEVNGKKVSINVVDVIVLAQPVGTVMSRYLDEDGFVADDTYEDMTVGIIDIGTGTTDLDVISMLRREKESTSVPKGMHDVYEPIVAKIKKETSATINDYKLEKVFEEGAYQASKRMDPIDFNDEKTASIKEVYDFIVNGVNNAWKTFDRFDEVLVSDGGANTFHELLEEWIGKVTKLEESQTANVEGFYRYGKFEVGEE

SEQ ID NO: 1211 - protein, 263 aa, Lactobacillus paracasei
RYNSEAFKLLANFALGLLASDFKIANNQVLEVVVTAGLPTGDYADQERLRSLLKVLEGQHQVTIDDQIVTVRVRKVYILPQPIGTLYNELLDDQGFIKNKALLDEKVGIVDVGGGTILIDTILNFELSGKNRQQFNTGVNDLYEAIASRIEGDVSLYQLEKELRHGNQQHQWSYRFSKNRQDDITELVGKESDRFTRRLVANVTSTLKNLDSIDTLFFTGGGANLINQKILKTTFTNAAIVKDTEVANVNGFYKYGLSQQVQE

SEQ ID NO: 1212 - protein, 323 aa, Natranaerobius thermophilus
VGIDLGYGYVKFIDGKEPKMFPSVVGYGNSQKYKSALQLDLNPLDDLQIKIGDEHFFIGDLAIRQSEVASRSLGKDRSQDKNARVLMLTALSLLSSWDKQGFNLVTGLPTNFYAAFAEEWESTLNGEFKTKMKIGGKTQERSFQIEEVTTLPQPFGTLYDQVLNSVGKVVDRDLTDSKIGIVDIGFKTTDLAVSDGMEFINPLSFSTTTGLSNVNRLVNEKLRHEFKIDREEHQLDDCINSQKIMVAGKSEDISSWVREALQTVSDKISVEIESKWDYRDFDTLLLTGGGGEMLYPYLKDKFPNLVLVEDPQTANVRGYQKLA

SEQ ID NO: 1213 - protein, 297 aa, Bacillus weihenstephanensis
VYTYEGIRYVIGEAQGISSSARNDDRYSSAGYRTETILAISQLVKDGSEIVVGTGLPSEDYKNGDNHEKVKRNLVGEHTVQIDGKTKTFSILRVYTPMQPIGSVVNRIYDYNLKVRKDMESERTARKLVIDIGFGTTDVCEAEGLRIVRYDGVQVGMLEANRIIKDELSKRGARGIVSLLHMDTLLRNAKREYVKDEFTDKEILSKVIIEIGGKEYEIKDLMEQALEYTARIVMQRVDNLGYVLKDYDVVLFTGGSLLALHKYIKPYLTGVNTKAEQGAQTANVKGYTKYAMIQDAK

SEQ ID NO: 1214 - protein, 182 aa, Clostridium beijerinckii
VRVITGLPAQFFAEQKNSLIKALENRRVFMKLNGENRSFTITKVIVFPQSAGLFLYDKSLVEKDTLVVDIGGGTLDIAYMSNGQFKEGRTYPLGVNPTYDVLLQELTKYGVNYSNRMKAEQIIADKAIFVEGKEIDVSKDIDNVLSLRAGEIINAIKQAFPEQSKYSRFVFIGGGALLLKNY

SEQ ID NO: 1215 - protein, 347 aa, Artificial
  Alicyclobacillus acidocaldarius mutated SEQ ID NO 1208
MLTIGLEVGNGSIGLCVRDGDTLVQDTTPSVYGRVDPTRQVLSVPGKSAPRKVDVFTFGGEHFVLGYKNVHAMHSTPIGAYDREQRYASRQFETLAKLALLDAATRTGRTGVIEVVVACGTPSEDFTTRTVEIMQRWFSEPVTGAKNGEQVVVMIKRLEVIPQPFGVFLDAYLDQDGLVVDEELEKQDVLVIDSGSGTLDLSEIHRLELTRQTSIPAGLNDVYQLILEEIRREEPKVYATAYDLEAQLRAQDGAQEFWFEYGALRMNITNLRERAMRQVWDRMQQGIQYAYPDRSSFGRVILAGGSGEAFRNYFLAWMPSIRIAPEPQLAVARGLYKYALAQGAEES

SEQ ID NO: 1216 - protein, 347 aa, Artificial
  Alicyclobacillus acidocaldarius mutated SEQ ID NO 1208
MLTIGLDVGNGSIGLCVRDGDTLVQDTTPSVYGRVDPTRQVLSVPGKSAPRKVDVFTFGGEHFVLGYKNVHAMHSTPIGAYDREQRYASRQFETLAKLALLDAATRTGRTGVIEVVVACGTPSEDFTTRTVEIMQRWFSEPVTGAKNGEQVVVMIKRLEVIPQPFGVFLDAYLDQDGLVVDEELEKQDVLVIDSGSGTLDLSEIHRLELTRQTSIPAGLNDVYQLILEEIRKEEPKVYATAYDLEAQLRAQDGAQEFWFEYGALRMNITNLRERAMRQVWDRMQQGIQYAYPDRSSFGRVILAGGSGEAFRNYFLAWMPSIRIAPEPQLAVARGLYKYALAQGAEES

SEQ ID NO: 1217 - protein, 347 aa, Artificial
  Alicyclobacillus acidocaldarius mutated SEQ ID NO 1208
MLTIGLDVGNGSIGLCVRDGDTLVQDTTPSVYGRVDPTRQVLSVPGKSAPRKVDVFTFGGEHFVLGYKNVHAMHSTPIGAYDREQRYASRQFETLAKLALLDAATRTGRTGVIEVIVACGTPSEDFTTRTVEIMQRWFSEPVTGAKNGEQVVVMIKRLEVIPQPFGVFLDAYLDQDGLVVDEELEKQDVLVIDSGSGTLDLSEIHRLELTRQTSIPAGLNDVYQLILEEIRREEPKVYATAYDLEAQLRAQDGAQEFWFEYGALRMNITNLRERAMRQVWDRMQQGIQYAYPDRSSFGRVILAGGSGEAFRNYFLAWMPSIRIAPEPQLAVARGLYKYALAQGAEES

SEQ ID NO: 1218 - protein, 347 aa, Artificial
  Alicyclobacillus acidocaldarius mutated SEQ ID NO 1208
MLTIGLDVGNGSIGLCVRDGDTLVQDTTPSVYGRVDPTRQVLSVPGKSAPRKVDVFTFGGEHFVLGYKNVHAMHSTPIGAYDREQRYASRQFETLAKLALLDAATRTGRTGVIEVVVACGTPSEDFTTRTVEIMQRWFSEPVTGAKNGEQVVVMIKRLEVIPQPFGVFLDAYLDQDGLVVDEELEKQDVLVIDSGSGTLDLSEIHRLELTRQTSIPAGLNDVYQLILEEIRREEPKVYATAYDLEAQLRAQDGAQEFWFEYGALRMNITNLRERAMRQIWDRMQQGIQYAYPDRSSFGRVILAGGSGEAFRNYFLAWMPSIRIAPEPQLAVARGLYKYALAQGAEES

SEQ ID NO: 1219 - protein, 347 aa, Artificial
  Alicyclobacillus acidocaldarius mutated SEQ ID NO 1208
MLTIGLDVGNGSIGLCVRDGDTLVQDTTPSVYGRVDPTRQVLSVPGKSAPRKVDVFTFGGEHFVLGYKNVHAMHSTPIGAYDREQRYASRQFETLAKLALLDAATRTGRTGVIEVVVACGTPSEDFTTRTVEIMQRWFSEPVTGAKNGEQVVVMIKRLEVIPQPFGVFLDAYLDQDGLVVDEELEKQDVLVIDSGSGTLDLSEIHRLELTRQTSIPAGLNDVYQLILEEIRREEPKVYATAYDLEAQLRANDGAQEFWFEYGALRMNITNLRERAMRQVWDRMQQGIQYAYPDRSSFGRVILAGGSGEAFRNYFLAWMPSIRIAPEPQLAVARGLYKYALAQGAEES

SEQ ID NO: 1220 - DNA, 1044 bp, Artificial
  Alicyclobacillus acidocaldarius mutated SEQ ID NO 1209
atgttgaccattggtctggaagtaggaaacggcagtatcggtttgtgcgtgcgcgacggggacaccctcgtccaagacaccacgccctcggtgtatggccgcgtggacccaacgaggcaggtgttgtccgtgcctggcaagtcggcaccgcgcaaagtggacgtgttcacgtttgggggcgaacacttcgtcctcggctataagaacgtccatgcgatgcacagcacgccgattggcgcttacgaccgcgagcaacgctatgcgagccggcagtttgagacgctggcgaagctggcactactggatgcggccacacggacggggcgtaccggggtgatcgaagtcgtcgtcgcgtgtggcacgccgtcagaggacttcaccacgcgcaccgtggaaatcatgcagcgctggttctctgaacccgtcaccggggcaaagaacggcgaacaagtggtggtcatgattaagcgcttggaggtcatcccgcagccatttggggtcttcctcgatgcgtatctcgaccaagatggtcttgtggtggatgaggagcttgaaaaacaagacgtactcgtgatcgacagtggctccggcacgctcgacttgagcgagattcaccgattggagctcacacgtcaaaccagcattcctgcaggcctgaacgacgtgtatcagctcatcctggaggaaatccggcgtgaagagccgaaagtgtacgcaaccgcgtacgacctggaagctcaattgagagcacaagacggagcacaagaattttggttcgaatacggcgcacttcggatgaacatcaccaatcttcgcgagcgcgccatgcggcaggtctgggatcgcatgcaacagggcatccaatatgcgtaccctgaccgttcgagttttgggcgcgtgattctcgcaggcggctccggcgaggccttccgcaactacttcctcgcttggatgccgagtattcgtatcgctcctgaaccgcaattggcggtggcaaggggactgtacaagtacgcattggcacaaggggcggaagaatcatga

SEQ ID NO: 1221 - DNA, 1044 bp, Artificial
  Alicyclobacillus acidocaldarius mutated SEQ ID NO 1209
atgttgaccattggtctggacgtaggaaacggcagtatcggtttgtgcgtgcgcgacggggacaccctcgtccaagacaccacgccctcggtgtatggccgcgtggacccaacgaggcaggtgttgtccgtgcctggcaagtcggcaccgcgcaaagtggacgtgttcacgtttgggggcgaacacttcgtcctcggctataagaacgtccatgcgatgcacagcacgccgattggcgcttacgaccgcgagcaacgctatgcgagccggcagtttgagacgctggcgaagctggcactactggatgcggccacacggacggggcgtaccggggtgatcgaagtcgtcgtcgcgtgtggcacgccgtcagaggacttcaccacgcgcaccgtggaaatcatgcagcgctggttctctgaacccgtcaccggggcaaagaacggcgaacaagtggtggtcatgattaagcgcttggaggtcatcccgcagccatttggggtcttcctcgatgcgtatctcgaccaagatggtcttgtggtggatgaggagcttgaaaaacaagacgtactcgtgatcgacagtggctccggcacgctcgacttgagcgagattcaccgattggagctcacacgtcaaaccagcattcctgcaggcctgaacgacgtgtatcagctcatcctggaggaaatccggaaagaagagccgaaagtgtacgcaaccgcgtacgacctggaagctcaattgagagcacaagacggagcacaagaattttggttcgaatacggcgcacttcggatgaacatcaccaatcttcgcgagcgcgccatgcggcaggtctgggatcgcatgcaacagggcatccaatatgcgtaccctgaccgttcgagttttgggcgcgtgattctcgcaggcggctccggcgaggccttccgcaactacttcctcgcttggatgccgagtattcgtatcgctcctgaaccgcaattggcggtggcaaggggactgtacaagtacgcattggcacaaggggcggaagaatcatga

SEQ ID NO: 1222 - DNA, 1044 bp, Artificial
  Alicyclobacillus acidocaldarius mutated SEQ ID NO 1209
atgttgaccattggtctggacgtaggaaacggcagtatcggtttgtgcgtgcgcgacggggacaccctcgtccaagacaccacgccctcggtgtatggccgcgtggacccaacgaggcaggtgttgtccgtgcctggcaagtcggcaccgcgcaaagtggacgtgttcacgtttgggggcgaacacttcgtcctcggctataagaacgtccatgcgatgcacagcacgccgattggcgcttacgaccgcgagcaacgctatgcgagccggcagtttgagacgctggcgaagctggcactactggatgcggccacacggacggggcgtaccggggtgatcgaagtcattgtcgcgtgtggcacgccgtcagaggacttcaccacgcgcaccgtggaaatcatgcagcgctggttctctgaacccgtcaccggggcaaagaacggcgaacaagtggtggtcatgattaagcgcttggaggtcatcccgcagccatttggggtcttcctcgatgcgtatctcgaccaagatggtcttgtggtggatgaggagcttgaaaaacaagacgtactcgtgatcgacagtggctccggcacgctcgacttgagcgagattcaccgattggagctcacacgtcaaaccagcattcctgcaggcctgaacgacgtgtatcagctcatcctggaggaaatccggcgtgaagagccgaaagtgtacgcaaccgcgtacgacctggaagctcaattgagagcacaagacggagcacaagaattttggttcgaatacggcgcacttcggatgaacatcaccaatcttcgcgagcgcgccatgcggcaggtctgggatcgcatgcaacagggcatccaatatgcgtaccctgaccgttcgagttttgggcgcgtgattctcgcaggcggctccggcgaggccttccgcaactacttcctcgcttggatgccgagtattcgtatcgctcctgaaccgcaattggcggtggcaaggggactgtacaagtacgcattggcacaaggggcggaagaatcatga

SEQ ID NO: 1223 - DNA, 1044 bp, Artificial
  Alicyclobacillus acidocaldarius mutated SEQ ID NO 1209
atgttgaccattggtctggacgtaggaaacggcagtatcggtttgtgcgtgcgcgacggggacaccctcgtccaagacaccacgccctcggtgtatggccgcgtggacccaacgaggcaggtgttgtccgtgcctggcaagtcggcaccgcgcaaagtggacgtgttcacgtttgggggcgaacacttcgtcctcggctataagaacgtccatgcgatgcacagcacgccgattggcgcttacgaccgcgagcaacgctatgcgagccggcagtttgagacgctggcgaagctggcactactggatgcggccacacggacggggcgtaccggggtgatcgaagtcgtcgtcgcgtgtggcacgccgtcagaggacttcaccacgcgcaccgtggaaatcatgcagcgctggttctctgaacccgtcaccggggcaaagaacggcgaacaagtggtggtcatgattaagcgcttggaggtcatcccgcagccatttggggtcttcctcgatgcgtatctcgaccaagatggtcttgtggtggatgaggagcttgaaaaacaagacgtactcgtgatcgacagtggctccggcacgctcgacttgagcgagattcaccgattggagctcacacgtcaaaccagcattcctgcaggcctgaacgacgtgtatcagctcatcctggaggaaatccggcgtgaagagccgaaagtgtacgcaaccgcgtacgacctggaagctcaattgagagcacaagacggagcacaagaattttggttcgaatacggcgcacttcggatgaacatcaccaatcttcgcgagcgcgccatgcggcagatttgggatcgcatgcaacagggcatccaatatgcgtaccctgaccgttcgagttttgggcgcgtgattctcgcaggcggctccggcgaggccttccgcaactacttcctcgcttggatgccgagtattcgtatcgctcctgaaccgcaattggcggtggcaaggggactgtacaagtacgcattggcacaaggggcggaagaatcatga

SEQ ID NO: 1224 - DNA, 1044 bp, Artificial
  Alicyclobacillus acidocaldarius mutated SEQ ID NO 1209
atgttgaccattggtctggacgtaggaaacggcagtatcggtttgtgcgtgcgcgacggggacaccctcgtccaagacaccacgccctcggtgtatggccgcgtggacccaacgaggcaggtgttgtccgtgcctggcaagtcggcaccgcgcaaagtggacgtgttcacgtttgggggcgaacacttcgtcctcggctataagaacgtccatgcgatgcacagcacgccgattggcgcttacgaccgcgagcaacgctatgcgagccggcagtttgagacgctggcgaagctggcactactggatgcggccacacggacggggcgtaccggggtgatcgaagtcgtcgtcgcgtgtggcacgccgtcagaggacttcaccacgcgcaccgtggaaatcatgcagcgctggttctctgaacccgtcaccggggcaaagaacggcgaacaagtggtggtcatgattaagcgcttggaggtcatcccgcagccatttggggtcttcctcgatgcgtatctcgaccaagatggtcttgtggtggatgaggagcttgaaaaacaagacgtactcgtgatcgacagtggctccggcacgctcgacttgagcgagattcaccgattggagctcacacgtcaaaccagcattcctgcaggcctgaacgacgtgtatcagctcatcctggaggaaatccggcgtgaagagccgaaagtgtacgcaaccgcgtacgacctggaagctcaattgagagcaaatgacggagcacaagaattttggttcgaatacggcgcacttcggatgaacatcaccaatcttcgcgagcgcgccatgcggcaggtctgggatcgcatgcaacagggcatccaatatgcgtaccctgaccgttcgagttttgggcgcgtgattctcgcaggcggctccggcgaggccttccgcaactacttcctcgcttggatgccgagtattcgtatcgctcctgaaccgcaattggcggtggcaaggggactgtacaagtacgcattggcacaaggggcggaagaatcatga

SEQ ID NO: 1225 - protein, 95 aa, Alicyclobacillus acidocaldarius
MTIRRYVLSYDDEYDREIAEVIEQTPKRRRAERVRQLILLGIQAEAEMRGEGGMKPVQTGSPASDDSSIPPSPQTPQSGSSTGKRPVIPRITPKS

SEQ ID NO: 1226 - DNA, 288 bp, Alicyclobacillus acidocaldarius
atgacgattcgcagatacgtcctctcctatgacgacgaatatgaccgtgaaatcgccgaggtcattgaacaaacaccgaaacgccggcgcgctgagcgcgtccggcagctcatcttacttggcattcaagctgaggctgaaatgcgaggcgagggcggtatgaaacccgttcagacgggttcacccgcctcggatgactcgtcaatcccgccttctccccaaacgcctcagtcggggtcctcgacagggaaacgccccgtcattccacgtatcacgccaaaatcatag

SEQ ID NO: 1227 - protein, 69 aa, Leishmania infantum
LVSTWPQSRRFLESRILQTADMQAEDMISGDGGSQHIEDDSVSVTPSTSAPSPAPRSAAATGAPPLAPR

SEQ ID NO: 1228 - protein, 37 aa, Bacillus cereus
MANKTYLLSYDDVLDKDIKEWLESLPRNRKAEMVRAI

SEQ ID NO: 1229 - protein, 47 aa, Bradyrhizobium  ORS278
QGAGGLSGMQSSSPSSSSSTPSSTGLEPRSGGAGGGQPLMPNVRITP

SEQ ID NO: 1230 - protein, 66 aa, Coprinopsis cinerea
QTVIVKRRAKPEPTGYDGNPTNAAASPAFSTTTQLTASPPSLFPNSPPTGTSSGIRPLIPHIVPPS

SEQ ID NO: 1231 - protein, 67 aa, Arthrobacter aurescens
RRLAERLTARLNEIYAERQLMAVGGSEWAAPGAAPQSNPGIPASTATPAHMMAQAGSSTGADPVLAR

SEQ ID NO: 1232 - protein, 95 aa, Artificial
  Alicyclobacillus acidocaldarius mutated SEQ ID NO 1225
MTIRRYVLSYDDEYDREIAEVIEQTPKRKRAERVRQLILLGIQAEAEMRGEGGMKPVQTGSPASDDSSIPPSPQTPQSGSSTGKRPVIPRITPKS

SEQ ID NO: 1233 - protein, 95 aa, Artificial
  Alicyclobacillus acidocaldarius mutated SEQ ID NO 1225
MTIRRYVLSYDDEYEREIAEVIEQTPKRRRAERVRQLILLGIQAEAEMRGEGGMKPVQTGSPASDDSSIPPSPQTPQSGSSTGKRPVIPRITPKS

SEQ ID NO: 1234 - protein, 95 aa, Artificial
  Alicyclobacillus acidocaldarius mutated SEQ ID NO 1225
MTIRRYVLSYDDEYDREIAEVIEQTPKRRRAEKVRQLILLGIQAEAEMRGEGGMKPVQTGSPASDDSSIPPSPQTPQSGSSTGKRPVIPRITPKS

SEQ ID NO: 1235 - protein, 95 aa, Artificial
  Alicyclobacillus acidocaldarius mutated SEQ ID NO 1225
MTIRRYVISYDDEYDREIAEVIEQTPKRRRAERVRQLILLGIQAEAEMRGEGGMKPVQTGSPASDDSSIPPSPQTPQSGSSTGKRPVIPRITPKS

SEQ ID NO: 1236 - protein, 95 aa, Artificial
  Alicyclobacillus acidocaldarius mutated SEQ ID NO 1225
MTIRRYVLSYDDEYDREIAEVLEQTPKRRRAERVRQLILLGIQAEAEMRGEGGMKPVQTGSPASDDSSIPPSPQTPQSGSSTGKRPVIPRITPKS

SEQ ID NO: 1237 - DNA, 288 bp, Artificial
  Alicyclobacillus acidocaldarius mutated SEQ ID NO 1226
atgacgattcgcagatacgtcctctcctatgacgacgaatatgaccgtgaaatcgccgaggtcattgaacaaacaccgaaacgcaaacgcgctgagcgcgtccggcagctcatcttacttggcattcaagctgaggctgaaatgcgaggcgagggcggtatgaaacccgttcagacgggttcacccgcctcggatgactcgtcaatcccgccttctccccaaacgcctcagtcggggtcctcgacagggaaacgccccgtcattccacgtatcacgccaaaatcatag

SEQ ID NO: 1238 - DNA, 288 bp, Artificial
  Alicyclobacillus acidocaldarius mutated SEQ ID NO 1226
atgacgattcgcagatacgtcctctcctatgacgacgaatatgaacgtgaaatcgccgaggtcattgaacaaacaccgaaacgccggcgcgctgagcgcgtccggcagctcatcttacttggcattcaagctgaggctgaaatgcgaggcgagggcggtatgaaacccgttcagacgggttcacccgcctcggatgactcgtcaatcccgccttctccccaaacgcctcagtcggggtcctcgacagggaaacgccccgtcattccacgtatcacgccaaaatcatag

SEQ ID NO: 1239 - DNA, 288 bp, Artificial
  Alicyclobacillus acidocaldarius mutated SEQ ID NO 1226
atgacgattcgcagatacgtcctctcctatgacgacgaatatgaccgtgaaatcgccgaggtcattgaacaaacaccgaaacgccggcgcgctgagaaagtccggcagctcatcttacttggcattcaagctgaggctgaaatgcgaggcgagggcggtatgaaacccgttcagacgggttcacccgcctcggatgactcgtcaatcccgccttctccccaaacgcctcagtcggggtcctcgacagggaaacgccccgtcattccacgtatcacgccaaaatcatag

SEQ ID NO: 1240 - DNA, 288 bp, Artificial
  Alicyclobacillus acidocaldarius mutated SEQ ID NO 1226
atgacgattcgcagatacgtcatttcctatgacgacgaatatgaccgtgaaatcgccgaggtcattgaacaaacaccgaaacgccggcgcgctgagcgcgtccggcagctcatcttacttggcattcaagctgaggctgaaatgcgaggcgagggcggtatgaaacccgttcagacgggttcacccgcctcggatgactcgtcaatcccgccttctccccaaacgcctcagtcggggtcctcgacagggaaacgccccgtcattccacgtatcacgccaaaatcatag

SEQ ID NO: 1241 - DNA, 288 bp, Artificial
  Alicyclobacillus acidocaldarius mutated SEQ ID NO 1226
atgacgattcgcagatacgtcctctcctatgacgacgaatatgaccgtgaaatcgccgaggtcttagaacaaacaccgaaacgccggcgcgctgagcgcgtccggcagctcatcttacttggcattcaagctgaggctgaaatgcgaggcgagggcggtatgaaacccgttcagacgggttcacccgcctcggatgactcgtcaatcccgccttctccccaaacgcctcagtcggggtcctcgacagggaaacgccccgtcattccacgtatcacgccaaaatcatag

SEQ ID NO: 1242 - protein, 178 aa, Alicyclobacillus acidocaldarius
MCKMWTKRWTDFLAVSILTATVTGCGTIPHAVSQTSSTAIPAPSVHAVVDRLPGHLQAKLIGFDVRKKRVSHLPIAVKGTNVLYISPMEQYAIQQFQQIWPRLKAYPVVVWTGVTKAQAEMVWRKEGYPGDPLPSQQTEYVSQTIPTPDAYHRDGKAWVEVPGILPASQLEDWVTFFR

SEQ ID NO: 1243 - DNA, 537 bp, Alicyclobacillus acidocaldarius
atgtgcaagatgtggacaaaacggtggacagatttccttgccgtatcgatactcacggcgacggttacggggtgcgggacgattccgcatgcggtgtcacagacatcttcgaccgcaatacccgcgccgtctgtgcacgcggtggtagataggctcccggggcatctccaagcgaagctgatcgggtttgacgtgcgcaagaagcgcgtcagccatctgccgatcgcggtgaagggcacaaatgtgctgtacatctcgccaatggagcaatacgcgatccagcaatttcagcagatttggccgcgtctgaaggcgtatcccgtggtggtatggacgggcgtgactaaggcgcaagcggagatggtgtggcgtaaggagggctatcccggcgaccctcttccgtctcagcaaacagaatacgtgtcgcagaccattccgacgccggatgcgtatcaccgtgacggcaaggcgtgggtggaggtgccggggattttgcctgcttcacaactggaggattgggtgacatttttccgctga

SEQ ID NO: 1244 - protein, 54 aa, Tribolium castaneum
RRKSKEENKLDREKSDYAPESVPIVGEENGVHYYEDGHFWMEVPGLLPESEEED

SEQ ID NO: 1245 - protein, 68 aa, Trichomonas vaginalis
LQAEFINFENAENIGFSLKQSSKLVISEQRSNKNYQKFWQRLWSAMTMPLALWEGATSKKIEMIYQRD

SEQ ID NO: 1246 - protein, 82 aa, Arthrobacter chlorophenolicus
IPAKAGEAHLERLLRHVHSRAGLEAAPSRIEDQLDHVARTVKGRNLLFVVADEIPASPALEQLLRRLRAQHEILWLTIRDAE

SEQ ID NO: 1247 - protein, 103 aa, Stigmatella aurantiaca
QGKLNRIDVASKRVTPIPFHVKGTRTLFARVHSPQAQAVVPERFPVKMLRWVQVSPKGDRVVYQALGHLYTRELPDGLPRRLTKQTEHFEMHPSFSRDGKSIV

SEQ ID NO: 1248 - protein, 95 aa, Prochlorococcus marinus
PLRLRCWRISMRTMVQRAAAELGIEVIPSRRTYALLDWLAERERDVYPLEEGYMAGPLAPPPTPIPTPPVPLPEAVRGDAWSWASLPLGLLREAQ

SEQ ID NO: 1249 - protein, 178 aa, Artificial
  Alicyclobacillus acidocaldarius mutated SEQ ID NO 1242
MCKMWTKRWTDFLAVSILTATVTGCGTIPHAVSQTSSTAIPAPSVHAVVDRLPGHLQAKLIGFDIRKKRVSHLPIAVKGTNVLYISPMEQYAIQQFQQIWPRLKAYPVVVWTGVTKAQAEMVWRKEGYPGDPLPSQQTEYVSQTIPTPDAYHRDGKAWVEVPGILPASQLEDWVTFFR

SEQ ID NO: 1250 - protein, 178 aa, Artificial
  Alicyclobacillus acidocaldarius mutated SEQ ID NO 1242
MCKMWTKRWTDFLAVSILTATVTGCGTIPHAVSQTSSTAIPAPSVHAVVDRLPGHLQAKLIGFDVRKKRVSHLPIAVKGTNVLYISPMEQYAIQQFQQIWPRLKAYPVVVWTGVTRAQAEMVWRKEGYPGDPLPSQQTEYVSQTIPTPDAYHRDGKAWVEVPGILPASQLEDWVTFFR

SEQ ID NO: 1251 - protein, 178 aa, Artificial
  Alicyclobacillus acidocaldarius mutated SEQ ID NO 1242
MCKMWTKRWTDFLAVSILTATVTGCGTIPHAVSQTSSTAIPAPSVHAVVDKLPGHLQAKLIGFDVRKKRVSHLPIAVKGTNVLYISPMEQYAIQQFQQIWPRLKAYPVVVWTGVTKAQAEMVWRKEGYPGDPLPSQQTEYVSQTIPTPDAYHRDGKAWVEVPGILPASQLEDWVTFFR

SEQ ID NO: 1252 - protein, 178 aa, Artificial
  Alicyclobacillus acidocaldarius mutated SEQ ID NO 1242
MCKMWTKRWTDFLAVSILTATVTGCGTIPHAVSQTSSTAIPAPSVHAVVDRLPGHLQAKLIGFDVRKKRVSHLPLAVKGTNVLYISPMEQYAIQQFQQIWPRLKAYPVVVWTGVTKAQAEMVWRKEGYPGDPLPSQQTEYVSQTIPTPDAYHRDGKAWVEVPGILPASQLEDWVTFFR

SEQ ID NO: 1253 - protein, 178 aa, Artificial
  Alicyclobacillus acidocaldarius mutated SEQ ID NO 1242
MCKMWTKRWTDFLAVSILTATVTGCGTIPHAVSQTSSTAIPAPSVHAVVDRLPGHLQARLIGFDVRKKRVSHLPIAVKGTNVLYISPMEQYAIQQFQQIWPRLKAYPVVVWTGVTKAQAEMVWRKEGYPGDPLPSQQTEYVSQTIPTPDAYHRDGKAWVEVPGILPASQLEDWVTFFR

SEQ ID NO: 1254 - DNA, 537 bp, Artificial
  Alicyclobacillus acidocaldarius mutated SEQ ID NO 1243
atgtgcaagatgtggacaaaacggtggacagatttccttgccgtatcgatactcacggcgacggttacggggtgcgggacgattccgcatgcggtgtcacagacatcttcgaccgcaatacccgcgccgtctgtgcacgcggtggtagataggctcccggggcatctccaagcgaagctgatcgggtttgacattcgcaagaagcgcgtcagccatctgccgatcgcggtgaagggcacaaatgtgctgtacatctcgccaatggagcaatacgcgatccagcaatttcagcagatttggccgcgtctgaaggcgtatcccgtggtggtatggacgggcgtgactaaggcgcaagcggagatggtgtggcgtaaggagggctatcccggcgaccctcttccgtctcagcaaacagaatacgtgtcgcagaccattccgacgccggatgcgtatcaccgtgacggcaaggcgtgggtggaggtgccggggattttgcctgcttcacaactggaggattgggtgacatttttccgctga

SEQ ID NO: 1255 - DNA, 537 bp, Artificial
  Alicyclobacillus acidocaldarius mutated SEQ ID NO 1243
atgtgcaagatgtggacaaaacggtggacagatttccttgccgtatcgatactcacggcgacggttacggggtgcgggacgattccgcatgcggtgtcacagacatcttcgaccgcaatacccgcgccgtctgtgcacgcggtggtagataggctcccggggcatctccaagcgaagctgatcgggtttgacgtgcgcaagaagcgcgtcagccatctgccgatcgcggtgaagggcacaaatgtgctgtacatctcgccaatggagcaatacgcgatccagcaatttcagcagatttggccgcgtctgaaggcgtatcccgtggtggtatggacgggcgtgactcgtgcgcaagcggagatggtgtggcgtaaggagggctatcccggcgaccctcttccgtctcagcaaacagaatacgtgtcgcagaccattccgacgccggatgcgtatcaccgtgacggcaaggcgtgggtggaggtgccggggattttgcctgcttcacaactggaggattgggtgacatttttccgctga

SEQ ID NO: 1256 - DNA, 537 bp, Artificial
  Alicyclobacillus acidocaldarius mutated SEQ ID NO 1243
atgtgcaagatgtggacaaaacggtggacagatttccttgccgtatcgatactcacggcgacggttacggggtgcgggacgattccgcatgcggtgtcacagacatcttcgaccgcaatacccgcgccgtctgtgcacgcggtggtagataaactcccggggcatctccaagcgaagctgatcgggtttgacgtgcgcaagaagcgcgtcagccatctgccgatcgcggtgaagggcacaaatgtgctgtacatctcgccaatggagcaatacgcgatccagcaatttcagcagatttggccgcgtctgaaggcgtatcccgtggtggtatggacgggcgtgactaaggcgcaagcggagatggtgtggcgtaaggagggctatcccggcgaccctcttccgtctcagcaaacagaatacgtgtcgcagaccattccgacgccggatgcgtatcaccgtgacggcaaggcgtgggtggaggtgccggggattttgcctgcttcacaactggaggattgggtgacatttttccgctga

SEQ ID NO: 1257 - DNA, 537 bp, Artificial
  Alicyclobacillus acidocaldarius mutated SEQ ID NO 1243
atgtgcaagatgtggacaaaacggtggacagatttccttgccgtatcgatactcacggcgacggttacggggtgcgggacgattccgcatgcggtgtcacagacatcttcgaccgcaatacccgcgccgtctgtgcacgcggtggtagataggctcccggggcatctccaagcgaagctgatcgggtttgacgtgcgcaagaagcgcgtcagccatctgccgttagcggtgaagggcacaaatgtgctgtacatctcgccaatggagcaatacgcgatccagcaatttcagcagatttggccgcgtctgaaggcgtatcccgtggtggtatggacgggcgtgactaaggcgcaagcggagatggtgtggcgtaaggagggctatcccggcgaccctcttccgtctcagcaaacagaatacgtgtcgcagaccattccgacgccggatgcgtatcaccgtgacggcaaggcgtgggtggaggtgccggggattttgcctgcttcacaactggaggattgggtgacatttttccgctga

SEQ ID NO: 1258 - DNA, 537 bp, Artificial
  Alicyclobacillus acidocaldarius mutated SEQ ID NO 1243
atgtgcaagatgtggacaaaacggtggacagatttccttgccgtatcgatactcacggcgacggttacggggtgcgggacgattccgcatgcggtgtcacagacatcttcgaccgcaatacccgcgccgtctgtgcacgcggtggtagataggctcccggggcatctccaagcgcgtctgatcgggtttgacgtgcgcaagaagcgcgtcagccatctgccgatcgcggtgaagggcacaaatgtgctgtacatctcgccaatggagcaatacgcgatccagcaatttcagcagatttggccgcgtctgaaggcgtatcccgtggtggtatggacgggcgtgactaaggcgcaagcggagatggtgtggcgtaaggagggctatcccggcgaccctcttccgtctcagcaaacagaatacgtgtcgcagaccattccgacgccggatgcgtatcaccgtgacggcaaggcgtgggtggaggtgccggggattttgcctgcttcacaactggaggattgggtgacatttttccgctga

SEQ ID NO: 1259 - protein, 256 aa, Alicyclobacillus acidocaldarius
MDMAWEPSQDPYTLLQDFSCFYGTDVKGPNSVLTQKDMMAIRNNIVEVSRGWRQLGPNKVELLEPLMDPSAVSGAFVYLAKHHEDWSLSDWPKVYLAFIRTVDSQTLTFEPNGNVIYTYKRGTGLTPNVTGVFEKGVDTVYSSYSYSDQIGVEAYKEDDPSLNSKIFYEPDYQVFSPKTHLSNYHYSYPGYVPPSNGQIAFELWGTVCDPYTARVGGAIFIEGMYEFTYYNGHLVNAHQIGQESENYPSEVTRYGD

SEQ ID NO: 1260 - DNA, 771 bp, Alicyclobacillus acidocaldarius
gtggacatggcgtgggagccgtcgcaagacccatacacgctgttgcaggacttctcgtgcttctacgggacggacgtgaaggggccgaacagcgtgctgacccagaaggacatgatggcgatccgcaacaacatcgtggaggtcagccgtgggtggcggcagttggggccgaataaggtggaacttctagaaccgttgatggatccgagtgctgtatccggagccttcgtttacttagccaaacatcacgaagattggagcctgtcggactggccaaaggtgtatctggcattcatccgaactgtggacagtcaaactctcacattcgaaccgaatggcaatgtgatttacacgtacaagcggggaacaggattaacgcctaacgtaacgggcgtgtttgaaaagggagtcgacaccgtatacagctcctattcctattcggatcagataggagtagaagcgtataaagaagacgatccatcccttaatagcaaaatattttatgaaccagactatcaagtgttttctcctaagacgcatttgtcaaattatcactatagctatcccggatatgtgccgccatcaaacgggcaaattgcctttgagttatggggaaccgtatgcgatccatatacagctagagttggaggagcgatttttatcgagggtatgtatgaattcacttactataacggtcacctagttaatgcacatcaaattggtcaagagtccgaaaattacccgtcggaagtgactagatatggggactag

SEQ ID NO: 1261 - protein, 136 aa, Methanospirillum hungatei
PSEVSGNFLSALNKLSLDDYSKIITSIESGFSTNLDSIIQLLERKGQIILYGPPGTGKTYSVQSLIKKTASTPYISTTKDYGNIQFFWLITYKDKYDDISTINSKSIYTYQWKSNYNYSKYFYMINEGDYFAIYLW

SEQ ID NO: 1262 - protein, 59 aa, Coprinopsis cinerea
YPGYIPPSSAQIESALRGTIYDALIRRIMWEGVRGKWGVPSTHQGEDGEERYSEIDTWG

SEQ ID NO: 1263 - protein, 65 aa, Blastopirellula marina
RLHRSNYTYTYTASGGTLSFSQWACVALTFDGYQYRFYKNGFLISTHGIGGSPVNNPAASVWIGD

SEQ ID NO: 1264 - protein, 51 aa, Psychromonas ingrahamii
SYSYNDEVGTLDYILASASLKDKIVDSMYWNINSSESSLFEYSTKYTGYLP

SEQ ID NO: 1265 - protein, 67 aa, Syntrophus aciditrophicus
HSYRAGAGLTYNLTEISDLGLDYAYSKSDYDEEDKVDSTKDTVSMAYRHFFRERRDIVTVTPFYSRY

SEQ ID NO: 1266 - protein, 256 aa, Artificial
  Alicyclobacillus acidocaldarius mutated SEQ ID NO 1259
MDMAWEPSQDPYTLLQDFSCFYGTDVKGPNSVITQKDMMAIRNNIVEVSRGWRQLGPNKVELLEPLMDPSAVSGAFVYLAKHHEDWSLSDWPKVYLAFIRTVDSQTLTFEPNGNVIYTYKRGTGLTPNVTGVFEKGVDTVYSSYSYSDQIGVEAYKEDDPSLNSKIFYEPDYQVFSPKTHLSNYHYSYPGYVPPSNGQIAFELWGTVCDPYTARVGGAIFIEGMYEFTYYNGHLVNAHQIGQESENYPSEVTRYGD

SEQ ID NO: 1267 - protein, 256 aa, Artificial
  Alicyclobacillus acidocaldarius mutated SEQ ID NO 1259
MDMAWEPSQDPYTLLQDFSCFYGTDVKGPNSVLTQKDMMAIRNNIVEVSRGWRQLGPNKVELLEPLMDPSAVSGAFVYLAKHHEDWSLSDWPKVYLAFIRTVDSQTLTFEPNGNVIYTYKKGTGLTPNVTGVFEKGVDTVYSSYSYSDQIGVEAYKEDDPSLNSKIFYEPDYQVFSPKTHLSNYHYSYPGYVPPSNGQIAFELWGTVCDPYTARVGGAIFIEGMYEFTYYNGHLVNAHQIGQESENYPSEVTRYGD

SEQ ID NO: 1268 - protein, 256 aa, Artificial
  Alicyclobacillus acidocaldarius mutated SEQ ID NO 1259
MDMAWEPSQDPYTLLQDFSCFYGTDVKGPNSVLTQKDMMAIRNNIVEVSRGWRQLGPNKVELLEPLMDPSAVSGAFVYLAKHHEDWSLSDWPKVYLAFIRTVDSQTLTFEPNGNVIYTYKRGTGLTPNVTGVFEKGVDTVYSSYSYSDQIGVEAYKEDDPSLNSKIFYEPDYQVFSPKTHLSNYHYSYPGYVPPSNGQIAFELWGTVCDPYTARVGGAIFIEGMYEFTYYNGHLVNAHQIGQESEQYPSEVTRYGD

SEQ ID NO: 1269 - protein, 256 aa, Artificial
  Alicyclobacillus acidocaldarius mutated SEQ ID NO 1259
MDMAWEPSQDPYTLLQDFSCFYGTDVKGPNSVLTQKDMMAIRNNIVEVSRGWRQLGPNKVELLEPLMDPSAVSGAFVYLAKHHEDWSISDWPKVYLAFIRTVDSQTLTFEPNGNVIYTYKRGTGLTPNVTGVFEKGVDTVYSSYSYSDQIGVEAYKEDDPSLNSKIFYEPDYQVFSPKTHLSNYHYSYPGYVPPSNGQIAFELWGTVCDPYTARVGGAIFIEGMYEFTYYNGHLVNAHQIGQESENYPSEVTRYGD

SEQ ID NO: 1270 - protein, 256 aa, Artificial
  Alicyclobacillus acidocaldarius mutated SEQ ID NO 1259
MDMAWEPSQDPYTLLQDFSCFYGTDVKGPNSVLTQKDMMAIRNNIVEVSRGWRQLGPNKVELLEPLMDPSAVSGAFVYLAKHHEDWSLSDWPKVYLAFIRTVDSQTLTFEPNGNVLYTYKRGTGLTPNVTGVFEKGVDTVYSSYSYSDQIGVEAYKEDDPSLNSKIFYEPDYQVFSPKTHLSNYHYSYPGYVPPSNGQIAFELWGTVCDPYTARVGGAIFIEGMYEFTYYNGHLVNAHQIGQESENYPSEVTRYGD

SEQ ID NO: 1271 - DNA, 771 bp, Artificial
  Alicyclobacillus acidocaldarius mutated SEQ ID NO 1260
gtggacatggcgtgggagccgtcgcaagacccatacacgctgttgcaggacttctcgtgcttctacgggacggacgtgaaggggccgaacagcgtgattacccagaaggacatgatggcgatccgcaacaacatcgtggaggtcagccgtgggtggcggcagttggggccgaataaggtggaacttctagaaccgttgatggatccgagtgctgtatccggagccttcgtttacttagccaaacatcacgaagattggagcctgtcggactggccaaaggtgtatctggcattcatccgaactgtggacagtcaaactctcacattcgaaccgaatggcaatgtgatttacacgtacaagcggggaacaggattaacgcctaacgtaacgggcgtgtttgaaaagggagtcgacaccgtatacagctcctattcctattcggatcagataggagtagaagcgtataaagaagacgatccatcccttaatagcaaaatattttatgaaccagactatcaagtgttttctcctaagacgcatttgtcaaattatcactatagctatcccggatatgtgccgccatcaaacgggcaaattgcctttgagttatggggaaccgtatgcgatccatatacagctagagttggaggagcgatttttatcgagggtatgtatgaattcacttactataacggtcacctagttaatgcacatcaaattggtcaagagtccgaaaattacccgtcggaagtgactagatatggggactag

SEQ ID NO: 1272 - DNA, 771 bp, Artificial
  Alicyclobacillus acidocaldarius mutated SEQ ID NO 1260
gtggacatggcgtgggagccgtcgcaagacccatacacgctgttgcaggacttctcgtgcttctacgggacggacgtgaaggggccgaacagcgtgctgacccagaaggacatgatggcgatccgcaacaacatcgtggaggtcagccgtgggtggcggcagttggggccgaataaggtggaacttctagaaccgttgatggatccgagtgctgtatccggagccttcgtttacttagccaaacatcacgaagattggagcctgtcggactggccaaaggtgtatctggcattcatccgaactgtggacagtcaaactctcacattcgaaccgaatggcaatgtgatttacacgtacaagaaaggaacaggattaacgcctaacgtaacgggcgtgtttgaaaagggagtcgacaccgtatacagctcctattcctattcggatcagataggagtagaagcgtataaagaagacgatccatcccttaatagcaaaatattttatgaaccagactatcaagtgttttctcctaagacgcatttgtcaaattatcactatagctatcccggatatgtgccgccatcaaacgggcaaattgcctttgagttatggggaaccgtatgcgatccatatacagctagagttggaggagcgatttttatcgagggtatgtatgaattcacttactataacggtcacctagttaatgcacatcaaattggtcaagagtccgaaaattacccgtcggaagtgactagatatggggactag

SEQ ID NO: 1273 - DNA, 771 bp, Artificial
  Alicyclobacillus acidocaldarius mutated SEQ ID NO 1260
gtggacatggcgtgggagccgtcgcaagacccatacacgctgttgcaggacttctcgtgcttctacgggacggacgtgaaggggccgaacagcgtgctgacccagaaggacatgatggcgatccgcaacaacatcgtggaggtcagccgtgggtggcggcagttggggccgaataaggtggaacttctagaaccgttgatggatccgagtgctgtatccggagccttcgtttacttagccaaacatcacgaagattggagcctgtcggactggccaaaggtgtatctggcattcatccgaactgtggacagtcaaactctcacattcgaaccgaatggcaatgtgatttacacgtacaagcggggaacaggattaacgcctaacgtaacgggcgtgtttgaaaagggagtcgacaccgtatacagctcctattcctattcggatcagataggagtagaagcgtataaagaagacgatccatcccttaatagcaaaatattttatgaaccagactatcaagtgttttctcctaagacgcatttgtcaaattatcactatagctatcccggatatgtgccgccatcaaacgggcaaattgcctttgagttatggggaaccgtatgcgatccatatacagctagagttggaggagcgatttttatcgagggtatgtatgaattcacttactataacggtcacctagttaatgcacatcaaattggtcaagagtccgaacaatacccgtcggaagtgactagatatggggactag

SEQ ID NO: 1274 - DNA, 771 bp, Artificial
  Alicyclobacillus acidocaldarius mutated SEQ ID NO 1260
gtggacatggcgtgggagccgtcgcaagacccatacacgctgttgcaggacttctcgtgcttctacgggacggacgtgaaggggccgaacagcgtgctgacccagaaggacatgatggcgatccgcaacaacatcgtggaggtcagccgtgggtggcggcagttggggccgaataaggtggaacttctagaaccgttgatggatccgagtgctgtatccggagccttcgtttacttagccaaacatcacgaagattggagcatttcggactggccaaaggtgtatctggcattcatccgaactgtggacagtcaaactctcacattcgaaccgaatggcaatgtgatttacacgtacaagcggggaacaggattaacgcctaacgtaacgggcgtgtttgaaaagggagtcgacaccgtatacagctcctattcctattcggatcagataggagtagaagcgtataaagaagacgatccatcccttaatagcaaaatattttatgaaccagactatcaagtgttttctcctaagacgcatttgtcaaattatcactatagctatcccggatatgtgccgccatcaaacgggcaaattgcctttgagttatggggaaccgtatgcgatccatatacagctagagttggaggagcgatttttatcgagggtatgtatgaattcacttactataacggtcacctagttaatgcacatcaaattggtcaagagtccgaaaattacccgtcggaagtgactagatatggggactag

SEQ ID NO: 1275 - DNA, 771 bp, Artificial
  Alicyclobacillus acidocaldarius mutated SEQ ID NO 1260
gtggacatggcgtgggagccgtcgcaagacccatacacgctgttgcaggacttctcgtgcttctacgggacggacgtgaaggggccgaacagcgtgctgacccagaaggacatgatggcgatccgcaacaacatcgtggaggtcagccgtgggtggcggcagttggggccgaataaggtggaacttctagaaccgttgatggatccgagtgctgtatccggagccttcgtttacttagccaaacatcacgaagattggagcctgtcggactggccaaaggtgtatctggcattcatccgaactgtggacagtcaaactctcacattcgaaccgaatggcaatgtgttatacacgtacaagcggggaacaggattaacgcctaacgtaacgggcgtgtttgaaaagggagtcgacaccgtatacagctcctattcctattcggatcagataggagtagaagcgtataaagaagacgatccatcccttaatagcaaaatattttatgaaccagactatcaagtgttttctcctaagacgcatttgtcaaattatcactatagctatcccggatatgtgccgccatcaaacgggcaaattgcctttgagttatggggaaccgtatgcgatccatatacagctagagttggaggagcgatttttatcgagggtatgtatgaattcacttactataacggtcacctagttaatgcacatcaaattggtcaagagtccgaaaattacccgtcggaagtgactagatatggggactag

SEQ ID NO: 1276 - protein, 151 aa, Alicyclobacillus acidocaldarius
MKPLRPVVSAKATERFESDPGEQAQIDLGAFLYYDSHGQRRTIWAFAMVLAYSRMLYVEFIKAADQLHILQALRNDLEFFGGVPRVMLSDNCSPLVVANDGQGHVDWQPAYLDFAKFYGFVPKACRPRRSRTKGKVERPIRYIRDSFWPVA

SEQ ID NO: 1277 - DNA, 453 bp, Alicyclobacillus acidocaldarius
atgaagccacttcgcccggtggtctctgccaaggccaccgagcgatttgagtcggatcctggtgaacaagcccagatcgatttgggggccttcctctactacgattcgcacggtcagcgacgaacgatttgggccttcgccatggtactcgcctactcccgcatgctctacgttgagtttatcaaagcggcagaccagctgcacatccttcaggcccttcgcaacgacctggagttctttggcggtgtgccgcgcgtcatgctcagcgacaactgttcacctttggtggtcgccaatgacggtcaaggccatgtcgactggcaaccggcttatctcgactttgccaagttctacggattcgtgcccaaggcatgtcggcctcgccggagccgcaccaagggcaaggtagaacggcctattcgctatatccgggacagcttctggccagttgcc

SEQ ID NO: 1278 - protein, 148 aa, Symbiobacterium thermophilum
MAPYRPMAKAAATVRFETPPGKQAQVDWADFGYIEVDGRRLKLYCFIMVLAYSRAMYLEFVTATDMKTFMRCHINAFKFFGGVPHEILYDNVKTVVKDRDDDNRPVFNERFLDFSSYYGFRPRLCLPYHAWTKGKVERPVRYIRQNFW

SEQ ID NO: 1279 - protein, 150 aa, Deinococcus geothermalis
VRPFRRTQVSAARVTTRFETAPGEQAQVDFGRYSYLNLEGQTRSIWAFVMVLGWSRALYVEFIRKADTASFIRCHLNAFAYFGGMTQSILYDNTKQVVLERDETGQPVWNPQFLDFSLRLGFSIRLCRPYRPRTKGKVESGVGYVEKNFW

SEQ ID NO: 1280 - protein, 147 aa, Methylobacterium  4-46
LRPSAPLPIERRFETPPGEQAQVDLARFEVVFADEPGVTRIVWLFAMVLGHSRYLWARFVVHQDLQTVLRCHIAAFQALGGAPREILYDRMKTAVIGEDPDGLVIYNRSLLDLARHYGFLPRACRPYRAKTKGKVERPFRYLREDFF

SEQ ID NO: 1281 - protein, 147 aa, Geobacillus stearothermophilus
MKPFRETAKKKYTVRYETLPGEQMQVDWKEVGEVVIEGKKVKLSLFVATLGYSRMKYAVFTTSQDQEHLMECLIQSFKYFGGVPKKVLFDNMKTVTDGREQGVVKWNQRFSEFASYYGFIPKVCRPYRAQTKGKVERAIQYIMDHFY

SEQ ID NO: 1282 - protein, 142 aa, Solibacter usitatus
PWREEGRERAFVRFETGPGEQSQMDWGHFGNWDGRRLYGFALTLCYSRMRYIEFTQSQDIHHLLACMVHAFRYFGGVTESVLTDRMKTVLIDQTGGELHFNQKFLQFAAYYGFVPRVCRPYRPETKGKIESSVRFVKQNFWP

SEQ ID NO: 1283 - protein, 151 aa, Artificial
  Alicyclobacillus acidocaldarius mutated SEQ ID NO 1276
MKPLRPVVSAKATERFESDPGEQAQIDLGAFLYYDSHGQRRTIWAFAMVLAYSRMLYVEFIKAADQLHILQALKNDLEFFGGVPRVMLSDNCSPLVVANDGQGHVDWQPAYLDFAKFYGFVPKACRPRRSRTKGKVERPIRYIRDSFWPVA

SEQ ID NO: 1284 - protein, 151 aa, Artificial
  Alicyclobacillus acidocaldarius mutated SEQ ID NO 1276
MKPLRPVVSAKATERFESDPGEQAQIDLGAFIYYDSHGQRRTIWAFAMVLAYSRMLYVEFIKAADQLHILQALRNDLEFFGGVPRVMLSDNCSPLVVANDGQGHVDWQPAYLDFAKFYGFVPKACRPRRSRTKGKVERPIRYIRDSFWPVA

SEQ ID NO: 1285 - protein, 151 aa, Artificial
  Alicyclobacillus acidocaldarius mutated SEQ ID NO 1276
MKPLRPVVSAKATERFESDPGEQAQIDIGAFLYYDSHGQRRTIWAFAMVLAYSRMLYVEFIKAADQLHILQALRNDLEFFGGVPRVMLSDNCSPLVVANDGQGHVDWQPAYLDFAKFYGFVPKACRPRRSRTKGKVERPIRYIRDSFWPVA

SEQ ID NO: 1286 - protein, 151 aa, Artificial
  Alicyclobacillus acidocaldarius mutated SEQ ID NO 1276
MKPLRPVVSAKATERFESDPGEQAQIDLGAFLYYDSHGQRRTIWAFAMVLAYSRMLYVEFIKAADQLHILQALRNDLEFFGGVPRVMLSDNCSPLVVANDGQGHVDWQPAYLDFAKFYGFVPKACRPRRSRTKGKVERPIKYIRDSFWPVA

SEQ ID NO: 1287 - protein, 151 aa, Artificial
  Alicyclobacillus acidocaldarius mutated SEQ ID NO 1276
MKPLRPVVSAKATERFESDPGEQAQIDLGAFLYYDSHGQRRTIWAFAMVLAYSRMLYVEFIKAADNLHILQALRNDLEFFGGVPRVMLSDNCSPLVVANDGQGHVDWQPAYLDFAKFYGFVPKACRPRRSRTKGKVERPIRYIRDSFWPVA

SEQ ID NO: 1288 - DNA, 453 bp, Artificial
  Alicyclobacillus acidocaldarius mutated SEQ ID NO 1277
atgaagccacttcgcccggtggtctctgccaaggccaccgagcgatttgagtcggatcctggtgaacaagcccagatcgatttgggggccttcctctactacgattcgcacggtcagcgacgaacgatttgggccttcgccatggtactcgcctactcccgcatgctctacgttgagtttatcaaagcggcagaccagctgcacatccttcaggcccttaaaaacgacctggagttctttggcggtgtgccgcgcgtcatgctcagcgacaactgttcacctttggtggtcgccaatgacggtcaaggccatgtcgactggcaaccggcttatctcgactttgccaagttctacggattcgtgcccaaggcatgtcggcctcgccggagccgcaccaagggcaaggtagaacggcctattcgctatatccgggacagcttctggccagttgcc

SEQ ID NO: 1289 - DNA, 453 bp, Artificial
  Alicyclobacillus acidocaldarius mutated SEQ ID NO 1277
atgaagccacttcgcccggtggtctctgccaaggccaccgagcgatttgagtcggatcctggtgaacaagcccagatcgatttgggggccttcatttactacgattcgcacggtcagcgacgaacgatttgggccttcgccatggtactcgcctactcccgcatgctctacgttgagtttatcaaagcggcagaccagctgcacatccttcaggcccttcgcaacgacctggagttctttggcggtgtgccgcgcgtcatgctcagcgacaactgttcacctttggtggtcgccaatgacggtcaaggccatgtcgactggcaaccggcttatctcgactttgccaagttctacggattcgtgcccaaggcatgtcggcctcgccggagccgcaccaagggcaaggtagaacggcctattcgctatatccgggacagcttctggccagttgcc

SEQ ID NO: 1290 - DNA, 453 bp, Artificial
  Alicyclobacillus acidocaldarius mutated SEQ ID NO 1277
atgaagccacttcgcccggtggtctctgccaaggccaccgagcgatttgagtcggatcctggtgaacaagcccagatcgatattggggccttcctctactacgattcgcacggtcagcgacgaacgatttgggccttcgccatggtactcgcctactcccgcatgctctacgttgagtttatcaaagcggcagaccagctgcacatccttcaggcccttcgcaacgacctggagttctttggcggtgtgccgcgcgtcatgctcagcgacaactgttcacctttggtggtcgccaatgacggtcaaggccatgtcgactggcaaccggcttatctcgactttgccaagttctacggattcgtgcccaaggcatgtcggcctcgccggagccgcaccaagggcaaggtagaacggcctattcgctatatccgggacagcttctggccagttgcc

SEQ ID NO: 1291 - DNA, 453 bp, Artificial
  Alicyclobacillus acidocaldarius mutated SEQ ID NO 1277
atgaagccacttcgcccggtggtctctgccaaggccaccgagcgatttgagtcggatcctggtgaacaagcccagatcgatttgggggccttcctctactacgattcgcacggtcagcgacgaacgatttgggccttcgccatggtactcgcctactcccgcatgctctacgttgagtttatcaaagcggcagaccagctgcacatccttcaggcccttcgcaacgacctggagttctttggcggtgtgccgcgcgtcatgctcagcgacaactgttcacctttggtggtcgccaatgacggtcaaggccatgtcgactggcaaccggcttatctcgactttgccaagttctacggattcgtgcccaaggcatgtcggcctcgccggagccgcaccaagggcaaggtagaacggcctattaaatatatccgggacagcttctggccagttgcc

SEQ ID NO: 1292 - DNA, 453 bp, Artificial
  Alicyclobacillus acidocaldarius mutated SEQ ID NO 1277
atgaagccacttcgcccggtggtctctgccaaggccaccgagcgatttgagtcggatcctggtgaacaagcccagatcgatttgggggccttcctctactacgattcgcacggtcagcgacgaacgatttgggccttcgccatggtactcgcctactcccgcatgctctacgttgagtttatcaaagcggcagacaatctgcacatccttcaggcccttcgcaacgacctggagttctttggcggtgtgccgcgcgtcatgctcagcgacaactgttcacctttggtggtcgccaatgacggtcaaggccatgtcgactggcaaccggcttatctcgactttgccaagttctacggattcgtgcccaaggcatgtcggcctcgccggagccgcaccaagggcaaggtagaacggcctattcgctatatccgggacagcttctggccagttgcc

SEQ ID NO: 1293 - protein, 467 aa, Alicyclobacillus acidocaldarius
MPYHVGMYIRVIRRKNKNGSVTGYVQLAHNFRDPNTGQPKAKVLYTFGREDEIDLEALRRLAQSIHRFVGDEFTAGRGQSERIQTTLLDSRPMGGAYLLDELWRQLGLDEVLRERLADRKFKAAVERVIFAMVANRALAPSSKLAMEEWVDREVALPGMTELDVWQAYRAMDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHCIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESALRTLKKFWTSVP

SEQ ID NO: 1294 - DNA, 1404 bp, Alicyclobacillus acidocaldarius
atgccgtatcatgtgggcatgtatatccgagtcattcgccgaaaaaacaagaacggttctgtcaccggttacgtgcagttggcccataactttcgcgatcccaacaccggccagcccaaggccaaggtcctctacaccttcggccgcgaagacgaaatcgacctcgaggccctccggcgccttgcccagagcatccatcgcttcgttggcgacgagtttaccgccggacgtggtcagtcggagcgcatccaaaccacgctgctggatagccgtcctatgggaggggcgtatctgctcgacgagctgtggcgacagcttggattggatgaggtcctgcgagagcggcttgccgaccggaagtttaaggcggctgtcgagcgtgtcatcttcgccatggtcgcaaatcgcgcgttggcgccaagcagcaagctggccatggaagaatgggtcgaccgtgaagtggctctccccgggatgaccgagttggacgtgtggcaggcataccgggccatggactttctccatgatgtggcggaagacctgcagtacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctgggaacacggcggatatgagcgtggtcgaggaggtcaaacaggacctcatcggttggcggcttggtcgcgtgatcacggtcgtggatcgaggtttcgtctcagagagcaatttgcggatcctgcaacgcgccggcggtcactgcatcgctggggagaagatgacctccgggaaaccagcggtggaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacttgatccgcacctccgacgacacgctgtcgacggaagatgtcgcgctgggatacaagcaactcctgatggtggagtcagcgttgcgtaccttgaaaaaattttggacatccgtcccatga

SEQ ID NO: 1295 - protein, 460 aa, Geobacillus kaustophilus
MYIRRVTRKNKDGTTVAYLQLAHNEWDPKAKYAKAKVIYSFGREDEVDRAVLERLAKSISRFLSPEQAWEVEKLTGEASDDFQFQSCKHLGGVWLLDQLWRQLGLGEILHSLFTSRHHQISLERLIFAMVANRALHPSSKLAMEEWVEKDVYIPHLPQVASHQLYRAMDELLAVQPELERQVFHAVADLLNLEVDLIYFDTTSSYFEVDPSETPEGESLRKQGFSKDKRPDLVQIVIGLAVTREGIPIRAWVWPGNTMDMTVIKQVKQDLIGWKLGRVISVMDRGFSSEENLRILQQAGGHYIVGENMRSGKAAVEEALSRRGRYHEVDENLHIKEIIVGDGEARQRYVLVYNPGEAERQRKERETLLESLKEELEGLRQLPNEAHHKATCRLRSHPSYGKYLRQLKDGTLRIDKQAVRDAEKYDGNYLIRTSDDTLSAEDVAIGYKQLVDIEQAFRTLK

SEQ ID NO: 1296 - protein, 443 aa, Geobacillus kaustophilus
YLQLAHNEWDPKAKYAKAKVIYSFGREDEVDRAVLERLAKSISRFLSPEQAWEIETLTGEVSDDFQFQSSKRLGGAWLLDQLWRQLGLGEILHSLFASRHHQIPLERLIFAMVANRALHPSSKLAMEEWVEKDVHIPHLPQVASHQLYRAMDELLAVQPELERQVFHAVADLLNLEVDLIYFDTTSSYFEVDPSETPEGESLRKQGFSKDKRPDLVQIVIGLAVTREGVPIRAWVWPGNTMDMTVIKQVKQDLIGWKLGRVISVMDRGFSSEENLRILQQAGGHYIVGEKMRSGKAAVEEALNRRGRYQQVRENLHIKEIIVGDGEARQRYVLVYNPSEAERQRKEREKLLESLKEELEGLRQLPNEAHHKATCRLRSHPSYGKYLRQLKDGTLRIDKQAVREAEKYDGKYLIRTSDDTLSAEDVALGYKQLVDIEQAFRTLK

SEQ ID NO: 1297 - protein, 443 aa, Geobacillus thermodenitrificans
YLQLAHNEWDPKAKYAKAKVIYSFGREDEVDRAVLERLAKSISRFLSPEQAWEIETLTGEVSDDFQFQSSKRLGGAWLLDQLWRQLGLGEILHSLFASRHHQIPLERLIFAMVANRALHPSSKLAMEEWVEKDVHIPHLPQGASHQLYRAMDELLAVQPELERQVFHAVADLLNLEVDLIYFDTTSSYFEVDPSETPEGESLRKQGFSKDKRPDLVQIVIGLAVTREGVPIRAWVWPGNTMDMTVIKQVKQDLIGWKLGRVISVMDRGFSSEENLRILQQAGGHYIVGEKMRSGKAAVEEALNRRGRYQQVRENLHIKEIIVGDGEARQRYVLVYNPSEAERQRKEREKLLESLKEELEGLRQLPNEAHHKATCRLRSHPSYGKYLRQLKDGTLRIDKQAVREAEKYDGKYLIRTSDDTLSAEDVALGYKQLVDIEQAFRTLK

SEQ ID NO: 1298 - protein, 456 aa, Desulfatibacillum alkenivorans
MYIRTISRKNKDGSKVEYVQLAHNYRDPKSKQARAEVLYSFGRKDQLDMEAIRRLAKSVERFLAKTGDVETQCKLQFPGEDVRFVESRPMGGVFVLKKIWDRLRISECLDKALADRQYTAPIGDAVFAMVANRALAPDSKLAVEDWAAKDVHLELDQPLKVQHLYRAMDFLLENQEAIQKEVFWSTANLLNLEVDLVFFDTTSTYFERDEEDEEGLKRYGHSKDKRKDLPQVVVGLAVTKEGLPIRSWVFPGNTPDVNTVEQIQKEMNDWKLGRVVWAMDRGMTSEENRAILQRGGGNYILGEKLRGSNMSKAVLGSPGRFTTVRDNLEIKEVTAGDGACRRRYVIVRNPKQVKRDQATRERLIRRAEQEIEAIGDLTGKKHTKAACALLSHRSMGKYVRELKSGKLKINKAKITEEEKLDGKYLLSCSDDTLSPEEIALGYKQLLEVERAFRTLK

SEQ ID NO: 1299 - protein, 348 aa, Geobacillus kaustophilus
VCSRHHQIPLERLIFAMVANRALHPSSKLAMEEWVEKDVHIPHLPQVASHQLYRAMDELLAVQPELERQVFHAVADLLNLEVDLIYFDTTSSYFEVDPSETPEGESLRKQGFSKDKRPDLVQIVIGLAVTREGVPIRAWVWPGNTMDMTVIKQVKQDLIGWKLGRVISVMDRGFSSEENLRILQQAGGHYIVGEKMRSGKAAVEEALNRRGRYQQVRENLHIKEIIVGDGEARQRYVLVYNPSEAERQRKEREKLLESLKEELEGLRQLPNEAHHKATCRLRSHPSYGKYLRQLKDGTLRIDKQAVREAEKYDGKYLIRTSDDTLSAEDVALGYKQLVDIEQAFRTLK

SEQ ID NO: 1300 - protein, 467 aa, Artificial
  Alicyclobacillus acidocaldarius mutated SEQ ID NO 1293
MPYHVGMYIRVIRRKNKNGSVTGYVQLAHNFRDPNTGQPKAKVLYTFGREDEIDLEALRRLAQSIHRFVGDEFTAGRGQSERIQTTLLDSRPMGGAYLLDELWRQLGLDEVLRERLADRKFKAAVERVIFAMVANRALAPSSKLAMEEWVDREVALPGMTELDVWQAYRAMDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHCIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQERWGNLRIDPEAVRQAAHLDGKYLIRTSDDTLSTEDVALGYKQLLMVESALRTLKKFWTSVP

SEQ ID NO: 1301 - protein, 467 aa, Artificial
  Alicyclobacillus acidocaldarius mutated SEQ ID NO 1293
MPYHVGMYIRVIRRKNKNGSVTGYVQLAHNFRDPNTGQPKAKVLYTFGREDEIDLEALRRIAQSIHRFVGDEFTAGRGQSERIQTTLLDSRPMGGAYLLDELWRQLGLDEVLRERLADRKFKAAVERVIFAMVANRALAPSSKLAMEEWVDREVALPGMTELDVWQAYRAMDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHCIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESALRTLKKFWTSVP

SEQ ID NO: 1302 - protein, 467 aa, Artificial
  Alicyclobacillus acidocaldarius mutated SEQ ID NO 1293
MPYHVGMYIRVIRRKNKNGSVTGYVQLAHNFRDPNTGQPKAKVLYTFGREDEIDLEALRRLAQSIHRFVGDEFTAGRGQSERIQTTLLDSRPMGGAYLLDELWRQLGLDEVLRERLADRKFKAAVERIIFAMVANRALAPSSKLAMEEWVDREVALPGMTELDVWQAYRAMDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHCIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESALRTLKKFWTSVP

SEQ ID NO: 1303 - protein, 467 aa, Artificial
  Alicyclobacillus acidocaldarius mutated SEQ ID NO 1293
MPYHVGMYIRVIRRKNKNGSVTGYVQLAHNFRDPNTGQPKAKVLYTFGREDEIDLEALRRLAQSIHRFVGDEFTAGRGQSERIQTTLLDSRPMGGAYLLDELWRQLGLDEVLRERLADRKFKAAVDRVIFAMVANRALAPSSKLAMEEWVDREVALPGMTELDVWQAYRAMDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHCIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESALRTLKKFWTSVP

SEQ ID NO: 1304 - protein, 467 aa, Artificial
  Alicyclobacillus acidocaldarius mutated SEQ ID NO 1293
MPYHVGMYIRVIRRKNKNGSVTGYVQLAHNFRDPNTGQPKAKVLYTFGREDEIDLEALRRLAQSIHRFVGDEFTAGRGNSERIQTTLLDSRPMGGAYLLDELWRQLGLDEVLRERLADRKFKAAVERVIFAMVANRALAPSSKLAMEEWVDREVALPGMTELDVWQAYRAMDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHCIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESALRTLKKFWTSVP

SEQ ID NO: 1305 - DNA, 1404 bp, Artificial
  Alicyclobacillus acidocaldarius mutated SEQ ID NO 1294
atgccgtatcatgtgggcatgtatatccgagtcattcgccgaaaaaacaagaacggttctgtcaccggttacgtgcagttggcccataactttcgcgatcccaacaccggccagcccaaggccaaggtcctctacaccttcggccgcgaagacgaaatcgacctcgaggccctccggcgccttgcccagagcatccatcgcttcgttggcgacgagtttaccgccggacgtggtcagtcggagcgcatccaaaccacgctgctggatagccgtcctatgggaggggcgtatctgctcgacgagctgtggcgacagcttggattggatgaggtcctgcgagagcggcttgccgaccggaagtttaaggcggctgtcgagcgtgtcatcttcgccatggtcgcaaatcgcgcgttggcgccaagcagcaagctggccatggaagaatgggtcgaccgtgaagtggctctccccgggatgaccgagttggacgtgtggcaggcataccgggccatggactttctccatgatgtggcggaagacctgcagtacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctgggaacacggcggatatgagcgtggtcgaggaggtcaaacaggacctcatcggttggcggcttggtcgcgtgatcacggtcgtggatcgaggtttcgtctcagagagcaatttgcggatcctgcaacgcgccggcggtcactgcatcgctggggagaagatgacctccgggaaaccagcggtggaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaacgatgggggaacctgagaattgacccggaggccgtgcggcaagcggctcatctggacgggaagtacttgatccgcacctccgacgacacgctgtcgacggaagatgtcgcgctgggatacaagcaactcctgatggtggagtcagcgttgcgtaccttgaaaaaattttggacatccgtcccatga

SEQ ID NO: 1306 - DNA, 1404 bp, Artificial
  Alicyclobacillus acidocaldarius mutated SEQ ID NO 1294
atgccgtatcatgtgggcatgtatatccgagtcattcgccgaaaaaacaagaacggttctgtcaccggttacgtgcagttggcccataactttcgcgatcccaacaccggccagcccaaggccaaggtcctctacaccttcggccgcgaagacgaaatcgacctcgaggccctccggcgcattgcccagagcatccatcgcttcgttggcgacgagtttaccgccggacgtggtcagtcggagcgcatccaaaccacgctgctggatagccgtcctatgggaggggcgtatctgctcgacgagctgtggcgacagcttggattggatgaggtcctgcgagagcggcttgccgaccggaagtttaaggcggctgtcgagcgtgtcatcttcgccatggtcgcaaatcgcgcgttggcgccaagcagcaagctggccatggaagaatgggtcgaccgtgaagtggctctccccgggatgaccgagttggacgtgtggcaggcataccgggccatggactttctccatgatgtggcggaagacctgcagtacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctgggaacacggcggatatgagcgtggtcgaggaggtcaaacaggacctcatcggttggcggcttggtcgcgtgatcacggtcgtggatcgaggtttcgtctcagagagcaatttgcggatcctgcaacgcgccggcggtcactgcatcgctggggagaagatgacctccgggaaaccagcggtggaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacttgatccgcacctccgacgacacgctgtcgacggaagatgtcgcgctgggatacaagcaactcctgatggtggagtcagcgttgcgtaccttgaaaaaattttggacatccgtcccatga

SEQ ID NO: 1307 - DNA, 1404 bp, Artificial
  Alicyclobacillus acidocaldarius mutated SEQ ID NO 1294
atgccgtatcatgtgggcatgtatatccgagtcattcgccgaaaaaacaagaacggttctgtcaccggttacgtgcagttggcccataactttcgcgatcccaacaccggccagcccaaggccaaggtcctctacaccttcggccgcgaagacgaaatcgacctcgaggccctccggcgccttgcccagagcatccatcgcttcgttggcgacgagtttaccgccggacgtggtcagtcggagcgcatccaaaccacgctgctggatagccgtcctatgggaggggcgtatctgctcgacgagctgtggcgacagcttggattggatgaggtcctgcgagagcggcttgccgaccggaagtttaaggcggctgtcgagcgtattatcttcgccatggtcgcaaatcgcgcgttggcgccaagcagcaagctggccatggaagaatgggtcgaccgtgaagtggctctccccgggatgaccgagttggacgtgtggcaggcataccgggccatggactttctccatgatgtggcggaagacctgcagtacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctgggaacacggcggatatgagcgtggtcgaggaggtcaaacaggacctcatcggttggcggcttggtcgcgtgatcacggtcgtggatcgaggtttcgtctcagagagcaatttgcggatcctgcaacgcgccggcggtcactgcatcgctggggagaagatgacctccgggaaaccagcggtggaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacttgatccgcacctccgacgacacgctgtcgacggaagatgtcgcgctgggatacaagcaactcctgatggtggagtcagcgttgcgtaccttgaaaaaattttggacatccgtcccatga

SEQ ID NO: 1308 - DNA, 1404 bp, Artificial
  Alicyclobacillus acidocaldarius mutated SEQ ID NO 1294
atgccgtatcatgtgggcatgtatatccgagtcattcgccgaaaaaacaagaacggttctgtcaccggttacgtgcagttggcccataactttcgcgatcccaacaccggccagcccaaggccaaggtcctctacaccttcggccgcgaagacgaaatcgacctcgaggccctccggcgccttgcccagagcatccatcgcttcgttggcgacgagtttaccgccggacgtggtcagtcggagcgcatccaaaccacgctgctggatagccgtcctatgggaggggcgtatctgctcgacgagctgtggcgacagcttggattggatgaggtcctgcgagagcggcttgccgaccggaagtttaaggcggctgtcgatcgtgtcatcttcgccatggtcgcaaatcgcgcgttggcgccaagcagcaagctggccatggaagaatgggtcgaccgtgaagtggctctccccgggatgaccgagttggacgtgtggcaggcataccgggccatggactttctccatgatgtggcggaagacctgcagtacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctgggaacacggcggatatgagcgtggtcgaggaggtcaaacaggacctcatcggttggcggcttggtcgcgtgatcacggtcgtggatcgaggtttcgtctcagagagcaatttgcggatcctgcaacgcgccggcggtcactgcatcgctggggagaagatgacctccgggaaaccagcggtggaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacttgatccgcacctccgacgacacgctgtcgacggaagatgtcgcgctgggatacaagcaactcctgatggtggagtcagcgttgcgtaccttgaaaaaattttggacatccgtcccatga

SEQ ID NO: 1309 - DNA, 1404 bp, Artificial
  Alicyclobacillus acidocaldarius mutated SEQ ID NO 1294
atgccgtatcatgtgggcatgtatatccgagtcattcgccgaaaaaacaagaacggttctgtcaccggttacgtgcagttggcccataactttcgcgatcccaacaccggccagcccaaggccaaggtcctctacaccttcggccgcgaagacgaaatcgacctcgaggccctccggcgccttgcccagagcatccatcgcttcgttggcgacgagtttaccgccggacgtggtaattcggagcgcatccaaaccacgctgctggatagccgtcctatgggaggggcgtatctgctcgacgagctgtggcgacagcttggattggatgaggtcctgcgagagcggcttgccgaccggaagtttaaggcggctgtcgagcgtgtcatcttcgccatggtcgcaaatcgcgcgttggcgccaagcagcaagctggccatggaagaatgggtcgaccgtgaagtggctctccccgggatgaccgagttggacgtgtggcaggcataccgggccatggactttctccatgatgtggcggaagacctgcagtacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctgggaacacggcggatatgagcgtggtcgaggaggtcaaacaggacctcatcggttggcggcttggtcgcgtgatcacggtcgtggatcgaggtttcgtctcagagagcaatttgcggatcctgcaacgcgccggcggtcactgcatcgctggggagaagatgacctccgggaaaccagcggtggaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacttgatccgcacctccgacgacacgctgtcgacggaagatgtcgcgctgggatacaagcaactcctgatggtggagtcagcgttgcgtaccttgaaaaaattttggacatccgtcccatga

SEQ ID NO: 1310 - protein, 456 aa, Alicyclobacillus acidocaldarius
MLPRRFFMDNTVDFLEPFAESRVLVRQGFFEHKEGLHPNLRERKWYPANHFKGAKSNVYVRQAWLFSFDEWMEMSPCERRELFFSTLDLSPYAAKLRSSTPQGAKPISREAILRAFLAAPLEGISTFTQLHRRLESDLRFRYQCGFSLHESIPSVSTLSRVFQAIVDKGVAATLFAELVRQCRDEGLIEGEHVAIDSTAIHAYERKHPRSGVQPSNRANWGAKFDAFGNKLAWFGYKVHLAVDAKSELPMALTVTPANVYDGEMAIPLMEELHHHDWRIRFVLMDAGYDQTKNYEAARALGAQAIIPMNRRNEKEPPEGMDFDGTPRCTMGYRMTYWGVHNAWLKFRCPHATGQVDCPLGMAACSASYYGMVVKKHIDEDVRRYANPHRGSRTWKMLYDERTAVERCFARLKEWLTLDGVHVRGIEKVTVHAYIHAIVLLASALAMHRTNRIEQVA

SEQ ID NO: 1311 - DNA, 1371 bp, Alicyclobacillus acidocaldarius
ttgcttcctcgaaggttctttatggataatactgttgattttcttgagccttttgcagaatcacgagtccttgtgcggcaagggtttttcgagcacaaagaaggacttcaccccaacttgagagaaagaaaatggtatccagcaaaccatttcaagggggcgaagtccaacgtgtatgttcgacaagcgtggctcttttccttcgacgaatggatggaaatgagtccatgtgaacgacgtgagctctttttctcgaccctcgatttgagcccgtatgccgcgaagctgagaagttcgacaccccaaggggcaaagcccatctctcgagaagcgattttgcgcgcatttctcgcggcaccccttgagggcatttcgaccttcacgcagcttcaccgacgtttggagagcgatttgcgcttccgttaccagtgcggtttctcccttcacgaatccattccatctgtctcgactctaagccgcgtcttccaagctatcgtcgacaaaggggttgcggcgacgctatttgccgagttggtgcgtcaatgtcgtgacgaagggctcatcgagggcgaacacgtcgctatcgacagcacggcgatccatgcttatgagcggaaacacccacgctcaggtgtccagccctccaatcgggccaactggggcgcgaagttcgatgcctttggcaacaagctggcgtggtttggctacaaggtccatttagccgtcgatgcaaaaagtgaacttcctatggcgctcacggtgacgccagcgaacgtctacgatggagagatggccattcccctcatggaagagcttcatcaccacgactggcggattcgcttcgtgttgatggatgcaggatacgaccagacgaaaaactatgaagccgctcgagcattgggcgctcaggctatcatcccgatgaatcgccggaatgagaaagagccgccggaagggatggatttcgacggcacgccccgctgcacgatggggtaccgaatgacgtattggggcgtccataacgcctggctcaagtttcgctgtccgcacgcgacaggccaggtcgattgcccgcttggcatggctgcctgttctgcatcgtactatggcatggtcgtgaagaagcacatcgatgaggacgtccgtcgatacgcgaatccacatcgcggctctcgcacatggaagatgctttatgatgaacggaccgctgtagagcgctgttttgcacggctgaaagagtggctgacgctggacggcgtgcatgtacgtggcatcgagaaagtcaccgtacatgcgtacatccacgcgattgtgctcttggcatctgctctggcgatgcaccggacgaatcgcatcgagcaagtggcttaa

SEQ ID NO: 1312 - protein, 391 aa, Thermosinus carboxydivorans
MYIRQKPLFSFDTLMQYQPKTRLAMVFESIDLHPLLKTLPIKSIRGPKGYSSAALIKAFLAMRLCSIPTVTLLVERLKTDLVFRYECGFSLEQPVPSLATFSRFFQKIAETDSLQVLFSALVDTAIQDKVISGEVVAIDASAIDSYEKPVPKKELNSNGDSATWGAKLDTHGNQHVWFGYKLHLAVDTKSELPIAVKVTPANRNDVTQAIPLMDEIKHQPKYYCMDMGYDAKDVYQAAYERQAQAIIPLNRRKEKLPPEGMDENRTPTCSMGYPMVYWGCEREKGILKFRCPHVCGKVNCPNGSAWCSPSNYGLVIKKKVEDDPRSFCTPHRGTREWEKLYAERTSVERAFSRLKEQLGANTVRVQGIKKVTAHLMLCCIALLAGTIAVNR

SEQ ID NO: 1313 - protein, 411 aa, Desulfotomaculum reducens
MYLLQPNLFSFEELLKFEPETKLQKVLSVLDLSPALNVVKRAVLGPKGHCVGNMIRALVAKQLEQIPTVAALVKRLSNDIRFRFQCGFSLSKPIPSESTFSRLIQKLAATDETNKTESVMKQIFDNLVKSAKDMGLIDSNCVAIDSSKIDAYEKSKPKKDLQGDKTANWGAKRDTHGNQISWFGYKAHVAVDCHSELPIAIMVTPANTHDAKMAIPLIELVNKALEDSKKPKYYTMDMGYDSKDIYSVVMNDFNAQAIIPINSRGSKDHPEGCDFDGTPICSMGQRMVFWGSDAKAGTNKYRCPHVMGKCDCPYGSAWCSPSSYGLVVKTKVKDDPRMNCIPARGTKNWQSLYNKRTSVERCFGRLKQHLGANSIRTRGLEKVTLHITLSCIALLAGSIAVAKTKRIEQAA

SEQ ID NO: 1314 - protein, 403 aa, Syntrophomonas wolfei
IRQGYVFSFEDAINLQPRSRLEIVLATLDFDDVITVLDKENKQHRGPTGYPFESKLNALIAMRVYNMATFTELVERLTHDPVLRYNCGFDVFGKVPSIATFSRFYERLTQSEVLRELFKKQVTTAESMGLIDTSSIAIDASKVDANEKSVPRKNIKDDGQSANWGSKLDTNGNQITWFGYKLHIATDVKSELPVALSITPASTNDGIMAESILEECSNNLNSKPQYYLMDAGYDQKSIYELIRKDYKAQAIIPLNHRGAKEPPEGLDWDATPICSAGYRMAYWGGSNGVNKFRCPHVMGKCDCPFGSSWCSDSNYGMVVKTRARQDSRLFIVPHRGTSNWKLLYNKRTSVERCFGRLKEHLGLETGLNVRGIKKVKTHAYLSVITMIASVIAINKDKSSTDIA

SEQ ID NO: 1315 - protein, 395 aa, Syntrophomonas wolfei
IRQNCIFSFEDALKIQPKSRLEKIINTLDLKPVLCKLDKPGEIRVGPKPYPAYAMLNALIAMRLENMGTFTQLVERLTYDPHLRYVCGFEPFGTAPSKSCFSRFYSKLAQSGCLETLFTSLVKQAEEMGLLDLSSVAIDATKVEAYEKSVPRKNIIQDGNVADWGIKSDTNGNPIKWFGYKLHIGTDVKSGLPIAMKVTPANYSDSSVALELVEKCCANTQSKIVYFLMDAGYDHREIYSVIRDKYHAQAIIALNKRGAKQPPEGFDWDGTPICSARYRMVYWGSYQGVNKFRCPHIMGKCDCPFGSAWCSDSNYGMVVKTKVKDDPRLFSSPHRGSANWQKQYNLRTYSERCFSRFKENLGLEDGLNVRKITKVETHAYLCAITMIAAVIAINQ

SEQ ID NO: 1316 - protein, 395 aa, Syntrophomonas wolfei
IRQNCIFSFEDALKIQPKSRLEKIINTLDLKPVLCKLDKPGEIRVGPKPYPAYAMLNALIAMRLENMGTFTQLVERLTYDPHLRYVCGFEPFGTAPSKSCFSRFYSKLAQSGCLETLFTSLVKQAEEMGLLDLSSVAIDATKVEAYEKSVPRKNIIQDGNAADWGIKSDTNGNPIKWFGYKLHIGTDVRSGLPIAMKVTPANCSDSSVALELVEKCCANTQSKIVYFLMDAGYDHREIYSVIRDKYHAQAIIALNKRGAKQPPEGFDWDGTPICSARYRMVYWGSYQGVNKFRCPHIMGKCDCPFGSAWCSDSNYGMVVKTKVKDDPRLFSSPHRGSANWQKQYNLRTYSERCFSRFKENLGLEDGLNVRKITKVETHAYLCAITMIAAVIAINQ

SEQ ID NO: 1317 - protein, 456 aa, Artificial
  Alicyclobacillus acidocaldarius mutated SEQ ID NO 1310
MLPRRFFMDNTVDFLEPFAESRVLVRQGFFEHKEGLHPNLRERKWYPANHFKGAKSNVYVRQAWLFSFDEWMEMSPCERRELFFSTLDLSPYAAKLRSSTPQGAKPISKEAILRAFLAAPLEGISTFTQLHRRLESDLRFRYQCGFSLHESIPSVSTLSRVFQAIVDKGVAATLFAELVRQCRDEGLIEGEHVAIDSTAIHAYERKHPRSGVQPSNRANWGAKFDAFGNKLAWFGYKVHLAVDAKSELPMALTVTPANVYDGEMAIPLMEELHHHDWRIRFVLMDAGYDQTKNYEAARALGAQAIIPMNRRNEKEPPEGMDFDGTPRCTMGYRMTYWGVHNAWLKFRCPHATGQVDCPLGMAACSASYYGMVVKKHIDEDVRRYANPHRGSRTWKMLYDERTAVERCFARLKEWLTLDGVHVRGIEKVTVHAYIHAIVLLASALAMHRTNRIEQVA

SEQ ID NO: 1318 - protein, 456 aa, Artificial
  Alicyclobacillus acidocaldarius mutated SEQ ID NO 1310
MLPRRFFMDNTVDFLEPFAESRVLVRQGFFEHKEGLHPNLRERKWYPANHFKGAKSNVYVRQAWLFSFDEWMEMSPCERRELFFSTLDLSPYAAKLRSSTPQGAKPISREAILRAFLAAPLEGISTFTQLHRRLESDLRFRYQCGFSLHESIPSVSTLSRVFQAIVDKGVAATLFAELVRQCRDEGLIEGEHVAIDSTAIHAYERKHPRSGVQPSNRAQWGAKFDAFGNKLAWFGYKVHLAVDAKSELPMALTVTPANVYDGEMAIPLMEELHHHDWRIRFVLMDAGYDQTKNYEAARALGAQAIIPMNRRNEKEPPEGMDFDGTPRCTMGYRMTYWGVHNAWLKFRCPHATGQVDCPLGMAACSASYYGMVVKKHIDEDVRRYANPHRGSRTWKMLYDERTAVERCFARLKEWLTLDGVHVRGIEKVTVHAYIHAIVLLASALAMHRTNRIEQVA

SEQ ID NO: 1319 - protein, 456 aa, Artificial
  Alicyclobacillus acidocaldarius mutated SEQ ID NO 1310
MLPRRFFMDNTVDFLEPFAESRVLVRQGFFEHKEGLHPNLRERKWYPANHFKGAKSNVYVRQAWLFSFDEWMEMSPCERRELFFSTLDLSPYAAKLRSSTPQGAKPISREAILRAFLAAPLEGISTFTQLHRRLESDLRFRYQCGFSLHESIPSVSTLSRVFQAIVDKGVAATLFAELVRQCRDEGLIEGEHVAIDSTAIHAYERKHPRSGVQPSNRANWGAKFDAFGNKLAWFGYKVHLAVDAKSELPMALTVTPANVYDGEMAIPLMEELHHHDWRIRFVLMDAGYDQTKNYEAARALGAQAIIPMNRRNEKEPPEGMDFDGTPRCTMGYRMTYWGVHNAWLKFRCPHATGQVDCPLGMAACSASYYGMVVKKHIEEDVRRYANPHRGSRTWKMLYDERTAVERCFARLKEWLTLDGVHVRGIEKVTVHAYIHAIVLLASALAMHRTNRIEQVA

SEQ ID NO: 1320 - protein, 456 aa, Artificial
  Alicyclobacillus acidocaldarius mutated SEQ ID NO 1310
MLPRRFFMDNTVDFLEPFAESRVLVRQGFFEHKEGLHPNLRERKWYPANHFKGAKSNVYVRQAWLFSFDEWMEMSPCERRELFFSTLDLSPYAAKLRSSTPQGAKPISREALLRAFLAAPLEGISTFTQLHRRLESDLRFRYQCGFSLHESIPSVSTLSRVFQAIVDKGVAATLFAELVRQCRDEGLIEGEHVAIDSTAIHAYERKHPRSGVQPSNRANWGAKFDAFGNKLAWFGYKVHLAVDAKSELPMALTVTPANVYDGEMAIPLMEELHHHDWRIRFVLMDAGYDQTKNYEAARALGAQAIIPMNRRNEKEPPEGMDFDGTPRCTMGYRMTYWGVHNAWLKFRCPHATGQVDCPLGMAACSASYYGMVVKKHIDEDVRRYANPHRGSRTWKMLYDERTAVERCFARLKEWLTLDGVHVRGIEKVTVHAYIHAIVLLASALAMHRTNRIEQVA

SEQ ID NO: 1321 - protein, 456 aa, Artificial
  Alicyclobacillus acidocaldarius mutated SEQ ID NO 1310
MLPRRFFMDNTVDFLEPFAESRVLVRQGFFEHKEGLHPNLRERKWYPANHFKGAKSNVYVRQAWLFSFDEWMEMSPCERRELFFSTLDLSPYAAKLRSSTPQGAKPISREAILRAFLAAPLEGISTFTQLHRRLESDLRFRYQCGFSLHESIPSVSTLSRVFQAIVDKGVAATLFAELVRQCRDEGLIEGEHVAIDSTAIHAYERKHPRSGVQPSNRANWGAKFDAFGNRLAWFGYKVHLAVDAKSELPMALTVTPANVYDGEMAIPLMEELHHHDWRIRFVLMDAGYDQTKNYEAARALGAQAIIPMNRRNEKEPPEGMDFDGTPRCTMGYRMTYWGVHNAWLKFRCPHATGQVDCPLGMAACSASYYGMVVKKHIDEDVRRYANPHRGSRTWKMLYDERTAVERCFARLKEWLTLDGVHVRGIEKVTVHAYIHAIVLLASALAMHRTNRIEQVA

SEQ ID NO: 1322 - DNA, 1371 bp, Artificial
  Alicyclobacillus acidocaldarius mutated SEQ ID NO 1311
ttgcttcctcgaaggttctttatggataatactgttgattttcttgagccttttgcagaatcacgagtccttgtgcggcaagggtttttcgagcacaaagaaggacttcaccccaacttgagagaaagaaaatggtatccagcaaaccatttcaagggggcgaagtccaacgtgtatgttcgacaagcgtggctcttttccttcgacgaatggatggaaatgagtccatgtgaacgacgtgagctctttttctcgaccctcgatttgagcccgtatgccgcgaagctgagaagttcgacaccccaaggggcaaagcccatctctaaagaagcgattttgcgcgcatttctcgcggcaccccttgagggcatttcgaccttcacgcagcttcaccgacgtttggagagcgatttgcgcttccgttaccagtgcggtttctcccttcacgaatccattccatctgtctcgactctaagccgcgtcttccaagctatcgtcgacaaaggggttgcggcgacgctatttgccgagttggtgcgtcaatgtcgtgacgaagggctcatcgagggcgaacacgtcgctatcgacagcacggcgatccatgcttatgagcggaaacacccacgctcaggtgtccagccctccaatcgggccaactggggcgcgaagttcgatgcctttggcaacaagctggcgtggtttggctacaaggtccatttagccgtcgatgcaaaaagtgaacttcctatggcgctcacggtgacgccagcgaacgtctacgatggagagatggccattcccctcatggaagagcttcatcaccacgactggcggattcgcttcgtgttgatggatgcaggatacgaccagacgaaaaactatgaagccgctcgagcattgggcgctcaggctatcatcccgatgaatcgccggaatgagaaagagccgccggaagggatggatttcgacggcacgccccgctgcacgatggggtaccgaatgacgtattggggcgtccataacgcctggctcaagtttcgctgtccgcacgcgacaggccaggtcgattgcccgcttggcatggctgcctgttctgcatcgtactatggcatggtcgtgaagaagcacatcgatgaggacgtccgtcgatacgcgaatccacatcgcggctctcgcacatggaagatgctttatgatgaacggaccgctgtagagcgctgttttgcacggctgaaagagtggctgacgctggacggcgtgcatgtacgtggcatcgagaaagtcaccgtacatgcgtacatccacgcgattgtgctcttggcatctgctctggcgatgcaccggacgaatcgcatcgagcaagtggcttaa

SEQ ID NO: 1323 - DNA, 1371 bp, Artificial
  Alicyclobacillus acidocaldarius mutated SEQ ID NO 1311
ttgcttcctcgaaggttctttatggataatactgttgattttcttgagccttttgcagaatcacgagtccttgtgcggcaagggtttttcgagcacaaagaaggacttcaccccaacttgagagaaagaaaatggtatccagcaaaccatttcaagggggcgaagtccaacgtgtatgttcgacaagcgtggctcttttccttcgacgaatggatggaaatgagtccatgtgaacgacgtgagctctttttctcgaccctcgatttgagcccgtatgccgcgaagctgagaagttcgacaccccaaggggcaaagcccatctctcgagaagcgattttgcgcgcatttctcgcggcaccccttgagggcatttcgaccttcacgcagcttcaccgacgtttggagagcgatttgcgcttccgttaccagtgcggtttctcccttcacgaatccattccatctgtctcgactctaagccgcgtcttccaagctatcgtcgacaaaggggttgcggcgacgctatttgccgagttggtgcgtcaatgtcgtgacgaagggctcatcgagggcgaacacgtcgctatcgacagcacggcgatccatgcttatgagcggaaacacccacgctcaggtgtccagccctccaatcgggcccaatggggcgcgaagttcgatgcctttggcaacaagctggcgtggtttggctacaaggtccatttagccgtcgatgcaaaaagtgaacttcctatggcgctcacggtgacgccagcgaacgtctacgatggagagatggccattcccctcatggaagagcttcatcaccacgactggcggattcgcttcgtgttgatggatgcaggatacgaccagacgaaaaactatgaagccgctcgagcattgggcgctcaggctatcatcccgatgaatcgccggaatgagaaagagccgccggaagggatggatttcgacggcacgccccgctgcacgatggggtaccgaatgacgtattggggcgtccataacgcctggctcaagtttcgctgtccgcacgcgacaggccaggtcgattgcccgcttggcatggctgcctgttctgcatcgtactatggcatggtcgtgaagaagcacatcgatgaggacgtccgtcgatacgcgaatccacatcgcggctctcgcacatggaagatgctttatgatgaacggaccgctgtagagcgctgttttgcacggctgaaagagtggctgacgctggacggcgtgcatgtacgtggcatcgagaaagtcaccgtacatgcgtacatccacgcgattgtgctcttggcatctgctctggcgatgcaccggacgaatcgcatcgagcaagtggcttaa

SEQ ID NO: 1324 - DNA, 1371 bp, Artificial
  Alicyclobacillus acidocaldarius mutated SEQ ID NO 1311
ttgcttcctcgaaggttctttatggataatactgttgattttcttgagccttttgcagaatcacgagtccttgtgcggcaagggtttttcgagcacaaagaaggacttcaccccaacttgagagaaagaaaatggtatccagcaaaccatttcaagggggcgaagtccaacgtgtatgttcgacaagcgtggctcttttccttcgacgaatggatggaaatgagtccatgtgaacgacgtgagctctttttctcgaccctcgatttgagcccgtatgccgcgaagctgagaagttcgacaccccaaggggcaaagcccatctctcgagaagcgattttgcgcgcatttctcgcggcaccccttgagggcatttcgaccttcacgcagcttcaccgacgtttggagagcgatttgcgcttccgttaccagtgcggtttctcccttcacgaatccattccatctgtctcgactctaagccgcgtcttccaagctatcgtcgacaaaggggttgcggcgacgctatttgccgagttggtgcgtcaatgtcgtgacgaagggctcatcgagggcgaacacgtcgctatcgacagcacggcgatccatgcttatgagcggaaacacccacgctcaggtgtccagccctccaatcgggccaactggggcgcgaagttcgatgcctttggcaacaagctggcgtggtttggctacaaggtccatttagccgtcgatgcaaaaagtgaacttcctatggcgctcacggtgacgccagcgaacgtctacgatggagagatggccattcccctcatggaagagcttcatcaccacgactggcggattcgcttcgtgttgatggatgcaggatacgaccagacgaaaaactatgaagccgctcgagcattgggcgctcaggctatcatcccgatgaatcgccggaatgagaaagagccgccggaagggatggatttcgacggcacgccccgctgcacgatggggtaccgaatgacgtattggggcgtccataacgcctggctcaagtttcgctgtccgcacgcgacaggccaggtcgattgcccgcttggcatggctgcctgttctgcatcgtactatggcatggtcgtgaagaagcacatcgaagaggacgtccgtcgatacgcgaatccacatcgcggctctcgcacatggaagatgctttatgatgaacggaccgctgtagagcgctgttttgcacggctgaaagagtggctgacgctggacggcgtgcatgtacgtggcatcgagaaagtcaccgtacatgcgtacatccacgcgattgtgctcttggcatctgctctggcgatgcaccggacgaatcgcatcgagcaagtggcttaa

SEQ ID NO: 1325 - DNA, 1371 bp, Artificial
  Alicyclobacillus acidocaldarius mutated SEQ ID NO 1311
ttgcttcctcgaaggttctttatggataatactgttgattttcttgagccttttgcagaatcacgagtccttgtgcggcaagggtttttcgagcacaaagaaggacttcaccccaacttgagagaaagaaaatggtatccagcaaaccatttcaagggggcgaagtccaacgtgtatgttcgacaagcgtggctcttttccttcgacgaatggatggaaatgagtccatgtgaacgacgtgagctctttttctcgaccctcgatttgagcccgtatgccgcgaagctgagaagttcgacaccccaaggggcaaagcccatctctcgagaagcgttattgcgcgcatttctcgcggcaccccttgagggcatttcgaccttcacgcagcttcaccgacgtttggagagcgatttgcgcttccgttaccagtgcggtttctcccttcacgaatccattccatctgtctcgactctaagccgcgtcttccaagctatcgtcgacaaaggggttgcggcgacgctatttgccgagttggtgcgtcaatgtcgtgacgaagggctcatcgagggcgaacacgtcgctatcgacagcacggcgatccatgcttatgagcggaaacacccacgctcaggtgtccagccctccaatcgggccaactggggcgcgaagttcgatgcctttggcaacaagctggcgtggtttggctacaaggtccatttagccgtcgatgcaaaaagtgaacttcctatggcgctcacggtgacgccagcgaacgtctacgatggagagatggccattcccctcatggaagagcttcatcaccacgactggcggattcgcttcgtgttgatggatgcaggatacgaccagacgaaaaactatgaagccgctcgagcattgggcgctcaggctatcatcccgatgaatcgccggaatgagaaagagccgccggaagggatggatttcgacggcacgccccgctgcacgatggggtaccgaatgacgtattggggcgtccataacgcctggctcaagtttcgctgtccgcacgcgacaggccaggtcgattgcccgcttggcatggctgcctgttctgcatcgtactatggcatggtcgtgaagaagcacatcgatgaggacgtccgtcgatacgcgaatccacatcgcggctctcgcacatggaagatgctttatgatgaacggaccgctgtagagcgctgttttgcacggctgaaagagtggctgacgctggacggcgtgcatgtacgtggcatcgagaaagtcaccgtacatgcgtacatccacgcgattgtgctcttggcatctgctctggcgatgcaccggacgaatcgcatcgagcaagtggcttaa

SEQ ID NO: 1326 - DNA, 1371 bp, Artificial
  Alicyclobacillus acidocaldarius mutated SEQ ID NO 1311
ttgcttcctcgaaggttctttatggataatactgttgattttcttgagccttttgcagaatcacgagtccttgtgcggcaagggtttttcgagcacaaagaaggacttcaccccaacttgagagaaagaaaatggtatccagcaaaccatttcaagggggcgaagtccaacgtgtatgttcgacaagcgtggctcttttccttcgacgaatggatggaaatgagtccatgtgaacgacgtgagctctttttctcgaccctcgatttgagcccgtatgccgcgaagctgagaagttcgacaccccaaggggcaaagcccatctctcgagaagcgattttgcgcgcatttctcgcggcaccccttgagggcatttcgaccttcacgcagcttcaccgacgtttggagagcgatttgcgcttccgttaccagtgcggtttctcccttcacgaatccattccatctgtctcgactctaagccgcgtcttccaagctatcgtcgacaaaggggttgcggcgacgctatttgccgagttggtgcgtcaatgtcgtgacgaagggctcatcgagggcgaacacgtcgctatcgacagcacggcgatccatgcttatgagcggaaacacccacgctcaggtgtccagccctccaatcgggccaactggggcgcgaagttcgatgcctttggcaaccgtctggcgtggtttggctacaaggtccatttagccgtcgatgcaaaaagtgaacttcctatggcgctcacggtgacgccagcgaacgtctacgatggagagatggccattcccctcatggaagagcttcatcaccacgactggcggattcgcttcgtgttgatggatgcaggatacgaccagacgaaaaactatgaagccgctcgagcattgggcgctcaggctatcatcccgatgaatcgccggaatgagaaagagccgccggaagggatggatttcgacggcacgccccgctgcacgatggggtaccgaatgacgtattggggcgtccataacgcctggctcaagtttcgctgtccgcacgcgacaggccaggtcgattgcccgcttggcatggctgcctgttctgcatcgtactatggcatggtcgtgaagaagcacatcgatgaggacgtccgtcgatacgcgaatccacatcgcggctctcgcacatggaagatgctttatgatgaacggaccgctgtagagcgctgttttgcacggctgaaagagtggctgacgctggacggcgtgcatgtacgtggcatcgagaaagtcaccgtacatgcgtacatccacgcgattgtgctcttggcatctgctctggcgatgcaccggacgaatcgcatcgagcaagtggcttaa

SEQ ID NO: 1327 - protein, 377 aa, Alicyclobacillus acidocaldarius; identical to SEQ ID NO: 392

SEQ ID NO: 1328 - DNA, 1134 bp, Alicyclobacillus acidocaldarius; identical to SEQ ID NO: 393

SEQ ID NO: 1329 - protein, 327 aa, Syntrophomonas wolfei; identical to SEQ ID NO: 394

SEQ ID NO: 1330 - protein, 325 aa, Syntrophomonas wolfei; identical to SEQ ID NO: 395

SEQ ID NO: 1331 - protein, 227 aa, Moorella thermoacetica; identical to SEQ ID NO: 396

SEQ ID NO: 1332 - protein, 314 aa, Bacillus selenitireducens; identical to SEQ ID NO: 397

SEQ ID NO: 1333 - protein, 332 aa, Desulfitobacterium hafniense; identical to SEQ ID NO: 398

SEQ ID NO: 1334 - protein, 377 aa, Artificial
  Alicyclobacillus acidocaldarius mutated SEQ ID NO 1327
MRQQVAYLEEQIHLLRHRLFGASSEKRRKTQAESDSVQLSLFNEAEVEADAQSSEETGEADTKAPSEDVETETITYERRKPRAVRERDAWLYQGEADEVVEYRLSDDERVCPKCAGELHEMSREITRRVKIIPAQMKKVEYVRYVYACRHCEAQDVETPVVRAPTPKPVQAKSLATPEAVAYVMTKKFVDGMPLYRQEQQFARHGYPLSRQTLANWVVHAAETWLEPLYAKLRQVLLAQRYLHADETTLQVLHEAGRAAQTQSYMWVYRSGTDEPPVVLYDYQETRNAEHPQRFLAGFQGYLHVDGYAGYEGLPDVTLAGCWAHARRKFEEALKAVPPKERKGKTAAEAIAWRKPTCASLTTSHTPRSPRTFQTSKE

SEQ ID NO: 1335 - protein, 377 aa, Artificial
  Alicyclobacillus acidocaldarius mutated SEQ ID NO 1327
MRQQVAYLEEQIHLLRHRLFGASSEKRRKTQAESDSVQLSLFNEAEVEADAQSSEETGEADTKAPSEDVETETITYERRKPRAVRERDAWLYQGEADEVVEYRLSDDERVCPKCAGELHEMSREITRRVKIIPAQMKKVEYVRYVYACRHCEAQDIETPVVRAPTPKPVQAKSLATPEAVAYVMTKKFVDGMPLYRQEQQFARHGYPLSRQTLANWVVHAAETWLEPLYAKLRQVLLAQRYLHADETTLQVLHEAGRAAQTQSYMWVYRSGTDEPPVVLYDYQETRNAEHPQRFLAGFQGYLHVDGYAGYEGLPDVTLAGCWAHARRKFDEALKAVPPKERKGKTAAEAIAWRKPTCASLTTSHTPRSPRTFQTSKE

SEQ ID NO: 1336 - protein, 377 aa, Artificial
  Alicyclobacillus acidocaldarius mutated SEQ ID NO 1327
MRQQVAYLEEQIHLLRHRLFGASSEKRRKTQAESDSVQLSLFNEAEVEADAQSSEETGEADTKAPSEDVETETITYERRKPRAVKERDAWLYQGEADEVVEYRLSDDERVCPKCAGELHEMSREITRRVKIIPAQMKKVEYVRYVYACRHCEAQDVETPVVRAPTPKPVQAKSLATPEAVAYVMTKKFVDGMPLYRQEQQFARHGYPLSRQTLANWVVHAAETWLEPLYAKLRQVLLAQRYLHADETTLQVLHEAGRAAQTQSYMWVYRSGTDEPPVVLYDYQETRNAEHPQRFLAGFQGYLHVDGYAGYEGLPDVTLAGCWAHARRKFDEALKAVPPKERKGKTAAEAIAWRKPTCASLTTSHTPRSPRTFQTSKE

SEQ ID NO: 1337 - protein, 377 aa, Artificial
  Alicyclobacillus acidocaldarius mutated SEQ ID NO 1327
MRQQVAYIEEQIHLLRHRLFGASSEKRRKTQAESDSVQLSLFNEAEVEADAQSSEETGEADTKAPSEDVETETITYERRKPRAVRERDAWLYQGEADEVVEYRLSDDERVCPKCAGELHEMSREITRRVKIIPAQMKKVEYVRYVYACRHCEAQDVETPVVRAPTPKPVQAKSLATPEAVAYVMTKKFVDGMPLYRQEQQFARHGYPLSRQTLANWVVHAAETWLEPLYAKLRQVLLAQRYLHADETTLQVLHEAGRAAQTQSYMWVYRSGTDEPPVVLYDYQETRNAEHPQRFLAGFQGYLHVDGYAGYEGLPDVTLAGCWAHARRKFDEALKAVPPKERKGKTAAEAIAWRKPTCASLTTSHTPRSPRTFQTSKE

SEQ ID NO: 1338 - protein, 377 aa, Artificial
  Alicyclobacillus acidocaldarius mutated SEQ ID NO 1327
MRQQVAYLEEQIHLLRHRLFGASSEKRRKTQAESDSVQLSLFNEAEVEADAQSSEETGEADTKAPSEDVETETITYERRKPRAVRERDAWLYQGEADEVVEYRLSDDERVCPKCAGELHEMSREITRRVKIIPAQMKKVEYVRYVYACRHCEAQDVETPVVRAPTPKPIQAKSLATPEAVAYVMTKKFVDGMPLYRQEQQFARHGYPLSRQTLANWVVHAAETWLEPLYAKLRQVLLAQRYLHADETTLQVLHEAGRAAQTQSYMWVYRSGTDEPPVVLYDYQETRNAEHPQRFLAGFQGYLHVDGYAGYEGLPDVTLAGCWAHARRKFDEALKAVPPKERKGKTAAEAIAWRKPTCASLTTSHTPRSPRTFQTSKE

SEQ ID NO: 1339 - DNA, 1134 bp, Artificial
  Alicyclobacillus acidocaldarius mutated SEQ ID NO 1328
ttgcgccaacaggtggcctacttggaggagcagatccatctgctccgtcatcgtctgtttggggcttccagtgaaaaacggcgcaagacccaggctgagtcggacagcgtccagctctcgctgttcaacgaagccgaagtcgaagcggacgcccaaagttcggaagagaccggcgaagccgatacgaaagcgccgtcagaagacgtggagacggagaccatcacgtatgagcgccggaagcctcgcgcggtgcgcgaacgtgacgcctggctatatcagggcgaagcagatgaggtcgtcgaataccgactgtcagatgacgagcgagtctgcccgaaatgtgcgggtgaactgcatgagatgagccgcgagatcacgcggcgcgtgaaaatcatcccggcccagatgaaaaaagtcgagtacgtgcggtacgtgtacgcctgccggcattgtgaagcgcaggacgtggagacccctgtggtgcgtgcaccgacgccgaagccggtgcaggcgaagagtctcgcgacgccggaagcagtggcatacgtgatgacgaagaaatttgtcgacgggatgccgctgtatcggcaagagcaacaatttgcgcggcacgggtatccgctgtcccgccagacgctggcgaactgggtcgtgcacgcggcggagacatggttagagccgctctatgcgaaacttcgccaagtgctcttggcgcagcgttatctgcatgcggacgaaacgacgctgcaagtgttacatgaagccgggcgcgcagcgcagacccagtcgtacatgtgggtgtaccggagcggtacggacgaaccgcctgtggtgctgtacgactaccaagagacgcggaatgcagaacatccgcagcggttcttggcgggatttcaaggttatctgcacgtggatggatacgcgggctatgagggcttgccggatgtcacccttgccggatgttgggcgcatgcgcgacgaaaatttgaagaagccctcaaggcagtgcctcctaaggagcgaaagggtaagacggcggccgaggcaatcgcttggcgcaaacccacgtgtgcgtcgctgacgaccagccacacaccccgcagtccacggacctttcagacttcgaaggaatga

SEQ ID NO: 1340 - DNA, 1134 bp, Artificial
  Alicyclobacillus acidocaldarius mutated SEQ ID NO 1328
ttgcgccaacaggtggcctacttggaggagcagatccatctgctccgtcatcgtctgtttggggcttccagtgaaaaacggcgcaagacccaggctgagtcggacagcgtccagctctcgctgttcaacgaagccgaagtcgaagcggacgcccaaagttcggaagagaccggcgaagccgatacgaaagcgccgtcagaagacgtggagacggagaccatcacgtatgagcgccggaagcctcgcgcggtgcgcgaacgtgacgcctggctatatcagggcgaagcagatgaggtcgtcgaataccgactgtcagatgacgagcgagtctgcccgaaatgtgcgggtgaactgcatgagatgagccgcgagatcacgcggcgcgtgaaaatcatcccggcccagatgaaaaaagtcgagtacgtgcggtacgtgtacgcctgccggcattgtgaagcgcaggacattgagacccctgtggtgcgtgcaccgacgccgaagccggtgcaggcgaagagtctcgcgacgccggaagcagtggcatacgtgatgacgaagaaatttgtcgacgggatgccgctgtatcggcaagagcaacaatttgcgcggcacgggtatccgctgtcccgccagacgctggcgaactgggtcgtgcacgcggcggagacatggttagagccgctctatgcgaaacttcgccaagtgctcttggcgcagcgttatctgcatgcggacgaaacgacgctgcaagtgttacatgaagccgggcgcgcagcgcagacccagtcgtacatgtgggtgtaccggagcggtacggacgaaccgcctgtggtgctgtacgactaccaagagacgcggaatgcagaacatccgcagcggttcttggcgggatttcaaggttatctgcacgtggatggatacgcgggctatgagggcttgccggatgtcacccttgccggatgttgggcgcatgcgcgacgaaaatttgacgaagccctcaaggcagtgcctcctaaggagcgaaagggtaagacggcggccgaggcaatcgcttggcgcaaacccacgtgtgcgtcgctgacgaccagccacacaccccgcagtccacggacctttcagacttcgaaggaatga

SEQ ID NO: 1341 - DNA, 1134 bp, Artificial
  Alicyclobacillus acidocaldarius mutated SEQ ID NO 1328
ttgcgccaacaggtggcctacttggaggagcagatccatctgctccgtcatcgtctgtttggggcttccagtgaaaaacggcgcaagacccaggctgagtcggacagcgtccagctctcgctgttcaacgaagccgaagtcgaagcggacgcccaaagttcggaagagaccggcgaagccgatacgaaagcgccgtcagaagacgtggagacggagaccatcacgtatgagcgccggaagcctcgcgcggtgaaagaacgtgacgcctggctatatcagggcgaagcagatgaggtcgtcgaataccgactgtcagatgacgagcgagtctgcccgaaatgtgcgggtgaactgcatgagatgagccgcgagatcacgcggcgcgtgaaaatcatcccggcccagatgaaaaaagtcgagtacgtgcggtacgtgtacgcctgccggcattgtgaagcgcaggacgtggagacccctgtggtgcgtgcaccgacgccgaagccggtgcaggcgaagagtctcgcgacgccggaagcagtggcatacgtgatgacgaagaaatttgtcgacgggatgccgctgtatcggcaagagcaacaatttgcgcggcacgggtatccgctgtcccgccagacgctggcgaactgggtcgtgcacgcggcggagacatggttagagccgctctatgcgaaacttcgccaagtgctcttggcgcagcgttatctgcatgcggacgaaacgacgctgcaagtgttacatgaagccgggcgcgcagcgcagacccagtcgtacatgtgggtgtaccggagcggtacggacgaaccgcctgtggtgctgtacgactaccaagagacgcggaatgcagaacatccgcagcggttcttggcgggatttcaaggttatctgcacgtggatggatacgcgggctatgagggcttgccggatgtcacccttgccggatgttgggcgcatgcgcgacgaaaatttgacgaagccctcaaggcagtgcctcctaaggagcgaaagggtaagacggcggccgaggcaatcgcttggcgcaaacccacgtgtgcgtcgctgacgaccagccacacaccccgcagtccacggacctttcagacttcgaaggaatga

SEQ ID NO: 1342 - DNA, 1134 bp, Artificial
  Alicyclobacillus acidocaldarius mutated SEQ ID NO 1328
ttgcgccaacaggtggcctacattgaggagcagatccatctgctccgtcatcgtctgtttggggcttccagtgaaaaacggcgcaagacccaggctgagtcggacagcgtccagctctcgctgttcaacgaagccgaagtcgaagcggacgcccaaagttcggaagagaccggcgaagccgatacgaaagcgccgtcagaagacgtggagacggagaccatcacgtatgagcgccggaagcctcgcgcggtgcgcgaacgtgacgcctggctatatcagggcgaagcagatgaggtcgtcgaataccgactgtcagatgacgagcgagtctgcccgaaatgtgcgggtgaactgcatgagatgagccgcgagatcacgcggcgcgtgaaaatcatcccggcccagatgaaaaaagtcgagtacgtgcggtacgtgtacgcctgccggcattgtgaagcgcaggacgtggagacccctgtggtgcgtgcaccgacgccgaagccggtgcaggcgaagagtctcgcgacgccggaagcagtggcatacgtgatgacgaagaaatttgtcgacgggatgccgctgtatcggcaagagcaacaatttgcgcggcacgggtatccgctgtcccgccagacgctggcgaactgggtcgtgcacgcggcggagacatggttagagccgctctatgcgaaacttcgccaagtgctcttggcgcagcgttatctgcatgcggacgaaacgacgctgcaagtgttacatgaagccgggcgcgcagcgcagacccagtcgtacatgtgggtgtaccggagcggtacggacgaaccgcctgtggtgctgtacgactaccaagagacgcggaatgcagaacatccgcagcggttcttggcgggatttcaaggttatctgcacgtggatggatacgcgggctatgagggcttgccggatgtcacccttgccggatgttgggcgcatgcgcgacgaaaatttgacgaagccctcaaggcagtgcctcctaaggagcgaaagggtaagacggcggccgaggcaatcgcttggcgcaaacccacgtgtgcgtcgctgacgaccagccacacaccccgcagtccacggacctttcagacttcgaaggaatga

SEQ ID NO: 1343 - DNA, 1134 bp, Artificial
  Alicyclobacillus acidocaldarius mutated SEQ ID NO 1328
ttgcgccaacaggtggcctacttggaggagcagatccatctgctccgtcatcgtctgtttggggcttccagtgaaaaacggcgcaagacccaggctgagtcggacagcgtccagctctcgctgttcaacgaagccgaagtcgaagcggacgcccaaagttcggaagagaccggcgaagccgatacgaaagcgccgtcagaagacgtggagacggagaccatcacgtatgagcgccggaagcctcgcgcggtgcgcgaacgtgacgcctggctatatcagggcgaagcagatgaggtcgtcgaataccgactgtcagatgacgagcgagtctgcccgaaatgtgcgggtgaactgcatgagatgagccgcgagatcacgcggcgcgtgaaaatcatcccggcccagatgaaaaaagtcgagtacgtgcggtacgtgtacgcctgccggcattgtgaagcgcaggacgtggagacccctgtggtgcgtgcaccgacgccgaagccgattcaggcgaagagtctcgcgacgccggaagcagtggcatacgtgatgacgaagaaatttgtcgacgggatgccgctgtatcggcaagagcaacaatttgcgcggcacgggtatccgctgtcccgccagacgctggcgaactgggtcgtgcacgcggcggagacatggttagagccgctctatgcgaaacttcgccaagtgctcttggcgcagcgttatctgcatgcggacgaaacgacgctgcaagtgttacatgaagccgggcgcgcagcgcagacccagtcgtacatgtgggtgtaccggagcggtacggacgaaccgcctgtggtgctgtacgactaccaagagacgcggaatgcagaacatccgcagcggttcttggcgggatttcaaggttatctgcacgtggatggatacgcgggctatgagggcttgccggatgtcacccttgccggatgttgggcgcatgcgcgacgaaaatttgacgaagccctcaaggcagtgcctcctaaggagcgaaagggtaagacggcggccgaggcaatcgcttggcgcaaacccacgtgtgcgtcgctgacgaccagccacacaccccgcagtccacggacctttcagacttcgaaggaatga

SEQ ID NO: 1344 - protein, 120 aa, Alicyclobacillus acidocaldarius; identical to SEQ ID NO: 409

SEQ ID NO: 1345 - DNA, 363 bp, Alicyclobacillus acidocaldarius; identical to SEQ ID NO: 410

SEQ ID NO: 1346 - protein, 110 aa, Moorella thermoacetica; identical to SEQ ID NO: 411

SEQ ID NO: 1347 - protein, 110 aa, Pelotomaculum thermopropionicum; identical to SEQ ID NO: 412

SEQ ID NO: 1348 - protein, 112 aa, Syntrophomonas wolfei; identical to SEQ ID NO: 413

SEQ ID NO: 1349 - protein, 109 aa, Syntrophomonas wolfei; identical to SEQ ID NO: 414

SEQ ID NO: 1350 - protein, 101 aa, Bacillus selenitireducens; identical to SEQ ID NO: 415

SEQ ID NO: 1351 - protein, 120 aa, Artificial
  Alicyclobacillus acidocaldarius mutated SEQ ID NO 1344
MLAFEWTSDHRVYLACGATDMRKSIDGLAALVQASFQLDPFSPCLFVFCNRQRDKLKILHWSHNGFWLYYRRLERGRFDWPETGDAKTMVITRRELNWLLDGLPLEQPRAHRAVYVRSAI

SEQ ID NO: 1352 - protein, 120 aa, Artificial
  Alicyclobacillus acidocaldarius mutated SEQ ID NO 1344
MLAFDWTSDHRVYLACGATDMRKSIDGLAALVQASFQLDPFSPCLFVFCNRQRDKLKILHWSHNGFWLYYRRLERGRFDWPETGDAKTMVITRRELNWLLDGLPLEQPRAHRAIYVRSAI

SEQ ID NO: 1353 - protein, 120 aa, Artificial
  Alicyclobacillus acidocaldarius mutated SEQ ID NO 1344
MLAFDWTSDHRVYLACGATDMRKSIDGLAALVQASFQLDPFSPCLFVFCNRQRDKLKILHWSHNGFWLYYRRLERGRFEWPETGDAKTMVITRRELNWLLDGLPLEQPRAHRAVYVRSAI

SEQ ID NO: 1354 - protein, 120 aa, Artificial; identical to SEQ ID NO: 420
  Alicyclobacillus acidocaldarius mutated SEQ ID NO 1344

SEQ ID NO: 1355 - protein, 120 aa, Artificial
  Alicyclobacillus acidocaldarius mutated SEQ ID NO 1344
MLAFDWTSEHRVYLACGATDMRKSIDGLAALVQASFQLDPFSPCLFVFCNRQRDKLKILHWSHNGFWLYYRRLERGRFDWPETGDAKTMVITRRELNWLLDGLPLEQPRAHRAVYVRSAI

SEQ ID NO: 1356 - DNA, 363 bp, Artificial
  Alicyclobacillus acidocaldarius mutated SEQ ID NO 1345
ttgttagccttcgaatggacttcggatcaccgcgtgtatctcgcctgcggtgccacagacatgcgcaaatccattgacggactcgccgcgctcgtccaggcgtcgtttcagctcgatccgttttcgccatgtttgtttgtcttctgcaatcggcaacgggacaagctcaaaatcctgcactggtcgcacaacggcttttggctgtactatcggcgcttagagcgcggccgattcgactggcccgagactggcgatgccaagaccatggtgatcacacggcgagagctgaactggctcctggatggtctgccgctcgagcagccgagagcgcatcgagccgtgtatgtccgttctgcgatctaa

SEQ ID NO: 1357 - DNA, 363 bp, Artificial
  Alicyclobacillus acidocaldarius mutated SEQ ID NO 1345
ttgttagccttcgactggacttcggatcaccgcgtgtatctcgcctgcggtgccacagacatgcgcaaatccattgacggactcgccgcgctcgtccaggcgtcgtttcagctcgatccgttttcgccatgtttgtttgtcttctgcaatcggcaacgggacaagctcaaaatcctgcactggtcgcacaacggcttttggctgtactatcggcgcttagagcgcggccgattcgactggcccgagactggcgatgccaagaccatggtgatcacacggcgagagctgaactggctcctggatggtctgccgctcgagcagccgagagcgcatcgagccatttatgtccgttctgcgatctaa

SEQ ID NO: 1358 - DNA, 363 bp, Artificial
  Alicyclobacillus acidocaldarius mutated SEQ ID NO 1345
ttgttagccttcgactggacttcggatcaccgcgtgtatctcgcctgcggtgccacagacatgcgcaaatccattgacggactcgccgcgctcgtccaggcgtcgtttcagctcgatccgttttcgccatgtttgtttgtcttctgcaatcggcaacgggacaagctcaaaatcctgcactggtcgcacaacggcttttggctgtactatcggcgcttagagcgcggccgattcgaatggcccgagactggcgatgccaagaccatggtgatcacacggcgagagctgaactggctcctggatggtctgccgctcgagcagccgagagcgcatcgagccgtgtatgtccgttctgcgatctaa

SEQ ID NO: 1359 - DNA, 363 bp, Artificial; identical to SEQ ID NO: 425
  Alicyclobacillus acidocaldarius mutated SEQ ID NO 1345

SEQ ID NO: 1360 - DNA, 363 bp, Artificial
  Alicyclobacillus acidocaldarius mutated SEQ ID NO 1345
ttgttagccttcgactggacttcggaacaccgcgtgtatctcgcctgcggtgccacagacatgcgcaaatccattgacggactcgccgcgctcgtccaggcgtcgtttcagctcgatccgttttcgccatgtttgtttgtcttctgcaatcggcaacgggacaagctcaaaatcctgcactggtcgcacaacggcttttggctgtactatcggcgcttagagcgcggccgattcgactggcccgagactggcgatgccaagaccatggtgatcacacggcgagagctgaactggctcctggatggtctgccgctcgagcagccgagagcgcatcgagccgtgtatgtccgttctgcgatctaa

SEQ ID NO: 1361 - protein, 323 aa, Alicyclobacillus acidocaldarius; identical to SEQ ID NO: 579

SEQ ID NO: 1362 - DNA, 972 bp, Alicyclobacillus acidocaldarius; identical to SEQ ID NO: 580

SEQ ID NO: 1363 - protein, 304 aa, Gemmata obscuriglobus; identical to SEQ ID NO: 581

SEQ ID NO: 1364 - protein, 312 aa, Candidatus Pelagibacter; identical to SEQ ID NO: 582

SEQ ID NO: 1365 - protein, 312 aa, Candidatus Pelagibacter; identical to SEQ ID NO: 583

SEQ ID NO: 1366 - protein, 305 aa, Candidatus Protochlamydia; identical to SEQ ID NO: 584

SEQ ID NO: 1367 - protein, 309 aa, Frankia alni; identical to SEQ ID NO: 585

SEQ ID NO: 1368 - protein, 323 aa, Artificial
  Alicyclobacillus acidocaldarius mutated SEQ ID NO 1361
MQEIMDTNVSSTIHVGLTELSASANKYVLNSKARNTIRAYQSDWRSFCTWCDERHLSSLPAEPKTVALYLSDMADRGYRTSTIGRHMISIGLAHRTKGFPSPTSDETVRAVWRGIRNTLGVAPQGKSPILVEDLRRMLQHVPNDLMGLRDRALLLIGFAGAFRRSEIVALNVEDVEFVREGLVITLRRSKTDQEGEGRKVGIPYGSFLETCPVRALQAWLNATGIDSGPLFRRVTKGHDVRDARLSDKTVARIVKRYVRLIGLDQRHFAGHSLRAGLATSAALAGVSERDIMAQTGHRSPMMVRRYIRDSNLFRSNAAARIGL

SEQ ID NO: 1369 - protein, 323 aa, Artificial
  Alicyclobacillus acidocaldarius mutated SEQ ID NO 1361
MQEIMDTNVSSTIHVGLTELSASANKYVLQSKARNTIRAYQSDWRSFCTWCDERHLSSLPAEPKTVALYLSDMADRGYRTSTIGRHMISIGLAHRTKGFPSPTSDETVRAVWRGIRNTLGVAPQGKSPILVEDLRRMLQHVPNDLMGLRDRALLLIGFAGAFRRSEIVALNVEDVEFVREGLVITLRRSKTDQEGEGRKVGIPYGSFIETCPVRALQAWLNATGIDSGPLFRRVTKGHDVRDARLSDKTVARIVKRYVRLIGLDQRHFAGHSLRAGLATSAALAGVSERDIMAQTGHRSPMMVRRYIRDSNLFRSNAAARIGL

SEQ ID NO: 1370 - protein, 323 aa, Artificial
  Alicyclobacillus acidocaldarius mutated SEQ ID NO 1361
MQEIMDTNVSSTIHVGLTELSASANKYVLNSKARNTIRAYQSDWRSFCTWCDERHLSSLPAEPKTVALYLSDMADRGYRTSTIGRHMISIGLAHRTKGFPSPTSDETVRAVWKGIRNTLGVAPQGKSPILVEDLRRMLQHVPNDLMGLRDRALLLIGFAGAFRRSEIVALNVEDVEFVREGLVITLRRSKTDQEGEGRKVGIPYGSFIETCPVRALQAWLNATGIDSGPLFRRVTKGHDVRDARLSDKTVARIVKRYVRLIGLDQRHFAGHSLRAGLATSAALAGVSERDIMAQTGHRSPMMVRRYIRDSNLFRSNAAARIGL

SEQ ID NO: 1371 - protein, 323 aa, Artificial
  Alicyclobacillus acidocaldarius mutated SEQ ID NO 1361
MQEIMDTNVSSTIHVGLTELSASANKYVLNSKARNTIRAYQSDWRSFCTWCDERHLSSLPAEPKTVALYLSDMADRGYRTSTIGRHMISIGLAHRTKGFPSPTSDETVRAVWRGIRNTLGVAPQGKSPILVEDLRRMLQHVPNDLMGLRDRALLLIGFAGAFRRSEIVALNVEDVEFVREGLVITLRRSKTDQEGEGRKVGIPYGSFIETCPVRALQAWLNATGIDSGPLFRRVTKGHDVRDARLSDKTVARIVKRYVRLLGLDQRHFAGHSLRAGLATSAALAGVSERDIMAQTGHRSPMMVRRYIRDSNLFRSNAAARIGL

SEQ ID NO: 1372 - protein, 323 aa, Artificial
  Alicyclobacillus acidocaldarius mutated SEQ ID NO 1361
MQEIMDTNVSSTIHVGLTELSASANKYVLNSKARNTIRAYQSDWRSFCTWCDERHLSSLPAEPKTVALYLSDMADRGYRTSTIGRHMISIGLAHRTKGFPSPTSDETVRAVWRGIRNTLGVAPQGKSPIIVEDLRRMLQHVPNDLMGLRDRALLLIGFAGAFRRSEIVALNVEDVEFVREGLVITLRRSKTDQEGEGRKVGIPYGSFIETCPVRALQAWLNATGIDSGPLFRRVTKGHDVRDARLSDKTVARIVKRYVRLIGLDQRHFAGHSLRAGLATSAALAGVSERDIMAQTGHRSPMMVRRYIRDSNLFRSNAAARIGL

SEQ ID NO: 1373 - DNA, 972 bp, Artificial
  Alicyclobacillus acidocaldarius mutated SEQ ID NO 1362
atgcaggaaatcatggatactaacgtatcctccacgatacacgttggattgaccgagttatctgcaagcgccaacaagtatgttctgaactctaaagcacgaaatacgattcgggcctaccaatccgactggcgctcgttctgcacctggtgcgacgaacgccacctctcttccctgcccgccgagccgaagacggtagcgctctacctatccgacatggctgatcgaggctatcgaaccagtaccatcggtcggcatatgatttcgattggcctcgctcatcgaacgaaaggcttcccctcccccacctccgatgagacggtacgggccgtctggcggggcatccgcaatacgcttggcgtagcacctcaggggaaatcacctatattagtggaagacttgcgacgcatgttgcaacacgtgccaaacgacctcatgggcctgcgggaccgcgcacttctgctgatcgggttcgccggcgcattccgacgctcggaaatcgtggctctgaatgttgaggacgtcgagttcgtgcgtgaggggcttgtgatcacgttgcgcaggagcaagactgaccaggagggcgaaggtcggaaagtgggtatcccctacggctcgttcttagagacctgcccagtgcgcgcgctccaagcgtggttgaacgcgacggggattgattccgggcccctctttcgccgagtgaccaaaggccacgatgtgcgcgacgcgcgactctctgataagaccgtggcacgtatcgtaaagcggtatgtgcgtctaataggccttgaccagcgtcactttgccggccacagcctgcgcgcaggtcttgcaacatcggcggcgctggcgggtgtgtcggaacgagacattatggcgcagacgggtcatagaagcccaatgatggtgcggaggtatatccgagacagcaacttgttcaggtcaaatgcggcggctaggattggattatga

SEQ ID NO: 1374 - DNA, 972 bp, Artificial
  Alicyclobacillus acidocaldarius mutated SEQ ID NO 1362
atgcaggaaatcatggatactaacgtatcctccacgatacacgttggattgaccgagttatctgcaagcgccaacaagtatgttctgcaatctaaagcacgaaatacgattcgggcctaccaatccgactggcgctcgttctgcacctggtgcgacgaacgccacctctcttccctgcccgccgagccgaagacggtagcgctctacctatccgacatggctgatcgaggctatcgaaccagtaccatcggtcggcatatgatttcgattggcctcgctcatcgaacgaaaggcttcccctcccccacctccgatgagacggtacgggccgtctggcggggcatccgcaatacgcttggcgtagcacctcaggggaaatcacctatattagtggaagacttgcgacgcatgttgcaacacgtgccaaacgacctcatgggcctgcgggaccgcgcacttctgctgatcgggttcgccggcgcattccgacgctcggaaatcgtggctctgaatgttgaggacgtcgagttcgtgcgtgaggggcttgtgatcacgttgcgcaggagcaagactgaccaggagggcgaaggtcggaaagtgggtatcccctacggctcgttcatcgagacctgcccagtgcgcgcgctccaagcgtggttgaacgcgacggggattgattccgggcccctctttcgccgagtgaccaaaggccacgatgtgcgcgacgcgcgactctctgataagaccgtggcacgtatcgtaaagcggtatgtgcgtctaataggccttgaccagcgtcactttgccggccacagcctgcgcgcaggtcttgcaacatcggcggcgctggcgggtgtgtcggaacgagacattatggcgcagacgggtcatagaagcccaatgatggtgcggaggtatatccgagacagcaacttgttcaggtcaaatgcggcggctaggattggattatga

SEQ ID NO: 1375 - DNA, 972 bp, Artificial
  Alicyclobacillus acidocaldarius mutated SEQ ID NO 1362
atgcaggaaatcatggatactaacgtatcctccacgatacacgttggattgaccgagttatctgcaagcgccaacaagtatgttctgaactctaaagcacgaaatacgattcgggcctaccaatccgactggcgctcgttctgcacctggtgcgacgaacgccacctctcttccctgcccgccgagccgaagacggtagcgctctacctatccgacatggctgatcgaggctatcgaaccagtaccatcggtcggcatatgatttcgattggcctcgctcatcgaacgaaaggcttcccctcccccacctccgatgagacggtacgggccgtctggaaaggcatccgcaatacgcttggcgtagcacctcaggggaaatcacctatattagtggaagacttgcgacgcatgttgcaacacgtgccaaacgacctcatgggcctgcgggaccgcgcacttctgctgatcgggttcgccggcgcattccgacgctcggaaatcgtggctctgaatgttgaggacgtcgagttcgtgcgtgaggggcttgtgatcacgttgcgcaggagcaagactgaccaggagggcgaaggtcggaaagtgggtatcccctacggctcgttcatcgagacctgcccagtgcgcgcgctccaagcgtggttgaacgcgacggggattgattccgggcccctctttcgccgagtgaccaaaggccacgatgtgcgcgacgcgcgactctctgataagaccgtggcacgtatcgtaaagcggtatgtgcgtctaataggccttgaccagcgtcactttgccggccacagcctgcgcgcaggtcttgcaacatcggcggcgctggcgggtgtgtcggaacgagacattatggcgcagacgggtcatagaagcccaatgatggtgcggaggtatatccgagacagcaacttgttcaggtcaaatgcggcggctaggattggattatga

SEQ ID NO: 1376 - DNA, 972 bp, Artificial
  Alicyclobacillus acidocaldarius mutated SEQ ID NO 1362
atgcaggaaatcatggatactaacgtatcctccacgatacacgttggattgaccgagttatctgcaagcgccaacaagtatgttctgaactctaaagcacgaaatacgattcgggcctaccaatccgactggcgctcgttctgcacctggtgcgacgaacgccacctctcttccctgcccgccgagccgaagacggtagcgctctacctatccgacatggctgatcgaggctatcgaaccagtaccatcggtcggcatatgatttcgattggcctcgctcatcgaacgaaaggcttcccctcccccacctccgatgagacggtacgggccgtctggcggggcatccgcaatacgcttggcgtagcacctcaggggaaatcacctatattagtggaagacttgcgacgcatgttgcaacacgtgccaaacgacctcatgggcctgcgggaccgcgcacttctgctgatcgggttcgccggcgcattccgacgctcggaaatcgtggctctgaatgttgaggacgtcgagttcgtgcgtgaggggcttgtgatcacgttgcgcaggagcaagactgaccaggagggcgaaggtcggaaagtgggtatcccctacggctcgttcatcgagacctgcccagtgcgcgcgctccaagcgtggttgaacgcgacggggattgattccgggcccctctttcgccgagtgaccaaaggccacgatgtgcgcgacgcgcgactctctgataagaccgtggcacgtatcgtaaagcggtatgtgcgtctattaggccttgaccagcgtcactttgccggccacagcctgcgcgcaggtcttgcaacatcggcggcgctggcgggtgtgtcggaacgagacattatggcgcagacgggtcatagaagcccaatgatggtgcggaggtatatccgagacagcaacttgttcaggtcaaatgcggcggctaggattggattatga

SEQ ID NO: 1377 - DNA, 972 bp, Artificial
  Alicyclobacillus acidocaldarius mutated SEQ ID NO 1362
atgcaggaaatcatggatactaacgtatcctccacgatacacgttggattgaccgagttatctgcaagcgccaacaagtatgttctgaactctaaagcacgaaatacgattcgggcctaccaatccgactggcgctcgttctgcacctggtgcgacgaacgccacctctcttccctgcccgccgagccgaagacggtagcgctctacctatccgacatggctgatcgaggctatcgaaccagtaccatcggtcggcatatgatttcgattggcctcgctcatcgaacgaaaggcttcccctcccccacctccgatgagacggtacgggccgtctggcggggcatccgcaatacgcttggcgtagcacctcaggggaaatcacctataattgtggaagacttgcgacgcatgttgcaacacgtgccaaacgacctcatgggcctgcgggaccgcgcacttctgctgatcgggttcgccggcgcattccgacgctcggaaatcgtggctctgaatgttgaggacgtcgagttcgtgcgtgaggggcttgtgatcacgttgcgcaggagcaagactgaccaggagggcgaaggtcggaaagtgggtatcccctacggctcgttcatcgagacctgcccagtgcgcgcgctccaagcgtggttgaacgcgacggggattgattccgggcccctctttcgccgagtgaccaaaggccacgatgtgcgcgacgcgcgactctctgataagaccgtggcacgtatcgtaaagcggtatgtgcgtctaataggccttgaccagcgtcactttgccggccacagcctgcgcgcaggtcttgcaacatcggcggcgctggcgggtgtgtcggaacgagacattatggcgcagacgggtcatagaagcccaatgatggtgcggaggtatatccgagacagcaacttgttcaggtcaaatgcggcggctaggattggattatga

SEQ ID NO: 1378 - protein, 416 aa, Alicyclobacillus acidocaldarius
MTNTKSRRHATMASLNSFAVLEWIRKMQDVDQIDFLRELMQLVTQFLIDAEAAEKIGAERYERTESRVTQRNGYRSRAWDTRLGTVDLKIPKLRQGSFFPSILEPRRRAEQALASVIQEAYVKGVSTRKVDDLVRALGLDGISKSEVSRLCQLIDEEVRQFKERPLEREYPYVWLDATFPKVREGGRVQSMALVIAIGVTDTGEREVLGFDVGTSEDGAFWSDFLRSLKARGLRGVRLVVSDAHAGLRQAISEVLTGATWQRCKVHTIRNVLSQVPKREQSMVASIIRTIFTQPTQEAAREQLRRVVAELRGRFPKAMDILEAAEEDVLAFMALPIEHWRQICSTNPLERLNREMRRRMDVVGIFPNRASVVRLAGAILQEQHEEWLVSRRYFSLESMAKLKPNRPFLAAEAMLQK

SEQ ID NO: 1379 - DNA, 1251 bp, Alicyclobacillus acidocaldarius
gtgaccaacaccaaaagtaggaggcacgcaacgatggcttcgctcaatagcttcgcagttctcgaatggattcgcaagatgcaagacgtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgtcgagcggaacaagcgctggcttctgtgatccaggaagcgtacgtgaagggcgtgagcacccgcaaggtcgatgacctggtgcgagcgttgggcctggatggcattagcaaaagcgaggtgtctcgcctctgccagctcatcgatgaagaggttcgccagttcaaggagcggccgctcgagcgtgagtatccgtacgtgtggctggatgccacgttcccgaaggtgcgggagggcggccgcgtgcagagcatggcgctggtcatcgccattggcgtcacggacaccggagagcgcgaagtactcggattcgatgtcggaacgagcgaggacggcgcgttctggtcggactttctgcgcagcctgaaggcgcgaggtcttcggggcgtgcgtctggtggtgagcgatgcgcacgcaggcttgcgccaggccatttcggaagtgctgacgggcgcgacgtggcaacgctgcaaagtgcacacgattcggaacgtgttgagccaagtgccgaagagggagcagtcgatggtggcctcgatcatccggacgatcttcacccagcccacgcaagaagcggcccgcgagcagcttcgccgagtggtcgcggaactccgggggcgtttcccgaaggcgatggacattttggaggcagcagaggaggacgtgctggcctttatggcgctacctatcgagcactggcggcagatctgctcgaccaacccgctcgagcggctcaatcgagagatgcgtcggcggatggacgtcgtggggattttcccgaatcgagcatcggtagtgcgcctcgctggagcgattttgcaagagcagcacgaagagtggctggtgtcgcggcgatatttcagcctggagtcgatggcgaaactcaagcccaaccgtccgttcctcgcagccgaggcgatgttgcaaaaataa

SEQ ID NO: 1380 - protein, 406 aa, Clostridium thermocellum
MATNNRMALLEQLSKYVVEKDKDFLKEALTLLINALMDAEVTSIIGAEKYERNNNRNNYRNGYRLREWDTRVGTLQLSIPKLRHGSYFPSLLEPRKMSEKALLNVVQEAYVHGVSTRKVDELVEALGMKGIDKSEVSRISKQLDEFVEEFKNRRLEGEYPYLWLDATFPKVREGGRVCSMALVIAVGVNQQGEREILGFDVGMSEDGAFWEEFLRRLVARGLKGVRLVISDAHEGLKAAIKKILTGSAWQRCRVHFMRNVLSQVPKHYQGMVSSIIRTIFAQNDQESAREQLRHVVDELKNRFPKAMKILEEAEEEILAYMAFPREHWAQIHSTNPLERLNREIRRRTDVVCIFPNREAVIRLVGAMLMEQNDEWKVGRRYFSLESMSKITSINEFTLTPVALLHK

SEQ ID NO: 1381 - protein, 406 aa, Clostridium thermocellum
MATNNRMALLEQLSKYVVEKDKDFLKEALTLLINALMDAEVTSIIGAEKYERNNNRNNYRNGYRLREWDTRVGTLQLSIPKLRHGSYFPSLLEPRKMSEKALLNVVQEAYVHGVSTRKVDELVEALGMKGIDKSEVSRISKQLDEFVEEFKNRRLEGEYPYLWLDATFPKVREGGRVCSMALVIAVGVNQQGEREILGFDVGMSEDGAFWEEFLRRLVARGLKGVRLVISDAHEGLKAAIKKILTGSAWQRCRVHFMRNVLSQVPKHYQGMVSSIIRTIFAQNDQESAREQLRHVVDELKNRFPKAMKILEEAEEEILAYMAFPREHWAQIHSTNPLERLNREIRRRTDVVCIFPNRKAVIRLVGAMLMEQNDEWKVGRRYFSLESMSKITSINEFTLTPVALLHK

SEQ ID NO: 1382 - protein, 406 aa, Clostridium thermocellum
MATNNRMALLEQLSKYVVEKDKDFLKEALTLLINALMDAEVTSIIGAEKYERNNNRNNYRNGYRLREWDTRVGTLQLSIPKLRHGSYFPSLLEPRKMSEKALLNVVQEAYVHGVSTRKVDELVEALGMKGIDKSEVSRISKQLDEFVEEFKNRRLEGEYPYLWLDATFPKVREGGRVCSMALVIAVGVNQQGEREILGFDVGMSEDGAFWEEFLRRLVARGLKGVRLVISDAHEGLKAAIKKILTGSAWQRCRVHFMRNVLSQVPKHYQGMVSSIIRTIFAQNDQESAREQLRHVVDELKKRFPKAMKILEEAEEEILAYMAFPREHWAQIHSTNPLERLNREIRRRTDVVCIFPNREAVIRLVGAMLMEQNDEWKVGRRYFSLESMSKITSINEFTLTPVALLHK

SEQ ID NO: 1383 - protein, 412 aa, Symbiobacterium thermophilum
SNTSQRGNPQVTNFRIALEELLRKSGVDDVDFLREGVRVLAQGLMELEVSQQIGAERYERSSERSNYRNGYRERQWDTRVGTIDLQIPKLRKGSYMPSWLEPRRRAEKALVAVVQEAYIQGVSTRKVDELVQALGMTGVSKSQVSRLCAELDEVVEAFRNRPLEGRYPYVWLDAKYEKVRENGRVSSMALVIAMGVREDGEREILGLDVGPSEDGAFWTAFLRQLVARGLKGVLLVISDNHVGLREAIRTVFSGASWQRCRVHFMRNLLGYVPKNLQSMVSAAVRTIFAQPDQQAAKSQLAVVVENLRKQFPRAAQLLEDAEEDILAYMAFPTEHWRRLHSTNPLERLNREIGRRTEIVGIFPNREALIRLAGAVMIEQQEEWMTAPRRYFSQASMAKLYAHDPSLGRPELL

SEQ ID NO: 1384 - protein, 382 aa, Symbiobacterium thermophilum
LEELLRKTGVDDFDFLREGLRVLAQGLMELEVSQRIGADRYERSAERSTYRNGYRERQWDTRVGTIDLQIPKLRKGSYMPSFLEPRRRAEKALVAVVLEAYVNGVSTRKVDDLVQALGMTGVSKSQVSRLCAELDEVVQAFRNRPLESRYPYVWLDAKYVKVRENGRVCTMALVVAVGVREDGDREVLGLDVGPSEDGAFWTAFLRQLVTRGLKGVLLAISDSHVGLQEAIRTVLSGASWQRSRVHFMRNLLGYVPKHWQSMVAAAVRTIFAQPDQQAARRQLAVVADNLRPQFPRAAQLLEEAEDDILAYMAFPTEHWRQLHSTNPLERLNREIGRRTDVVGIFPNREAFIRLAGAVLIEQQDEWTAAPRRYFSQASMAKL

SEQ ID NO: 1385 - protein, 416 aa, Artificial
  Alicyclobacillus acidocaldarius mutated SEQ ID NO 1378
MTNTKSRRHATMASLNSFAVLEWIRKMQDIDQIDFLRELMQLVTQFLIDAEAAEKIGAERYERTESRVTQRNGYRSRAWDTRLGTVDLKIPKLRQGSFFPSILEPRRRAEQALASVIQEAYVKGVSTRKVDDLVRALGLDGISKSEVSRLCQLIDEEVRQFKERPLEREYPYVWLDATFPKVREGGRVQSMALVIAIGVTDTGEREVLGFDVGTSEDGAFWSDFLRSLKARGLRGVRLVVSDAHAGLRQAISEVLTGATWQRCKVHTIRNVLSQVPKREQSMVASIIRTIFTQPTQEAAREQLRRVVAELRGRFPKAMDILEAAEEDVLAFMALPIEHWRQICSTNPLERLNREMRRRMDVVGIFPNRASVVRLAGAILQEQHEEWLVSRRYFSLESMAKLKPNRPFLAAEAMLQK

SEQ ID NO: 1386 - protein, 416 aa, Artificial
  Alicyclobacillus acidocaldarius mutated SEQ ID NO 1378
MTNTKSRKHATMASLNSFAVLEWIRKMQDVDQIDFLRELMQLVTQFLIDAEAAEKIGAERYERTESRVTQRNGYRSRAWDTRLGTVDLKIPKLRQGSFFPSILEPRRRAEQALASVIQEAYVKGVSTRKVDDLVRALGLDGISKSEVSRLCQLIDEEVRQFKERPLEREYPYVWLDATFPKVREGGRVQSMALVIAIGVTDTGEREVLGFDVGTSEDGAFWSDFLRSLKARGLRGVRLVVSDAHAGLRQAISEVLTGATWQRCKVHTIRNVLSQVPKREQSMVASIIRTIFTQPTQEAAREQLRRVVAELRGRFPKAMDILEAAEEDVLAFMALPIEHWRQICSTNPLERLNREMRRRMDVVGIFPNRASVVRLAGAILQEQHEEWLVSRRYFSLESMAKLKPNRPFLAAEAMLQK

SEQ ID NO: 1387 - protein, 416 aa, Artificial
  Alicyclobacillus acidocaldarius mutated SEQ ID NO 1378
MTNTKSRRHATMASLNSFAVLEWIRKMQDVDQIDFLRELMQLVTQFLIDAEAAEKIGAERYERTESRVTQRNGYRSRAWDTRLGTVDLKIPKLRQGSFFPSILEPRRRAEQALASVIQEAYVKGVSTRKVDDLVRALGLDGISKSEVSRLCQLIDEEVRQFKERPLEREYPYVWLDATFPKVREGGRVQSMALVIAIGVTDTGEREVLGFDVGTSEDGAFWSDFLRSLKARGLRGVRLVVSDAHAGLRQAISEVLTGATWQRCKVHTIRNVLSQVPKREQSMVASIIRTIFTQPTQEAAREQLRRVVAELRGRFPKAMDILEAAEEDVLAFMALPIEHWRQICSTNPLERLNREMKRRMDVVGIFPNRASVVRLAGAILQEQHEEWLVSRRYFSLESMAKLKPNRPFLAAEAMLQK

SEQ ID NO: 1388 - protein, 416 aa, Artificial
  Alicyclobacillus acidocaldarius mutated SEQ ID NO 1378
MTNTKSKRHATMASLNSFAVLEWIRKMQDVDQIDFLRELMQLVTQFLIDAEAAEKIGAERYERTESRVTQRNGYRSRAWDTRLGTVDLKIPKLRQGSFFPSILEPRRRAEQALASVIQEAYVKGVSTRKVDDLVRALGLDGISKSEVSRLCQLIDEEVRQFKERPLEREYPYVWLDATFPKVREGGRVQSMALVIAIGVTDTGEREVLGFDVGTSEDGAFWSDFLRSLKARGLRGVRLVVSDAHAGLRQAISEVLTGATWQRCKVHTIRNVLSQVPKREQSMVASIIRTIFTQPTQEAAREQLRRVVAELRGRFPKAMDILEAAEEDVLAFMALPIEHWRQICSTNPLERLNREMRRRMDVVGIFPNRASVVRLAGAILQEQHEEWLVSRRYFSLESMAKLKPNRPFLAAEAMLQK

SEQ ID NO: 1389 - protein, 416 aa, Artificial
  Alicyclobacillus acidocaldarius mutated SEQ ID NO 1378
MTNTKSRRHATMASLNSFAVLEWIRKMQDVDQIDFLRELMQLVTQFLIDAEAAEKIGAERYERTESRVTQRNGYRSRAWDTRLGTVDLKIPKLRQGSFFPSILEPRRRAEQALASVIQEAYVKGVSTRKVDDLVRALGLDGISKSEVSRLCQLIDEEVRQFKERPLEREYPYVWLDATFPKVREGGRVQSMALVIAIGVTDTGEREVLGFDVGTSEDGAFWSDFLRSLKARGLRGVRLVVSDAHAGLRNAISEVLTGATWQRCKVHTIRNVLSQVPKREQSMVASIIRTIFTQPTQEAAREQLRRVVAELRGRFPKAMDILEAAEEDVLAFMALPIEHWRQICSTNPLERLNREMRRRMDVVGIFPNRASVVRLAGAILQEQHEEWLVSRRYFSLESMAKLKPNRPFLAAEAMLQK

SEQ ID NO: 1390 - DNA, 1251 bp, Artificial
  Alicyclobacillus acidocaldarius mutated SEQ ID NO 1379
gtgaccaacaccaaaagtaggaggcacgcaacgatggcttcgctcaatagcttcgcagttctcgaatggattcgcaagatgcaagacattgatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgtcgagcggaacaagcgctggcttctgtgatccaggaagcgtacgtgaagggcgtgagcacccgcaaggtcgatgacctggtgcgagcgttgggcctggatggcattagcaaaagcgaggtgtctcgcctctgccagctcatcgatgaagaggttcgccagttcaaggagcggccgctcgagcgtgagtatccgtacgtgtggctggatgccacgttcccgaaggtgcgggagggcggccgcgtgcagagcatggcgctggtcatcgccattggcgtcacggacaccggagagcgcgaagtactcggattcgatgtcggaacgagcgaggacggcgcgttctggtcggactttctgcgcagcctgaaggcgcgaggtcttcggggcgtgcgtctggtggtgagcgatgcgcacgcaggcttgcgccaggccatttcggaagtgctgacgggcgcgacgtggcaacgctgcaaagtgcacacgattcggaacgtgttgagccaagtgccgaagagggagcagtcgatggtggcctcgatcatccggacgatcttcacccagcccacgcaagaagcggcccgcgagcagcttcgccgagtggtcgcggaactccgggggcgtttcccgaaggcgatggacattttggaggcagcagaggaggacgtgctggcctttatggcgctacctatcgagcactggcggcagatctgctcgaccaacccgctcgagcggctcaatcgagagatgcgtcggcggatggacgtcgtggggattttcccgaatcgagcatcggtagtgcgcctcgctggagcgattttgcaagagcagcacgaagagtggctggtgtcgcggcgatatttcagcctggagtcgatggcgaaactcaagcccaaccgtccgttcctcgcagccgaggcgatgttgcaaaaataa

SEQ ID NO: 1391 - DNA, 1251 bp, Artificial
  Alicyclobacillus acidocaldarius mutated SEQ ID NO 1379
gtgaccaacaccaaaagtaggaaacacgcaacgatggcttcgctcaatagcttcgcagttctcgaatggattcgcaagatgcaagacgtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgtcgagcggaacaagcgctggcttctgtgatccaggaagcgtacgtgaagggcgtgagcacccgcaaggtcgatgacctggtgcgagcgttgggcctggatggcattagcaaaagcgaggtgtctcgcctctgccagctcatcgatgaagaggttcgccagttcaaggagcggccgctcgagcgtgagtatccgtacgtgtggctggatgccacgttcccgaaggtgcgggagggcggccgcgtgcagagcatggcgctggtcatcgccattggcgtcacggacaccggagagcgcgaagtactcggattcgatgtcggaacgagcgaggacggcgcgttctggtcggactttctgcgcagcctgaaggcgcgaggtcttcggggcgtgcgtctggtggtgagcgatgcgcacgcaggcttgcgccaggccatttcggaagtgctgacgggcgcgacgtggcaacgctgcaaagtgcacacgattcggaacgtgttgagccaagtgccgaagagggagcagtcgatggtggcctcgatcatccggacgatcttcacccagcccacgcaagaagcggcccgcgagcagcttcgccgagtggtcgcggaactccgggggcgtttcccgaaggcgatggacattttggaggcagcagaggaggacgtgctggcctttatggcgctacctatcgagcactggcggcagatctgctcgaccaacccgctcgagcggctcaatcgagagatgcgtcggcggatggacgtcgtggggattttcccgaatcgagcatcggtagtgcgcctcgctggagcgattttgcaagagcagcacgaagagtggctggtgtcgcggcgatatttcagcctggagtcgatggcgaaactcaagcccaaccgtccgttcctcgcagccgaggcgatgttgcaaaaataa

SEQ ID NO: 1392 - DNA, 1251 bp, Artificial
  Alicyclobacillus acidocaldarius mutated SEQ ID NO 1379
gtgaccaacaccaaaagtaggaggcacgcaacgatggcttcgctcaatagcttcgcagttctcgaatggattcgcaagatgcaagacgtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgtcgagcggaacaagcgctggcttctgtgatccaggaagcgtacgtgaagggcgtgagcacccgcaaggtcgatgacctggtgcgagcgttgggcctggatggcattagcaaaagcgaggtgtctcgcctctgccagctcatcgatgaagaggttcgccagttcaaggagcggccgctcgagcgtgagtatccgtacgtgtggctggatgccacgttcccgaaggtgcgggagggcggccgcgtgcagagcatggcgctggtcatcgccattggcgtcacggacaccggagagcgcgaagtactcggattcgatgtcggaacgagcgaggacggcgcgttctggtcggactttctgcgcagcctgaaggcgcgaggtcttcggggcgtgcgtctggtggtgagcgatgcgcacgcaggcttgcgccaggccatttcggaagtgctgacgggcgcgacgtggcaacgctgcaaagtgcacacgattcggaacgtgttgagccaagtgccgaagagggagcagtcgatggtggcctcgatcatccggacgatcttcacccagcccacgcaagaagcggcccgcgagcagcttcgccgagtggtcgcggaactccgggggcgtttcccgaaggcgatggacattttggaggcagcagaggaggacgtgctggcctttatggcgctacctatcgagcactggcggcagatctgctcgaccaacccgctcgagcggctcaatcgagagatgaaacggcggatggacgtcgtggggattttcccgaatcgagcatcggtagtgcgcctcgctggagcgattttgcaagagcagcacgaagagtggctggtgtcgcggcgatatttcagcctggagtcgatggcgaaactcaagcccaaccgtccgttcctcgcagccgaggcgatgttgcaaaaataa

SEQ ID NO: 1393 - DNA, 1251 bp, Artificial
  Alicyclobacillus acidocaldarius mutated SEQ ID NO 1379
gtgaccaacaccaaaagtaaaaggcacgcaacgatggcttcgctcaatagcttcgcagttctcgaatggattcgcaagatgcaagacgtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgtcgagcggaacaagcgctggcttctgtgatccaggaagcgtacgtgaagggcgtgagcacccgcaaggtcgatgacctggtgcgagcgttgggcctggatggcattagcaaaagcgaggtgtctcgcctctgccagctcatcgatgaagaggttcgccagttcaaggagcggccgctcgagcgtgagtatccgtacgtgtggctggatgccacgttcccgaaggtgcgggagggcggccgcgtgcagagcatggcgctggtcatcgccattggcgtcacggacaccggagagcgcgaagtactcggattcgatgtcggaacgagcgaggacggcgcgttctggtcggactttctgcgcagcctgaaggcgcgaggtcttcggggcgtgcgtctggtggtgagcgatgcgcacgcaggcttgcgccaggccatttcggaagtgctgacgggcgcgacgtggcaacgctgcaaagtgcacacgattcggaacgtgttgagccaagtgccgaagagggagcagtcgatggtggcctcgatcatccggacgatcttcacccagcccacgcaagaagcggcccgcgagcagcttcgccgagtggtcgcggaactccgggggcgtttcccgaaggcgatggacattttggaggcagcagaggaggacgtgctggcctttatggcgctacctatcgagcactggcggcagatctgctcgaccaacccgctcgagcggctcaatcgagagatgcgtcggcggatggacgtcgtggggattttcccgaatcgagcatcggtagtgcgcctcgctggagcgattttgcaagagcagcacgaagagtggctggtgtcgcggcgatatttcagcctggagtcgatggcgaaactcaagcccaaccgtccgttcctcgcagccgaggcgatgttgcaaaaataa

SEQ ID NO: 1394 - DNA, 1251 bp, Artificial
  Alicyclobacillus acidocaldarius mutated SEQ ID NO 1379
gtgaccaacaccaaaagtaggaggcacgcaacgatggcttcgctcaatagcttcgcagttctcgaatggattcgcaagatgcaagacgtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgtcgagcggaacaagcgctggcttctgtgatccaggaagcgtacgtgaagggcgtgagcacccgcaaggtcgatgacctggtgcgagcgttgggcctggatggcattagcaaaagcgaggtgtctcgcctctgccagctcatcgatgaagaggttcgccagttcaaggagcggccgctcgagcgtgagtatccgtacgtgtggctggatgccacgttcccgaaggtgcgggagggcggccgcgtgcagagcatggcgctggtcatcgccattggcgtcacggacaccggagagcgcgaagtactcggattcgatgtcggaacgagcgaggacggcgcgttctggtcggactttctgcgcagcctgaaggcgcgaggtcttcggggcgtgcgtctggtggtgagcgatgcgcacgcaggcttgcgcaatgccatttcggaagtgctgacgggcgcgacgtggcaacgctgcaaagtgcacacgattcggaacgtgttgagccaagtgccgaagagggagcagtcgatggtggcctcgatcatccggacgatcttcacccagcccacgcaagaagcggcccgcgagcagcttcgccgagtggtcgcggaactccgggggcgtttcccgaaggcgatggacattttggaggcagcagaggaggacgtgctggcctttatggcgctacctatcgagcactggcggcagatctgctcgaccaacccgctcgagcggctcaatcgagagatgcgtcggcggatggacgtcgtggggattttcccgaatcgagcatcggtagtgcgcctcgctggagcgattttgcaagagcagcacgaagagtggctggtgtcgcggcgatatttcagcctggagtcgatggcgaaactcaagcccaaccgtccgttcctcgcagccgaggcgatgttgcaaaaataa

SEQ ID NO: 1395 - protein, 304 aa, Alicyclobacillus acidocaldarius
MTNTKSRRHATMASLNSFAVLEWIRKMQDVDQIDFLRELMQLVTQFLIDAEAAEKIGAERYERTESRVTQRNGYRSRAWDTRLGTVDLKIPKLRQGSFFPSILEPRRRAEQALASVIQEAYVKGVSTRKVDDLVRALGLDGISKSEVSRLCQLIDEEVRQFKERPLEREYPYVWLDATFPKVREGGRVQSMALVIAIGVTDTGEREVLGFDVGTSEDGAFWSDFLRSLKARGLRGVRLVVSDAHAGLRQAISEVLTGATWQRCKVHTIRNVLSQVPKREQSMVASIIRTIFTHPTQEAGREQLP

SEQ ID NO: 1396 - DNA, 915 bp, Alicyclobacillus acidocaldarius
gtgaccaacaccaaaagtaggaggcacgcaacgatggcttcgctcaatagcttcgcagttctcgaatggattcgcaagatgcaagacgtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgtcgagcggaacaagcgctggcttctgtgatccaggaagcgtacgtgaagggcgtgagcacccgcaaggtcgatgacctggtgcgagcgttgggcctggatggcattagcaaaagcgaggtgtctcgcctctgccagctcatcgatgaagaggttcgccagttcaaggagcggccgctcgagcgtgagtatccgtacgtgtggctggatgccacgttcccgaaggtgcgggagggcggccgcgtgcagagcatggcgctggtcatcgccattggcgtcacggacaccggagagcgcgaagtactcggattcgatgtcggaacgagcgaggacggcgcgttctggtcggactttctgcgcagcctgaaggcgcgaggtcttcggggcgtgcgtctggtggtgagcgatgcgcacgcaggcttgcgccaggccatttcggaagtgctgacgggcgcgacgtggcaacgctgcaaagtgcacacgattcggaacgtgttgagccaagtgccgaagagggagcagtcgatggtggcctcgatcatccggacgatcttcacccatcccacgcaagaagcgggccgcgagcagcttccgtga

SEQ ID NO: 1397 - protein, 292 aa, Clostridium thermocellum
MATNNRMALLEQLSKYVVEKDKDFLKEALTLLINALMDAEVTSIIGAEKYERNNNRNNYRNGYRLREWDTRVGTLQLSIPKLRHGSYFPSLLEPRKMSEKALLNVVQEAYVHGVSTRKVDELVEALGMKGIDKSEVSRISKQLDEFVEEFKNRRLEGEYPYLWLDATFPKVREGGRVCSMALVIAVGVNQQGEREILGFDVGMSEDGAFWEEFLRRLVARGLKGVRLVISDAHEGLKAAIKKILTGSAWQRCRVHFMRNVLSQVPKHYQGMVSSIIRTIFAQNDQESAREQL

SEQ ID NO: 1398 - protein, 292 aa, Clostridium thermocellum; identical to SEQ ID NO: 1397

SEQ ID NO: 1399 - protein, 292 aa, Clostridium thermocellum; identical to SEQ ID NO: 1397

SEQ ID NO: 1400 - protein, 300 aa, Symbiobacterium thermophilum
SNTSQRGNPQVTNFRIALEELLRKSGVDDVDFLREGVRVLAQGLMELEVSQQIGAERYERSSERSNYRNGYRERQWDTRVGTIDLQIPKLRKGSYMPSWLEPRRRAEKALVAVVQEAYIQGVSTRKVDELVQALGMTGVSKSQVSRLCAELDEVVEAFRNRPLEGRYPYVWLDAKYEKVRENGRVSSMALVIAMGVREDGEREILGLDVGPSEDGAFWTAFLRQLVARGLKGVLLVISDNHVGLREAIRTVFSGASWQRCRVHFMRNLLGYVPKNLQSMVSAAVRTIFAQPDQQAAKSQL

SEQ ID NO: 1401 - protein, 283 aa, Symbiobacterium thermophilum
LEELLRKTGVDDFDFLREGLRVLAQGLMELEVSQRIGADRYERSAERSTYRNGYRERQWDTRVGTIDLQIPKLRKGSYMPSFLEPRRRAEKALVAVVLEAYVNGVSTRKVDDLVQALGMTGVSKSQVSRLCAELDEVVQAFRNRPLESRYPYVWLDAKYVKVRENGRVCTMALVVAVGVREDGDREVLGLDVGPSEDGAFWTAFLRQLVTRGLKGVLLAISDSHVGLQEAIRTVLSGASWQRSRVHFMRNLLGYVPKHWQSMVAAAVRTIFAQPDQQAARRQL

SEQ ID NO: 1402 - protein, 304 aa, Artificial
  Alicyclobacillus acidocaldarius mutated SEQ ID NO 1395
MTNTKSRRHATMASLNSFAVLEWIRKMQDVDQIDFLRELMQLVTQFLIDAEAAEKIGAERYERTESRVTQRNGYRSRAWDTRLGTVDLKIPKLRQGSFFPSLLEPRRRAEQALASVIQEAYVKGVSTRKVDDLVRALGLDGISKSEVSRLCQLIDEEVRQFKERPLEREYPYVWLDATFPKVREGGRVQSMALVIAIGVTDTGEREVLGFDVGTSEDGAFWSDFLRSLKARGLRGVRLVVSDAHAGLRQAISEVLTGATWQRCKVHTIRNVLSQVPKREQSMVASIIRTIFTHPTQEAGREQLP

SEQ ID NO: 1403 - protein, 304 aa, Artificial
  Alicyclobacillus acidocaldarius mutated SEQ ID NO 1395
MTNTKSRRHATMASLNSFAVLEWIRKMQDVDQLDFLRELMQLVTQFLIDAEAAEKIGAERYERTESRVTQRNGYRSRAWDTRLGTVDLKIPKLRQGSFFPSILEPRRRAEQALASVIQEAYVKGVSTRKVDDLVRALGLDGISKSEVSRLCQLIDEEVRQFKERPLEREYPYVWLDATFPKVREGGRVQSMALVIAIGVTDTGEREVLGFDVGTSEDGAFWSDFLRSLKARGLRGVRLVVSDAHAGLRQAISEVLTGATWQRCKVHTIRNVLSQVPKREQSMVASIIRTIFTHPTQEAGREQLP

SEQ ID NO: 1404 - protein, 304 aa, Artificial
  Alicyclobacillus acidocaldarius mutated SEQ ID NO 1395
MTNTKSRRHATMASLNSFAVLEWIRKMNDVDQIDFLRELMQLVTQFLIDAEAAEKIGAERYERTESRVTQRNGYRSRAWDTRLGTVDLKIPKLRQGSFFPSILEPRRRAEQALASVIQEAYVKGVSTRKVDDLVRALGLDGISKSEVSRLCQLIDEEVRQFKERPLEREYPYVWLDATFPKVREGGRVQSMALVIAIGVTDTGEREVLGFDVGTSEDGAFWSDFLRSLKARGLRGVRLVVSDAHAGLRQAISEVLTGATWQRCKVHTIRNVLSQVPKREQSMVASIIRTIFTHPTQEAGREQLP

SEQ ID NO: 1405 - protein, 304 aa, Artificial
  Alicyclobacillus acidocaldarius mutated SEQ ID NO 1395
MTNTKSRRHATMASLNSFAVLEWIRKMQDVDQIDFLRELMQLVTQFLIDAEAAEKIGAERYERTESRVTQRNGYRSRAWDTRLGTVDLKIPKLRQGSFFPSILEPRRRAEQALASVIQEAYVKGVSTRKVDDLVRALGLDGISKSEVSRLCQLIDEEVRQFKERPLEREYPYVWLDATFPKVREGGRVQSMALVIAIGVTDTGEREVLGFDVGTSEDGAFWSDFLRSLKARGLRGVRLVVSDAHAGLRQAISDVLTGATWQRCKVHTIRNVLSQVPKREQSMVASIIRTIFTHPTQEAGREQLP

SEQ ID NO: 1406 - protein, 304 aa, Artificial
  Alicyclobacillus acidocaldarius mutated SEQ ID NO 1395
MTNTKSRRHATMASLNSFAVLEWIRKMQDVDQIDFLRELMQLVTQFLIDAEAAEKIGAERYERTESRVTQRNGYRSRAWDTRLGTVDLKIPKLRQGSFFPSILEPRRRAEQALASVIQEAYVKGVSTRKVDDLVRALGLDGISKSEVSRLCQLIDEEVRQFKERPLEKEYPYVWLDATFPKVREGGRVQSMALVIAIGVTDTGEREVLGFDVGTSEDGAFWSDFLRSLKARGLRGVRLVVSDAHAGLRQAISEVLTGATWQRCKVHTIRNVLSQVPKREQSMVASIIRTIFTHPTQEAGREQLP

SEQ ID NO: 1407 - DNA, 915 bp, Artificial
  Alicyclobacillus acidocaldarius mutated SEQ ID NO 1396
gtgaccaacaccaaaagtaggaggcacgcaacgatggcttcgctcaatagcttcgcagttctcgaatggattcgcaagatgcaagacgtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccttactggagcccaggcgtcgagcggaacaagcgctggcttctgtgatccaggaagcgtacgtgaagggcgtgagcacccgcaaggtcgatgacctggtgcgagcgttgggcctggatggcattagcaaaagcgaggtgtctcgcctctgccagctcatcgatgaagaggttcgccagttcaaggagcggccgctcgagcgtgagtatccgtacgtgtggctggatgccacgttcccgaaggtgcgggagggcggccgcgtgcagagcatggcgctggtcatcgccattggcgtcacggacaccggagagcgcgaagtactcggattcgatgtcggaacgagcgaggacggcgcgttctggtcggactttctgcgcagcctgaaggcgcgaggtcttcggggcgtgcgtctggtggtgagcgatgcgcacgcaggcttgcgccaggccatttcggaagtgctgacgggcgcgacgtggcaacgctgcaaagtgcacacgattcggaacgtgttgagccaagtgccgaagagggagcagtcgatggtggcctcgatcatccggacgatcttcacccatcccacgcaagaagcgggccgcgagcagcttccgtga

SEQ ID NO: 1408 - DNA, 915 bp, Artificial
  Alicyclobacillus acidocaldarius mutated SEQ ID NO 1396
gtgaccaacaccaaaagtaggaggcacgcaacgatggcttcgctcaatagcttcgcagttctcgaatggattcgcaagatgcaagacgtggatcagttagattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgtcgagcggaacaagcgctggcttctgtgatccaggaagcgtacgtgaagggcgtgagcacccgcaaggtcgatgacctggtgcgagcgttgggcctggatggcattagcaaaagcgaggtgtctcgcctctgccagctcatcgatgaagaggttcgccagttcaaggagcggccgctcgagcgtgagtatccgtacgtgtggctggatgccacgttcccgaaggtgcgggagggcggccgcgtgcagagcatggcgctggtcatcgccattggcgtcacggacaccggagagcgcgaagtactcggattcgatgtcggaacgagcgaggacggcgcgttctggtcggactttctgcgcagcctgaaggcgcgaggtcttcggggcgtgcgtctggtggtgagcgatgcgcacgcaggcttgcgccaggccatttcggaagtgctgacgggcgcgacgtggcaacgctgcaaagtgcacacgattcggaacgtgttgagccaagtgccgaagagggagcagtcgatggtggcctcgatcatccggacgatcttcacccatcccacgcaagaagcgggccgcgagcagcttccgtga

SEQ ID NO: 1409 - DNA, 915 bp, Artificial
  Alicyclobacillus acidocaldarius mutated SEQ ID NO 1396
gtgaccaacaccaaaagtaggaggcacgcaacgatggcttcgctcaatagcttcgcagttctcgaatggattcgcaagatgaatgacgtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgtcgagcggaacaagcgctggcttctgtgatccaggaagcgtacgtgaagggcgtgagcacccgcaaggtcgatgacctggtgcgagcgttgggcctggatggcattagcaaaagcgaggtgtctcgcctctgccagctcatcgatgaagaggttcgccagttcaaggagcggccgctcgagcgtgagtatccgtacgtgtggctggatgccacgttcccgaaggtgcgggagggcggccgcgtgcagagcatggcgctggtcatcgccattggcgtcacggacaccggagagcgcgaagtactcggattcgatgtcggaacgagcgaggacggcgcgttctggtcggactttctgcgcagcctgaaggcgcgaggtcttcggggcgtgcgtctggtggtgagcgatgcgcacgcaggcttgcgccaggccatttcggaagtgctgacgggcgcgacgtggcaacgctgcaaagtgcacacgattcggaacgtgttgagccaagtgccgaagagggagcagtcgatggtggcctcgatcatccggacgatcttcacccatcccacgcaagaagcgggccgcgagcagcttccgtga

SEQ ID NO: 1410 - DNA, 915 bp, Artificial
  Alicyclobacillus acidocaldarius mutated SEQ ID NO 1396
gtgaccaacaccaaaagtaggaggcacgcaacgatggcttcgctcaatagcttcgcagttctcgaatggattcgcaagatgcaagacgtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgtcgagcggaacaagcgctggcttctgtgatccaggaagcgtacgtgaagggcgtgagcacccgcaaggtcgatgacctggtgcgagcgttgggcctggatggcattagcaaaagcgaggtgtctcgcctctgccagctcatcgatgaagaggttcgccagttcaaggagcggccgctcgagcgtgagtatccgtacgtgtggctggatgccacgttcccgaaggtgcgggagggcggccgcgtgcagagcatggcgctggtcatcgccattggcgtcacggacaccggagagcgcgaagtactcggattcgatgtcggaacgagcgaggacggcgcgttctggtcggactttctgcgcagcctgaaggcgcgaggtcttcggggcgtgcgtctggtggtgagcgatgcgcacgcaggcttgcgccaggccatttcggatgtgctgacgggcgcgacgtggcaacgctgcaaagtgcacacgattcggaacgtgttgagccaagtgccgaagagggagcagtcgatggtggcctcgatcatccggacgatcttcacccatcccacgcaagaagcgggccgcgagcagcttccgtga

SEQ ID NO: 1411 - DNA, 915 bp, Artificial
  Alicyclobacillus acidocaldarius mutated SEQ ID NO 1396
gtgaccaacaccaaaagtaggaggcacgcaacgatggcttcgctcaatagcttcgcagttctcgaatggattcgcaagatgcaagacgtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgtcgagcggaacaagcgctggcttctgtgatccaggaagcgtacgtgaagggcgtgagcacccgcaaggtcgatgacctggtgcgagcgttgggcctggatggcattagcaaaagcgaggtgtctcgcctctgccagctcatcgatgaagaggttcgccagttcaaggagcggccgctcgagaaagagtatccgtacgtgtggctggatgccacgttcccgaaggtgcgggagggcggccgcgtgcagagcatggcgctggtcatcgccattggcgtcacggacaccggagagcgcgaagtactcggattcgatgtcggaacgagcgaggacggcgcgttctggtcggactttctgcgcagcctgaaggcgcgaggtcttcggggcgtgcgtctggtggtgagcgatgcgcacgcaggcttgcgccaggccatttcggaagtgctgacgggcgcgacgtggcaacgctgcaaagtgcacacgattcggaacgtgttgagccaagtgccgaagagggagcagtcgatggtggcctcgatcatccggacgatcttcacccatcccacgcaagaagcgggccgcgagcagcttccgtga

SEQ ID NO: 1412 - protein, 425 aa, Alicyclobacillus acidocaldarius
MFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGEHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAIT

SEQ ID NO: 1413 - DNA, 1275 bp, Alicyclobacillus acidocaldarius
ttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagagcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgccatcacc

SEQ ID NO: 1414 - protein, 347 aa, Desulfitobacterium hafniense
MFARIKTAYNRDGSPRRYLQLVESRREEGKVRQKVLCNLGRVEDLQNGKLDDLIRSLAKFSDTLAVVDAAEDLFADWSKEFGPSMVFRRLWENLGLHKILSGLFNERELSIDVQEAIFCMVLNRLTEPTSKLGVSDWKDSVYRPEFESLKLHHFYKAIDFLDENKESIEEQLFFHQTNLFTQQLDLVFFDTTSTYVEGDAGAFDLLEYGHSKDHRPDRLQVMIGILMSRDGIPIAHHVFPGNTPDTDAFIEAVRDLKKRFTIQRVIVVGDRGMMGKRTLELLEELELHYILGVRMRNIKAGPELAASPEPYTFLKDNLKVKEVLHQEKRYIVCLNEEEAKRDRLVRE

SEQ ID NO: 1415 - protein, 347 aa, Desulfitobacterium hafniense
MFARIKTAYNRDGSPRRYLQLVESRREEGKVRQKVLCNLGRVEDLQNGKLDDLIRSLAKFSDTLAVVDAAEDLFADWSKEFGPSMVFRRLWENLGLHTILDGLFNERDLSIDVQEAIFCMVLNRLTEPTSKLGVSDWKDSVYRPEFESLKLHHFYKAIDFLDENKDTLEEQLFFHHTNLFTQQLDLVFFDTTSTYVEGDAGAFDLLEYGHSKDHRPDRLQVMIGLLMSRDGIPIAHHVFPGNTSDTDAFIEAVSDLKKRFTIQRVIVVGDRGMMGKRTLELLEELQLHYILGVRMRNVKAGPELATSPEPYVFTKDNLKVKEVLHQGKRYIVCLNEEEAKRDQWVRE

SEQ ID NO: 1416 - protein, 347 aa, Desulfitobacterium hafniense
MFARIKTAYNRDGSPRRYLQLVESRREEGKVRQKVLCNLGRVEDLQNGKLDDLIRSLAKFSDTLAVVDAAEDLFADWSKEFGPSMVFRRLWENLGLHKIFAGLFNERDLSIDVQEAIFCMVLNRLTEPTSKLGVSDWKDSVYRPEFESLKLHHFYRAIDFLDENKDTLEEQLFFHHTNLFTQQLDLVFFDTTSTYVQGDAGAFDLLEYGHSKDHRPDRLQVMIGILMSRDGIPIAHHVFPGNTPDTDAFIEAVSDLKKRFTIQRVIVVGDRGMMGKRTLELLEELQLHYILGVRMRNIKAGPELAASAQPYPFVKDNLKVKEVLHQEKRYIVCLNEEEAKRDQLVRE

SEQ ID NO: 1417 - protein, 347 aa, Desulfitobacterium hafniense
MFARIKTAYNRDGSPRRYLQIVESRREEGKVRQKVLCNLGRVEDLQNGKLDDLIRSLAKFSDKLAVVDAAEDLFADWSKEYGPSMVFNRLWDNLGLHKILDGLFSERELSIDVREAIFCMVLNRLTEPTSKLGVSDWKDSVYRPDFETLKLHHFYKAIDFLDENKDTIEEQLFFHHTNLFTQQLDLVFFDTTSTYVEGDAGAFDLLEYGHSKDHRPDRLQVMIGILMSRDGIPIAHHVFPGNTPDTDAFIEAVSDLKKRFNIQRVIVVGDRGMMGKRTLELLEELQLQYILGVRMRNIKAGPDLANSPEPYAFIKDNLKVKEVVHQEKRYIVCLNEEEAKRDQLVRE

SEQ ID NO: 1418 - protein, 296 aa, Desulfitobacterium hafniense
MFARIKTAYNRDGSPRRYLQIVESRREEGKVRQKVLCNLGRVEDLQNGKLDDLIRSLAKFSDKLAVVDAAEDLFADWSKEYGPSMVFNRLWDNLGLHKILDGLFSERELSIDVREAIFCMVLNRLTEPTSKLGVSDWKDSVYRPDFETLKLHHFYKAIDFLDENKDTIEEQLFFHHTNLFTQQLDLVFFDTTSTYVEGDAGAFDLLEYGHSKDHRPDRLQVMIGILMSRDGIPIAHHVFPGNTPDTDAFIEAVSDLKKRFNIQRVIVVGDRGMMGKRTLELLEELQLQYILGVRMR

SEQ ID NO: 1419 - protein, 425 aa, Artificial
  Alicyclobacillus acidocaldarius mutated SEQ ID NO 1412
MFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVNAMVIHRLVDPSSKLRLFHTLDDLYLPDWGGEPWQLQHFYRALDYLVDIKPQLERVLYARLTDLLNFRLSLVLYDLTSTHLHGHACPLGEHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAIT

SEQ ID NO: 1420 - protein, 425 aa, Artificial
  Alicyclobacillus acidocaldarius mutated SEQ ID NO 1412
MFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGEHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTEKGVMLKVADLLTRKGVEAFFQVDYKDGILTYRRDEDAIT

SEQ ID NO: 1421 - protein, 425 aa, Artificial
  Alicyclobacillus acidocaldarius mutated SEQ ID NO 1412
MFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLIDIKPQLERVLYARLTDLLNFRLSLVLYDLTSTHLHGHACPLGEHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAIT

SEQ ID NO: 1422 - protein, 425 aa, Artificial
  Alicyclobacillus acidocaldarius mutated SEQ ID NO 1412
MFAQIVSTKKPDGKTYKYLHIVESYREGRTVKKRRVASLGNISQYSEREIEQIIRTLESLLQHRTTGSLEDFEAQQVLHFGIPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGEHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAIT

SEQ ID NO: 1423 - protein, 425 aa, Artificial
  Alicyclobacillus acidocaldarius mutated SEQ ID NO 1412
MFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGEHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNIRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAIT

SEQ ID NO: 1424 - DNA, 1275 bp, Artificial
  Alicyclobacillus acidocaldarius mutated SEQ ID NO 1413
ttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtcaatgccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagagcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgccatcacc

SEQ ID NO: 1425 - DNA, 1275 bp, Artificial
  Alicyclobacillus acidocaldarius mutated SEQ ID NO 1413
ttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagagcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgaaaaaggcgtcatgctcaaggtggcggacctgttgaccagaaaaggggttgaagcgttttttcaggtcgattacaaggacggcatcctgacgtatcggcgcgatgaggacgccatcacc

SEQ ID NO: 1426 - DNA, 1275 bp, Artificial
  Alicyclobacillus acidocaldarius mutated SEQ ID NO 1413
ttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttattgacatcaagcctcaactggaacgcgtgttgtacgcgcgactgacagacttgctgaacttcaggctctcgttggttctgtacgacttgaccagcactcatctccacgggcacgcctgtcccttaggagagcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgccatcacc

SEQ ID NO: 1427 - DNA, 1275 bp, Artificial
  Alicyclobacillus acidocaldarius mutated SEQ ID NO 1413
ttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcattccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagagcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgccatcacc

SEQ ID NO: 1428 - DNA, 1275 bp, Artificial
  Alicyclobacillus acidocaldarius mutated SEQ ID NO 1413
ttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagagcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacattcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgccatcacc

SEQ ID NO: 1429 - protein, 120 aa, Alicyclobacillus acidocaldarius
MLAFDWTSDHRVYLVCGATDMRKSIDGLAALVQASFQLDPFSPCLFVFCNRQRDKLKILHWSHNGFWLYYRRLERGRFDWPETGDAKTMVITRRELNWLLDGLPLEQPKAHRAVPVRSAI

SEQ ID NO: 1430 - DNA, 363 bp, Alicyclobacillus acidocaldarius
ttgctagccttcgactggacttcggatcaccgcgtgtatctcgtctgcggcgccacagacatgcgcaaatccattgacggactcgccgcactcgttcaggcatcgtttcaactcgatccgttttcgccatgcctgtttgtcttctgcaatcggcaacgggacaagctcaaaatcctgcactggtcgcacaacggcttttggttgtactatcggcgcttagaacgcggtcgattcgattggccagagacaggcgatgccaagaccatggtgatcacacggcgcgagctaaactggctcctggatggcctgccgctcgagcagcccaaagcgcatcgagctgtgcctgtccgttctgcgatttaa

SEQ ID NO: 1431 - protein, 110 aa, Moorella thermoacetica; identical to SEQ ID NO: 411

SEQ ID NO: 1432 - protein, 110 aa, Pelotomaculum thermopropionicum; identical to SEQ ID NO: 412

SEQ ID NO: 1433 - protein, 112 aa, Syntrophomonas wolfei; identical to SEQ ID NO: 413

SEQ ID NO: 1434 - protein, 109 aa, Syntrophomonas wolfei; identical to SEQ ID NO: 414

SEQ ID NO: 1435 - protein, 101 aa, Bacillus selenitireducens; identical to SEQ ID NO: 415

SEQ ID NO: 1436 - protein, 120 aa, Artificial
  Alicyclobacillus acidocaldarius mutated SEQ ID NO 1429
MLAFDWTSEHRVYLVCGATDMRKSIDGLAALVQASFQLDPFSPCLFVFCNRQRDKLKILHWSHNGFWLYYRRLERGRFDWPETGDAKTMVITRRELNWLLDGLPLEQPKAHRAVPVRSAI

SEQ ID NO: 1437 - protein, 120 aa, Artificial
  Alicyclobacillus acidocaldarius mutated SEQ ID NO 1429
MLAFDWTSDHRVYLVCGATDMRKSIDGLAALVQASFQLDPFSPCLFVFCNRQRDKLKILHWSHNGFWLYYRRLERGRFDWPETGDAKTMVITRRELNWLLDGLPLEQPRAHRAVPVRSAI

SEQ ID NO: 1438 - protein, 120 aa, Artificial
  Alicyclobacillus acidocaldarius mutated SEQ ID NO 1429
MLAFDWTSDHRVYLVCGATDMRKSIDGLAALVQASFQLDPFSPCLFVFCNRQRDKLKILHWSHNGFWLYYRRLERGRFDWPDTGDAKTMVITRRELNWLLDGLPLEQPKAHRAVPVRSAI

SEQ ID NO: 1439 - protein, 120 aa, Artificial
  Alicyclobacillus acidocaldarius mutated SEQ ID NO 1429
MLAFDWTSDHRVYLVCGATDMRKSIDGLAALVQASFQLDPFSPCLFVFCNRQRDKLKILHWSHNGFWLYYRRLERGRFDWPETGDAKTMVITRRELNWLLDGLPLEQPKAHKAVPVRSAI

SEQ ID NO: 1440 - protein, 120 aa, Artificial
  Alicyclobacillus acidocaldarius mutated SEQ ID NO 1429
MLAFDWTSDHRVYLVCGATDMRKSIDGLAALVQASFQLDPFSPCLFVFCNRQRDKLKILHWSHNGFWLYYRRLERGRFDWPETGEAKTMVITRRELNWLLDGLPLEQPKAHRAVPVRSAI

SEQ ID NO: 1441 - DNA, 363 bp, Artificial
  Alicyclobacillus acidocaldarius mutated SEQ ID NO 1430
ttgctagccttcgactggacttcggaacaccgcgtgtatctcgtctgcggcgccacagacatgcgcaaatccattgacggactcgccgcactcgttcaggcatcgtttcaactcgatccgttttcgccatgcctgtttgtcttctgcaatcggcaacgggacaagctcaaaatcctgcactggtcgcacaacggcttttggttgtactatcggcgcttagaacgcggtcgattcgattggccagagacaggcgatgccaagaccatggtgatcacacggcgcgagctaaactggctcctggatggcctgccgctcgagcagcccaaagcgcatcgagctgtgcctgtccgttctgcgatttaa

SEQ ID NO: 1442 - DNA, 363 bp, Artificial
  Alicyclobacillus acidocaldarius mutated SEQ ID NO 1430
ttgctagccttcgactggacttcggatcaccgcgtgtatctcgtctgcggcgccacagacatgcgcaaatccattgacggactcgccgcactcgttcaggcatcgtttcaactcgatccgttttcgccatgcctgtttgtcttctgcaatcggcaacgggacaagctcaaaatcctgcactggtcgcacaacggcttttggttgtactatcggcgcttagaacgcggtcgattcgattggccagagacaggcgatgccaagaccatggtgatcacacggcgcgagctaaactggctcctggatggcctgccgctcgagcagccccgtgcgcatcgagctgtgcctgtccgttctgcgatttaa

SEQ ID NO: 1443 - DNA, 363 bp, Artificial
  Alicyclobacillus acidocaldarius mutated SEQ ID NO 1430
ttgctagccttcgactggacttcggatcaccgcgtgtatctcgtctgcggcgccacagacatgcgcaaatccattgacggactcgccgcactcgttcaggcatcgtttcaactcgatccgttttcgccatgcctgtttgtcttctgcaatcggcaacgggacaagctcaaaatcctgcactggtcgcacaacggcttttggttgtactatcggcgcttagaacgcggtcgattcgattggccagatacaggcgatgccaagaccatggtgatcacacggcgcgagctaaactggctcctggatggcctgccgctcgagcagcccaaagcgcatcgagctgtgcctgtccgttctgcgatttaa

SEQ ID NO: 1444 - DNA, 363 bp, Artificial
  Alicyclobacillus acidocaldarius mutated SEQ ID NO 1430
ttgctagccttcgactggacttcggatcaccgcgtgtatctcgtctgcggcgccacagacatgcgcaaatccattgacggactcgccgcactcgttcaggcatcgtttcaactcgatccgttttcgccatgcctgtttgtcttctgcaatcggcaacgggacaagctcaaaatcctgcactggtcgcacaacggcttttggttgtactatcggcgcttagaacgcggtcgattcgattggccagagacaggcgatgccaagaccatggtgatcacacggcgcgagctaaactggctcctggatggcctgccgctcgagcagcccaaagcgcataaagctgtgcctgtccgttctgcgatttaa

SEQ ID NO: 1445 - DNA, 363 bp, Artificial
  Alicyclobacillus acidocaldarius mutated SEQ ID NO 1430
ttgctagccttcgactggacttcggatcaccgcgtgtatctcgtctgcggcgccacagacatgcgcaaatccattgacggactcgccgcactcgttcaggcatcgtttcaactcgatccgttttcgccatgcctgtttgtcttctgcaatcggcaacgggacaagctcaaaatcctgcactggtcgcacaacggcttttggttgtactatcggcgcttagaacgcggtcgattcgattggccagagacaggcgaagccaagaccatggtgatcacacggcgcgagctaaactggctcctggatggcctgccgctcgagcagcccaaagcgcatcgagctgtgcctgtccgttctgcgatttaa

SEQ ID NO: 1446 - protein, 137 aa, Alicyclobacillus acidocaldarius
MRIPQDHRPQFLKIIGMNSPPPCRIVAPVIRSWEVPVMREDERMEIRQLYEAGVSISELARRFGYDRKTIRSALNSSLEEKQGERASRGERKKGSKLEPYKDYVKQRMQLGVSTLNEFCERFGSRAIPAVSPSSVSS

SEQ ID NO: 1447 - DNA, 414 bp, Alicyclobacillus acidocaldarius
atgagaattccccaagatcatcggcctcaattcctcaaaatcatcgggatgaattccccacccccatgtcgaatcgtggcacctgtcatccgttcatgggaggtgcccgtcatgagggaggacgagaggatggagatcaggcaactctacgaggctggcgtcagcatctcggaactggccagaagattcggctatgaccgtaagaccattcgcagcgcgctgaattcatcgctggaggagaagcagggcgaaagagcgtcgcgtggggagcgaaagaaaggttccaagctggagccctacaaggattacgtgaagcagcgtatgcaacttggtgtttcaacgctgaacgaattctgcgagagattcgggagcagggctataccggcggtatcaccgtcctccgtgagttcatga

SEQ ID NO: 1448 - protein, 75 aa, Symbiobacterium thermophilum
MLRSGETLEIRQMYAGGLSISEIARRTGRDRKTIRKWLRTNTMPKPAKRKRSSMLDQHEAFTLEQMQKGVTSASK

SEQ ID NO: 1449 - protein, 73 aa, Methanosarcina mazei
MLKTEEWLLIRDLYSQGFSISEIAKQTGFDRKTVRKYLRLKTLPEPQKRSGRKSKLDPFKPYIQEKLKEGPYT

SEQ ID NO: 1450 - protein, 73 aa, Methanosarcina acetivorans
MLKTEEWLSIRDLYSQGFSISEISRRTGYARETVRKYLKKKTAPEPQKRPPKPSKLDPFKPYIQEKLKEGPYT

SEQ ID NO: 1451 - protein, 58 aa, Geobacillus stearothermophilus
IKEMYERGMSISDIARELGIDRKTVRKYIHSPNPPSKSKRKQRKSKLDPFKPYLQKRM

SEQ ID NO: 1452 - protein, 58 aa, Geobacillus stearothermophilus; identical to SEQ ID NO: 1451

SEQ ID NO: 1453 - protein, 137 aa, Artificial
  Alicyclobacillus acidocaldarius mutated SEQ ID NO 1446
MRIPQDHRPQFLKIIGMNSPPPCRIVAPVIRSWEVPVMREDERMEIRQLYEAGVSISELARRFGYDRKTIRSALNSSLEEKQGERASRGDRKKGSKLEPYKDYVKQRMQLGVSTLNEFCERFGSRAIPAVSPSSVSS

SEQ ID NO: 1454 - protein, 137 aa, Artificial
  Alicyclobacillus acidocaldarius mutated SEQ ID NO 1446
MRIPQDHRPQFLKIIGMNSPPPCRIVAPVIRSWEVPVMREDERMEIRQLYEAGVSISELARRFGYDRKTIRSALNSSLEEKQGERASRGERKKGSKLEPYKDYVKQRMQIGVSTLNEFCERFGSRAIPAVSPSSVSS

SEQ ID NO: 1455 - protein, 137 aa, Artificial
  Alicyclobacillus acidocaldarius mutated SEQ ID NO 1446
MRIPQDHRPQFLKIIGMNSPPPCRIVAPVIRSWEVPVMREDERMEIRQLYEAGVSISELARRFGYERKTIRSALNSSLEEKQGERASRGERKKGSKLEPYKDYVKQRMQLGVSTLNEFCERFGSRAIPAVSPSSVSS

SEQ ID NO: 1456 - protein, 137 aa, Artificial
  Alicyclobacillus acidocaldarius mutated SEQ ID NO 1446
MRIPQDHRPQFLKIIGMNSPPPCRIVAPVIRSWEVPVMREDERMEIRQLYEAGVSISELARRFGYDRKTIRSALNSSLEEKQGERASKGERKKGSKLEPYKDYVKQRMQLGVSTLNEFCERFGSRAIPAVSPSSVSS

SEQ ID NO: 1457 - protein, 137 aa, Artificial
  Alicyclobacillus acidocaldarius mutated SEQ ID NO 1446
MRIPQDHRPQFLKIIGMNSPPPCRIVAPVIRSWEVPVMREEERMEIRQLYEAGVSISELARRFGYDRKTIRSALNSSLEEKQGERASRGERKKGSKLEPYKDYVKQRMQLGVSTLNEFCERFGSRAIPAVSPSSVSS

SEQ ID NO: 1458 - DNA, 414 bp, Artificial
  Alicyclobacillus acidocaldarius mutated SEQ ID NO 1447
atgagaattccccaagatcatcggcctcaattcctcaaaatcatcgggatgaattccccacccccatgtcgaatcgtggcacctgtcatccgttcatgggaggtgcccgtcatgagggaggacgagaggatggagatcaggcaactctacgaggctggcgtcagcatctcggaactggccagaagattcggctatgaccgtaagaccattcgcagcgcgctgaattcatcgctggaggagaagcagggcgaaagagcgtcgcgtggggatcgaaagaaaggttccaagctggagccctacaaggattacgtgaagcagcgtatgcaacttggtgtttcaacgctgaacgaattctgcgagagattcgggagcagggctataccggcggtatcaccgtcctccgtgagttcatga

SEQ ID NO: 1459 - DNA, 414 bp, Artificial
  Alicyclobacillus acidocaldarius mutated SEQ ID NO 1447
atgagaattccccaagatcatcggcctcaattcctcaaaatcatcgggatgaattccccacccccatgtcgaatcgtggcacctgtcatccgttcatgggaggtgcccgtcatgagggaggacgagaggatggagatcaggcaactctacgaggctggcgtcagcatctcggaactggccagaagattcggctatgaccgtaagaccattcgcagcgcgctgaattcatcgctggaggagaagcagggcgaaagagcgtcgcgtggggagcgaaagaaaggttccaagctggagccctacaaggattacgtgaagcagcgtatgcaaattggtgtttcaacgctgaacgaattctgcgagagattcgggagcagggctataccggcggtatcaccgtcctccgtgagttcatga

SEQ ID NO: 1460 - DNA, 414 bp, Artificial
  Alicyclobacillus acidocaldarius mutated SEQ ID NO 1447
atgagaattccccaagatcatcggcctcaattcctcaaaatcatcgggatgaattccccacccccatgtcgaatcgtggcacctgtcatccgttcatgggaggtgcccgtcatgagggaggacgagaggatggagatcaggcaactctacgaggctggcgtcagcatctcggaactggccagaagattcggctatgaacgtaagaccattcgcagcgcgctgaattcatcgctggaggagaagcagggcgaaagagcgtcgcgtggggagcgaaagaaaggttccaagctggagccctacaaggattacgtgaagcagcgtatgcaacttggtgtttcaacgctgaacgaattctgcgagagattcgggagcagggctataccggcggtatcaccgtcctccgtgagttcatga

SEQ ID NO: 1461 - DNA, 414 bp, Artificial
  Alicyclobacillus acidocaldarius mutated SEQ ID NO 1447
atgagaattccccaagatcatcggcctcaattcctcaaaatcatcgggatgaattccccacccccatgtcgaatcgtggcacctgtcatccgttcatgggaggtgcccgtcatgagggaggacgagaggatggagatcaggcaactctacgaggctggcgtcagcatctcggaactggccagaagattcggctatgaccgtaagaccattcgcagcgcgctgaattcatcgctggaggagaagcagggcgaaagagcgtcgaaaggggagcgaaagaaaggttccaagctggagccctacaaggattacgtgaagcagcgtatgcaacttggtgtttcaacgctgaacgaattctgcgagagattcgggagcagggctataccggcggtatcaccgtcctccgtgagttcatga

SEQ ID NO: 1462 - DNA, 414 bp, Artificial
  Alicyclobacillus acidocaldarius mutated SEQ ID NO 1447
atgagaattccccaagatcatcggcctcaattcctcaaaatcatcgggatgaattccccacccccatgtcgaatcgtggcacctgtcatccgttcatgggaggtgcccgtcatgagggaggaagagaggatggagatcaggcaactctacgaggctggcgtcagcatctcggaactggccagaagattcggctatgaccgtaagaccattcgcagcgcgctgaattcatcgctggaggagaagcagggcgaaagagcgtcgcgtggggagcgaaagaaaggttccaagctggagccctacaaggattacgtgaagcagcgtatgcaacttggtgtttcaacgctgaacgaattctgcgagagattcgggagcagggctataccggcggtatcaccgtcctccgtgagttcatga

SEQ ID NO: 1463 - protein, 332 aa, Alicyclobacillus acidocaldarius
MDERLISAEWMREDAQLDTIRPRFLDDYIGQRAAVENLRIFIQAAKERGEPLDHVLLYGPPGLGKTSLAMIIANELGVQIRVTSGPAIERAGDLAAILTNLQPGDVLFIDEIHRLSPSVEEVLYPAMEDFAIDIVIGKGPSARSVRLDLPPFTLIGATTRAGLLSHPLRDRFGVMLHLDYYPVRDLAEIVKRNARILQLSITEDGCAEIARRARGTPRIANRLLKRVRDIAQVAGWPEIDAARAAEALAQLHVDPLGLDATDKRILEAAMDKFGGGPVGLDTLAAAVGEEPSTLEDVYEPYLLQIGFLKRTPRGRVVMPSAYRHLGRAVPSG

SEQ ID NO: 1464 - DNA, 999 bp, Alicyclobacillus acidocaldarius
atggacgagcgattgatttctgccgaatggatgcgcgaggacgcgcagcttgacaccattcgcccccgttttctcgacgactacatcggccagcgcgccgccgtggaaaacctgcggatcttcattcaggccgccaaggagcgcggagagccgctcgatcacgtcctgctgtacggtccgcccggcctcggcaagacgtccctcgcgatgatcatcgccaacgagctcggcgtccaaatccgggtgacctccggtccggccattgagcgcgcgggcgatctcgccgccatcctgacgaatctgcagccgggcgacgtgctgttcatcgacgagatccaccgcctgtcgccgagcgtcgaagaggtcctctatccggccatggaggactttgcgattgatatcgtcatcggcaaaggtccaagcgcccgctcggtgaggctggatctccctccgttcacgctgatcggcgccacgacgcgcgcggggctcctgtcgcacccgttgcgcgaccgtttcggcgtgatgctgcatttggactactatccggtgcgcgatctcgccgagatcgtgaaacgcaacgcgcgcattctccaactcagcatcacggaggacgggtgcgccgagatcgcccgccgagcgcggggaacgccgcgaattgcgaatcggctgctgaagcgggtgcgcgatatcgcgcaggtcgcgggctggcccgagatcgacgcggcgagggccgcagaggcgctcgcgcaactgcacgtggatcccctggggctcgacgctaccgacaagcggatcctggaggcggcgatggacaagttcggcgggggcccggtcgggctcgacacgctcgcggccgcggtcggcgaggagccctcgacgctcgaggacgtgtacgaaccgtacttgctccagatcggcttcttgaagcggaccccgcgcggccgcgtcgtcatgccgtccgcctaccgccacctggggcgcgccgtgccttcaggctga

SEQ ID NO: 1465 - protein, 325 aa, Moorella thermoacetica
ERLVAGNLHNEDQELELSLRPRCLAEYIGQEHVKETLGIFIQAARERGEALDHVLLYGPPGLGKTTLAGIIANELGVQLRVTSGPALERAGDLAAILTNLQPRDVLFIDEIHRLPRQVEEILYPAMEDFVLDIILGKGPGARSIRLDLPPFTLVGATTRAGLLSSPLRDRFGINSRLEFYQVAELEEIIRRAATILQVAIEPEGAREIARRARGTPRVANRLLKRVRDYAEIRAGGVITREVAREALELLQVDAAGLDSSDRRLLLTLIRKFNGGPVGLETLAAAISEEPDTIEDVYEPFLLQMGYLQRTPRGRVATPGAYAHLG

SEQ ID NO: 1466 - protein, 331 aa, Geobacillus kaustophilus
MEERLVSGEVLGEETALEPSLRPQYLHEYIGQDKIKENLKVFIEAAKLREETLDHVLLYGPPGLGKTTLAVIIANEMGVKLRATSGPALERPGDLAALLTSLEPGDVLFIDEIHRLPRAVEEVLYPAMEDYCLDITIGKGPDARTLRLDLPPFTLVGATTRAGALSAPLRDRFGVISRLEYYHVDQLAQIIERAAAILQIGIEREAALELARRARGTPRIANRLLRRVRDFAQVRGEGGITLPLAVEALERLQVDRLGLDQIDHKLLSAMIEKFAGGPVGLETLAAVIGEEAQTIEEVYEPYLMQIGLLQRTPRGRVVTPAAYTHLGMEVP

SEQ ID NO: 1467 - protein, 331 aa, Bacillus cereus
MDERLLSGESAYEDADLEYSLRPQTLRQYIGQDKAKHNLEVFIEAAKMREETLDHVLLYGPPGLGKTTLANIIANEMGVNVRTTSGPAIERPGDLAAVLTSLQPGDVLFIDEIHRLHRSIEEVLYPAMEDFCLDIVIGKGPSARSVRLDLPPFTLVGATTRAGALSAPLRDRFGVLSRLEYYTVDQLSEIVERTAEVFEVEIDSLAALEIARRARGTPRIANRLLRRVRDFAQVRGNGTVTMEITQMALELLQVDKLGLDHIDHKLLLGIIEKFRGGPVGLETVSATIGEESHTIEDVYEPYLLQIGFLQRTPRGRIVTPLAYEHFGMEMP

SEQ ID NO: 1468 - protein, 327 aa, Pelotomaculum thermopropionicum
MKDRLISAVARPEDADVDTSLRPRLLAEYIGQEKVKETISVFIQAARGRGEPLDHVLLFGPPGLGKTTLANIIANEMGVSIRTTSGPAVERPGDLAAILTSLSQGDILFIDEIHRLSRTVEEVLYPAMEDYALDIVIGKGPGARSLRLELPRFTLVGATTRAGLLTSPLRDRFGVISRLEYYRPEDLVLIVNRSARILGIEITAEGAFEIARRSRGTPRVANRLLKRVRDYAQVRANGVITCEVAVEALKFLEVDPLGLDFADRRLLLTIIQKFGGGPVGLETIATAVNEEPETVEDVYEPYLIQLGMLARTPRGRVTTPLAFRHLG

SEQ ID NO: 1469 - protein, 332 aa, Bacillus halodurans
MEERMVSAEAQTEEAAVEQGIRPHSFEQYIGQEKVKQNLKVFIEAAKMREEALDHVLLYGPPGLGKTTLSTIIANELGVQMRTTSGPAIERPGDLAAILTALEPGDVLFIDEIHRLNRMVEEVLYPAMEDYCIDIVIGKGPTARSVRLDLPPFTLVGATTRAGMLSSPLRDRFGVMARLEYYNVEELTTIIERTATIFDTELERDASIEIARRSRGTPRIANRLLRRVRDFAQVSGDMRISSSRAIESLERLQVDRLGLDHIDHKLIKGIMTKFNGGPVGLETISATIGEETDTIEEVYEPYLLQIGFLQRTPRGRVVTPLAYEHFNMEVPN

SEQ ID NO: 1470 - protein, 332 aa, Artificial
  Alicyclobacillus acidocaldarius mutated SEQ ID NO 1463
MDERLISAEWMREDAQLDTIRPRFLDDYIGQRAAVENLRIFIQAAKDRGEPLDHVLLYGPPGLGKTSLAMIIANELGVQIRVTSGPAIERAGDLAAILTNLQPGDVLFIDEIHRLSPSVEEVLYPAMEDFAIDIVIGKGPSARSVRLDLPPFTLIGATTRAGLLSHPLRDRFGVMLHLDYYPVRDLAEIVKRNARILQLSITEDGCAEIARRARGTPRIANRLLKRVRDIAQVAGWPEIDAARAAEALAQLHVDPLGLDATDKRILEAAMDKFGGGPVGLDTLAAAVGEEPSTLEDVYEPYLLQIGFLKRTPRGRVVMPSAYRHLGRAVPSG

SEQ ID NO: 1471 - protein, 332 aa, Artificial
  Alicyclobacillus acidocaldarius mutated SEQ ID NO 1463
MEERLISAEWMREDAQLDTIRPRFLDDYIGQRAAVENLRIFIQAAKERGEPLDHVLLYGPPGLGKTSLAMIIANELGVQIRVTSGPAIERAGDLAAILTNLQPGDVLFIDEIHRLSPSVEEVLYPAMEDFAIDIVIGKGPSARSVRLDLPPFTLIGATTRAGLLSHPLRDRFGVMLHLDYYPVRDLAEIVKRNARILQLSITEDGCAEIARRARGTPRIANRLLKRVRDIAQVAGWPEIDAARAAEALAQLHVDPLGLDATDKRILEAAMDKFGGGPVGLDTLAAAVGEEPSTLEDVYEPYLLQIGFLKRTPRGRVVMPSAYRHLGRAVPSG

SEQ ID NO: 1472 - protein, 332 aa, Artificial
  Alicyclobacillus acidocaldarius mutated SEQ ID NO 1463
MDERLISADWMREDAQLDTIRPRFLDDYIGQRAAVENLRIFIQAAKERGEPLDHVLLYGPPGLGKTSLAMIIANELGVQIRVTSGPAIERAGDLAAILTNLQPGDVLFIDEIHRLSPSVEEVLYPAMEDFAIDIVIGKGPSARSVRLDLPPFTLIGATTRAGLLSHPLRDRFGVMLHLDYYPVRDLAEIVKRNARILQLSITEDGCAEIARRARGTPRIANRLLKRVRDIAQVAGWPEIDAARAAEALAQLHVDPLGLDATDKRILEAAMDKFGGGPVGLDTLAAAVGEEPSTLEDVYEPYLLQIGFLKRTPRGRVVMPSAYRHLGRAVPSG

SEQ ID NO: 1473 - protein, 332 aa, Artificial
  Alicyclobacillus acidocaldarius mutated SEQ ID NO 1463
MDERLISAEWMREDAQLDTIRPRFLDDYIGQRAAVENLRIFIQAAKERGEPLDHVLLYGPPGLGKTSLAMIIANELGVQIRVTSGPAIERAGDLAAILTNLQPGDVLFIDEIHRLSPSVEEVLYPAMEDFAIDIVIGKGPSARSVRLDLPPFTLIGATTRAGLLSHPLRDRFGVMLHLDYYPVRDLAEIVKRNARILQLSITEDGCAEIARRARGTPRIANRLLKRVRDIAQVAGWPEIDAARAAEALAQLHVDPLGLDATDKRILEAAMDKFGGGPVGLDTLAAAVGEEPSTLEDVYEPYLLQIGFLKRTPRGRVVMPSAYRHLGKAVPSG

SEQ ID NO: 1474 - protein, 332 aa, Artificial
  Alicyclobacillus acidocaldarius mutated SEQ ID NO 1463
MDERLISAEWMREDAQLDTIRPRFLDDYIGQRAAVENLRIFIQAAKERGEPLDHVLLYGPPGLGKTSLAMIIANELGVQIRVTSGPAIERAGDLAAILTNLQPGDVLFIDEIHRLSPSVEEVLYPAMEDFAIDIVIGKGPSARSVRLDLPPFTLIGATTRAGLLSHPLRDRFGVMLHLDYYPVRDLAEIVKRNAKILQLSITEDGCAEIARRARGTPRIANRLLKRVRDIAQVAGWPEIDAARAAEALAQLHVDPLGLDATDKRILEAAMDKFGGGPVGLDTLAAAVGEEPSTLEDVYEPYLLQIGFLKRTPRGRVVMPSAYRHLGRAVPSG

SEQ ID NO: 1475 - DNA, 999 bp, Artificial
  Alicyclobacillus acidocaldarius mutated SEQ ID NO 1464
atggacgagcgattgatttctgccgaatggatgcgcgaggacgcgcagcttgacaccattcgcccccgttttctcgacgactacatcggccagcgcgccgccgtggaaaacctgcggatcttcattcaggccgccaaggatcgcggagagccgctcgatcacgtcctgctgtacggtccgcccggcctcggcaagacgtccctcgcgatgatcatcgccaacgagctcggcgtccaaatccgggtgacctccggtccggccattgagcgcgcgggcgatctcgccgccatcctgacgaatctgcagccgggcgacgtgctgttcatcgacgagatccaccgcctgtcgccgagcgtcgaagaggtcctctatccggccatggaggactttgcgattgatatcgtcatcggcaaaggtccaagcgcccgctcggtgaggctggatctccctccgttcacgctgatcggcgccacgacgcgcgcggggctcctgtcgcacccgttgcgcgaccgtttcggcgtgatgctgcatttggactactatccggtgcgcgatctcgccgagatcgtgaaacgcaacgcgcgcattctccaactcagcatcacggaggacgggtgcgccgagatcgcccgccgagcgcggggaacgccgcgaattgcgaatcggctgctgaagcgggtgcgcgatatcgcgcaggtcgcgggctggcccgagatcgacgcggcgagggccgcagaggcgctcgcgcaactgcacgtggatcccctggggctcgacgctaccgacaagcggatcctggaggcggcgatggacaagttcggcgggggcccggtcgggctcgacacgctcgcggccgcggtcggcgaggagccctcgacgctcgaggacgtgtacgaaccgtacttgctccagatcggcttcttgaagcggaccccgcgcggccgcgtcgtcatgccgtccgcctaccgccacctggggcgcgccgtgccttcaggctga

SEQ ID NO: 1476 - DNA, 999 bp, Artificial
  Alicyclobacillus acidocaldarius mutated SEQ ID NO 1464
atggaagagcgattgatttctgccgaatggatgcgcgaggacgcgcagcttgacaccattcgcccccgttttctcgacgactacatcggccagcgcgccgccgtggaaaacctgcggatcttcattcaggccgccaaggagcgcggagagccgctcgatcacgtcctgctgtacggtccgcccggcctcggcaagacgtccctcgcgatgatcatcgccaacgagctcggcgtccaaatccgggtgacctccggtccggccattgagcgcgcgggcgatctcgccgccatcctgacgaatctgcagccgggcgacgtgctgttcatcgacgagatccaccgcctgtcgccgagcgtcgaagaggtcctctatccggccatggaggactttgcgattgatatcgtcatcggcaaaggtccaagcgcccgctcggtgaggctggatctccctccgttcacgctgatcggcgccacgacgcgcgcggggctcctgtcgcacccgttgcgcgaccgtttcggcgtgatgctgcatttggactactatccggtgcgcgatctcgccgagatcgtgaaacgcaacgcgcgcattctccaactcagcatcacggaggacgggtgcgccgagatcgcccgccgagcgcggggaacgccgcgaattgcgaatcggctgctgaagcgggtgcgcgatatcgcgcaggtcgcgggctggcccgagatcgacgcggcgagggccgcagaggcgctcgcgcaactgcacgtggatcccctggggctcgacgctaccgacaagcggatcctggaggcggcgatggacaagttcggcgggggcccggtcgggctcgacacgctcgcggccgcggtcggcgaggagccctcgacgctcgaggacgtgtacgaaccgtacttgctccagatcggcttcttgaagcggaccccgcgcggccgcgtcgtcatgccgtccgcctaccgccacctggggcgcgccgtgccttcaggctga

SEQ ID NO: 1477 - DNA, 999 bp, Artificial
  Alicyclobacillus acidocaldarius mutated SEQ ID NO 1464
atggacgagcgattgatttctgccgattggatgcgcgaggacgcgcagcttgacaccattcgcccccgttttctcgacgactacatcggccagcgcgccgccgtggaaaacctgcggatcttcattcaggccgccaaggagcgcggagagccgctcgatcacgtcctgctgtacggtccgcccggcctcggcaagacgtccctcgcgatgatcatcgccaacgagctcggcgtccaaatccgggtgacctccggtccggccattgagcgcgcgggcgatctcgccgccatcctgacgaatctgcagccgggcgacgtgctgttcatcgacgagatccaccgcctgtcgccgagcgtcgaagaggtcctctatccggccatggaggactttgcgattgatatcgtcatcggcaaaggtccaagcgcccgctcggtgaggctggatctccctccgttcacgctgatcggcgccacgacgcgcgcggggctcctgtcgcacccgttgcgcgaccgtttcggcgtgatgctgcatttggactactatccggtgcgcgatctcgccgagatcgtgaaacgcaacgcgcgcattctccaactcagcatcacggaggacgggtgcgccgagatcgcccgccgagcgcggggaacgccgcgaattgcgaatcggctgctgaagcgggtgcgcgatatcgcgcaggtcgcgggctggcccgagatcgacgcggcgagggccgcagaggcgctcgcgcaactgcacgtggatcccctggggctcgacgctaccgacaagcggatcctggaggcggcgatggacaagttcggcgggggcccggtcgggctcgacacgctcgcggccgcggtcggcgaggagccctcgacgctcgaggacgtgtacgaaccgtacttgctccagatcggcttcttgaagcggaccccgcgcggccgcgtcgtcatgccgtccgcctaccgccacctggggcgcgccgtgccttcaggctga

SEQ ID NO: 1478 - DNA, 999 bp, Artificial
  Alicyclobacillus acidocaldarius mutated SEQ ID NO 1464
atggacgagcgattgatttctgccgaatggatgcgcgaggacgcgcagcttgacaccattcgcccccgttttctcgacgactacatcggccagcgcgccgccgtggaaaacctgcggatcttcattcaggccgccaaggagcgcggagagccgctcgatcacgtcctgctgtacggtccgcccggcctcggcaagacgtccctcgcgatgatcatcgccaacgagctcggcgtccaaatccgggtgacctccggtccggccattgagcgcgcgggcgatctcgccgccatcctgacgaatctgcagccgggcgacgtgctgttcatcgacgagatccaccgcctgtcgccgagcgtcgaagaggtcctctatccggccatggaggactttgcgattgatatcgtcatcggcaaaggtccaagcgcccgctcggtgaggctggatctccctccgttcacgctgatcggcgccacgacgcgcgcggggctcctgtcgcacccgttgcgcgaccgtttcggcgtgatgctgcatttggactactatccggtgcgcgatctcgccgagatcgtgaaacgcaacgcgcgcattctccaactcagcatcacggaggacgggtgcgccgagatcgcccgccgagcgcggggaacgccgcgaattgcgaatcggctgctgaagcgggtgcgcgatatcgcgcaggtcgcgggctggcccgagatcgacgcggcgagggccgcagaggcgctcgcgcaactgcacgtggatcccctggggctcgacgctaccgacaagcggatcctggaggcggcgatggacaagttcggcgggggcccggtcgggctcgacacgctcgcggccgcggtcggcgaggagccctcgacgctcgaggacgtgtacgaaccgtacttgctccagatcggcttcttgaagcggaccccgcgcggccgcgtcgtcatgccgtccgcctaccgccacctggggaaagccgtgccttcaggctga

SEQ ID NO: 1479 - DNA, 999 bp, Artificial
  Alicyclobacillus acidocaldarius mutated SEQ ID NO 1464
atggacgagcgattgatttctgccgaatggatgcgcgaggacgcgcagcttgacaccattcgcccccgttttctcgacgactacatcggccagcgcgccgccgtggaaaacctgcggatcttcattcaggccgccaaggagcgcggagagccgctcgatcacgtcctgctgtacggtccgcccggcctcggcaagacgtccctcgcgatgatcatcgccaacgagctcggcgtccaaatccgggtgacctccggtccggccattgagcgcgcgggcgatctcgccgccatcctgacgaatctgcagccgggcgacgtgctgttcatcgacgagatccaccgcctgtcgccgagcgtcgaagaggtcctctatccggccatggaggactttgcgattgatatcgtcatcggcaaaggtccaagcgcccgctcggtgaggctggatctccctccgttcacgctgatcggcgccacgacgcgcgcggggctcctgtcgcacccgttgcgcgaccgtttcggcgtgatgctgcatttggactactatccggtgcgcgatctcgccgagatcgtgaaacgcaacgcgaaaattctccaactcagcatcacggaggacgggtgcgccgagatcgcccgccgagcgcggggaacgccgcgaattgcgaatcggctgctgaagcgggtgcgcgatatcgcgcaggtcgcgggctggcccgagatcgacgcggcgagggccgcagaggcgctcgcgcaactgcacgtggatcccctggggctcgacgctaccgacaagcggatcctggaggcggcgatggacaagttcggcgggggcccggtcgggctcgacacgctcgcggccgcggtcggcgaggagccctcgacgctcgaggacgtgtacgaaccgtacttgctccagatcggcttcttgaagcggaccccgcgcggccgcgtcgtcatgccgtccgcctaccgccacctggggcgcgccgtgccttcaggctga

SEQ ID NO: 1480 - protein, 215 aa, Alicyclobacillus acidocaldarius
MGTGAFSVIAFLRGRVAFLGPGYVDLDVRDVGYRVHVCDRTQAALNLGDTAFLYTHHHVREDGWALYGFETIEERALFERLVAVSGIGPKLALQVIGAAGVGEIVAAILAEDAESLSRLPGIGRKLASRLVVELREKLDDLAPAALRAPAPASSPQGSAAEDAVSALVALGYRPREAEEAVSAVGRGRQSVEDTIKAALTYLYARDARTEPLSQP

SEQ ID NO: 1481 - DNA, 648 bp, Alicyclobacillus acidocaldarius
gtgggaacgggggcgttttcggtgatcgctttcttgcgggggcgcgtggcgttcctcggtccgggttatgtcgatctcgacgtgagagacgtgggctaccgcgtgcacgtgtgcgaccgcacacaggcggcgctgaacctcggtgacaccgcattcttgtatacacaccatcatgtgcgcgaggacggctgggcgctgtacggcttcgagacaatcgaggaacgggccctgtttgaacgcctggtggcggtgtccgggattggacccaagctggcgcttcaggtcattggcgccgcaggcgtgggcgagatcgtcgcggccatcctggcggaggacgccgaaagcttgagtcgcctgcctggcatcggccgcaaactcgcgagtcggttggtcgtggagttgcgcgagaagctcgacgacttggcgcccgctgccttgcgcgcccccgctcccgcgtctagcccgcagggctcggcggcggaggacgcggtgtcggcgcttgtcgcgctcgggtaccgccctcgggaggccgaagaggcggtgtctgcggtcggcagaggccgccagtccgtcgaagacaccatcaaggcggcgctgacgtatctgtacgcgcgagacgcgcgaaccgagccgctgtcgcaaccgtag

SEQ ID NO: 1482 - protein, 198 aa, Pseudomonas syringae
MIGRLRGSLAEKQPPHLVLDVNGVGYEVEVPMTTLYRLPHVGETVTLHTHLVVREDAHLLYGFYEKRERELFRELIRLNGVGPKLALALMSGLEVDELVRCVQAQDTSALTRIPGVGKKTAERLLVELKDRFKAWEALPGTFTLVSNGPNQAEPVASAESDAVSALISLGYKPQEASKAVSAIKEKDLSSADLIRRAL

SEQ ID NO: 1483 - protein, 198 aa, Pseudomonas syringae
MIGRLRGAIAEKQPPHLVLDVNGVGYELEVPMTTLYRLPHVGETVTLHTHLVVREDAHLLYGFYEKRERELFRELIRLNGVGPKLALALMSGLEVDELVRCVQAQDTSALTRIPGVGKKTAERLLVELKDRFKAWESLPGTFTLVSNGPNHADPVASAESDAVSALISLGYKPQEASKAVSAIKEKDLSSADLIRRAL

SEQ ID NO: 1484 - protein, 198 aa, Pseudomonas syringae
MIGRLRGSLAEKQPPHLVLDVNGVGYELEVPMTTLYRLPHVGETVTLHTHLVVREDAHLLYGFYEKRERELFRELIRLNGVGPKLALALMSGLEVDELVRCVQAQDTSALTRIPGVGKKTAERLLVELKDRFKAWESLPGTFTLVSNGPNQAEPVASAESDAVSALISLGYKPQEASKAVSAIKEKDLSSADLIRRAL

SEQ ID NO: 1485 - protein, 199 aa, Vibrio splendidus
MIGRLRGTLIEKQPPELLIEVSGVGYEVQMPMSCFYELPNVGEEAIIYTHFVVREDAQLLYGFNTVKERALFREVIKANGVGPKLGLGILSGMTASQFVQSVEREDISTLVKLPGVGKKTAERLVVEMKDRLKGWGAGDLFTPATDAAPMDSMPTVHDAEEEAVSALLALGYKPTQASKVVAQVAKGGMTSEQLIREAL

SEQ ID NO: 1486 - protein, 197 aa, Pseudomonas mendocina
VIGRLRGTLAEKQPPHLLLDVNGVGYELEVPMTTLYRLPAVGETLTLHTHQVVREDAHLLYGFFEKRERELFRELIRLNGVGPKLALALMSGLEVDELVRCVQAQDTAALTKVPGVGKKTAERLLVELKDRFKAWETMPAIATLVVEPRLGATVSSAENDAVSALISLGYKPQEASRAVAAVKEDGLSSEDLIRRAL

SEQ ID NO: 1487 - protein, 215 aa, Artificial
  Alicyclobacillus acidocaldarius mutated SEQ ID NO 1480
MGTGAFSVIAFLRGRVAFLGPGYVDLDVRDVGYRVHVCDRTQAALQLGDTAFLYTHHHVREDGWALYGFETIEERALFERLVAVSGIGPKLALQVIGAAGVGEIVAAILAEDAESLSRLPGIGRKLASRLVVELREKLDDLAPAALRAPAPASSPQGSAAEDAVSALVALGYRPREAEEAVSAVGRGRQSVEDTIKAALTYLYARDARTEPLSQP

SEQ ID NO: 1488 - protein, 215 aa, Artificial
  Alicyclobacillus acidocaldarius mutated SEQ ID NO 1480
MGTGAFSVIAFLRGRVAFLGPGYVDLDVRDVGYRVHVCDKTQAALNLGDTAFLYTHHHVREDGWALYGFETIEERALFERLVAVSGIGPKLALQVIGAAGVGEIVAAILAEDAESLSRLPGIGRKLASRLVVELREKLDDLAPAALRAPAPASSPQGSAAEDAVSALVALGYRPREAEEAVSAVGRGRQSVEDTIKAALTYLYARDARTEPLSQP

SEQ ID NO: 1489 - protein, 215 aa, Artificial
  Alicyclobacillus acidocaldarius mutated SEQ ID NO 1480
MGTGAFSVIAFLRGRVAFLGPGYVDLDVRDVGYRVHVCDRTQAALNLGDTAFLYTHHHVREDGWALYGFETIEERALFERLVAVSGIGPKLALQVIGAAGVGEIVAAILAEDAESLSRLPGIGRKLASRLVVELREKLDDLAPAALRAPAPASSPNGSAAEDAVSALVALGYRPREAEEAVSAVGRGRQSVEDTIKAALTYLYARDARTEPLSQP

SEQ ID NO: 1490 - protein, 215 aa, Artificial
  Alicyclobacillus acidocaldarius mutated SEQ ID NO 1480
MGTGAFSVIAFLRGRVAFLGPGYVDLDVRDVGYRVHVCDRTQAALNLGDTAFLYTHHHVREDGWALYGFETIEERALFERLVAVSGIGPKLALQVIGAAGVGEIVAAILAEDADSLSRLPGIGRKLASRLVVELREKLDDLAPAALRAPAPASSPQGSAAEDAVSALVALGYRPREAEEAVSAVGRGRQSVEDTIKAALTYLYARDARTEPLSQP

SEQ ID NO: 1491 - protein, 215 aa, Artificial
  Alicyclobacillus acidocaldarius mutated SEQ ID NO 1480
MGTGAFSVIAFLRGRVAFLGPGYVDLDVRDVGYRVHVCDRTQAALNLGDTAFLYTHHHVREDGWALYGFETIEERALFERLVAVSGIGPKLALQVIGAAGVGEIVAAILAEDAESLSRLPGIGRKLASRLVVELREKLDDLAPAALRAPAPASSPQGSAAEDAVSALVALGYRPREAEEAVSAVGRGRQSVEDTIKAALTYLYARDARTEPLSNP

SEQ ID NO: 1492 - DNA, 648 bp, Artificial
  Alicyclobacillus acidocaldarius mutated SEQ ID NO 1481
gtgggaacgggggcgttttcggtgatcgctttcttgcgggggcgcgtggcgttcctcggtccgggttatgtcgatctcgacgtgagagacgtgggctaccgcgtgcacgtgtgcgaccgcacacaggcggcgctgcaactcggtgacaccgcattcttgtatacacaccatcatgtgcgcgaggacggctgggcgctgtacggcttcgagacaatcgaggaacgggccctgtttgaacgcctggtggcggtgtccgggattggacccaagctggcgcttcaggtcattggcgccgcaggcgtgggcgagatcgtcgcggccatcctggcggaggacgccgaaagcttgagtcgcctgcctggcatcggccgcaaactcgcgagtcggttggtcgtggagttgcgcgagaagctcgacgacttggcgcccgctgccttgcgcgcccccgctcccgcgtctagcccgcagggctcggcggcggaggacgcggtgtcggcgcttgtcgcgctcgggtaccgccctcgggaggccgaagaggcggtgtctgcggtcggcagaggccgccagtccgtcgaagacaccatcaaggcggcgctgacgtatctgtacgcgcgagacgcgcgaaccgagccgctgtcgcaaccgtag

SEQ ID NO: 1493 - DNA, 648 bp, Artificial
  Alicyclobacillus acidocaldarius mutated SEQ ID NO 1481
gtgggaacgggggcgttttcggtgatcgctttcttgcgggggcgcgtggcgttcctcggtccgggttatgtcgatctcgacgtgagagacgtgggctaccgcgtgcacgtgtgcgacaaaacacaggcggcgctgaacctcggtgacaccgcattcttgtatacacaccatcatgtgcgcgaggacggctgggcgctgtacggcttcgagacaatcgaggaacgggccctgtttgaacgcctggtggcggtgtccgggattggacccaagctggcgcttcaggtcattggcgccgcaggcgtgggcgagatcgtcgcggccatcctggcggaggacgccgaaagcttgagtcgcctgcctggcatcggccgcaaactcgcgagtcggttggtcgtggagttgcgcgagaagctcgacgacttggcgcccgctgccttgcgcgcccccgctcccgcgtctagcccgcagggctcggcggcggaggacgcggtgtcggcgcttgtcgcgctcgggtaccgccctcgggaggccgaagaggcggtgtctgcggtcggcagaggccgccagtccgtcgaagacaccatcaaggcggcgctgacgtatctgtacgcgcgagacgcgcgaaccgagccgctgtcgcaaccgtag

SEQ ID NO: 1494 - DNA, 648 bp, Artificial
  Alicyclobacillus acidocaldarius mutated SEQ ID NO 1481
gtgggaacgggggcgttttcggtgatcgctttcttgcgggggcgcgtggcgttcctcggtccgggttatgtcgatctcgacgtgagagacgtgggctaccgcgtgcacgtgtgcgaccgcacacaggcggcgctgaacctcggtgacaccgcattcttgtatacacaccatcatgtgcgcgaggacggctgggcgctgtacggcttcgagacaatcgaggaacgggccctgtttgaacgcctggtggcggtgtccgggattggacccaagctggcgcttcaggtcattggcgccgcaggcgtgggcgagatcgtcgcggccatcctggcggaggacgccgaaagcttgagtcgcctgcctggcatcggccgcaaactcgcgagtcggttggtcgtggagttgcgcgagaagctcgacgacttggcgcccgctgccttgcgcgcccccgctcccgcgtctagcccgaatggctcggcggcggaggacgcggtgtcggcgcttgtcgcgctcgggtaccgccctcgggaggccgaagaggcggtgtctgcggtcggcagaggccgccagtccgtcgaagacaccatcaaggcggcgctgacgtatctgtacgcgcgagacgcgcgaaccgagccgctgtcgcaaccgtag

SEQ ID NO: 1495 - DNA, 648 bp, Artificial
  Alicyclobacillus acidocaldarius mutated SEQ ID NO 1481
gtgggaacgggggcgttttcggtgatcgctttcttgcgggggcgcgtggcgttcctcggtccgggttatgtcgatctcgacgtgagagacgtgggctaccgcgtgcacgtgtgcgaccgcacacaggcggcgctgaacctcggtgacaccgcattcttgtatacacaccatcatgtgcgcgaggacggctgggcgctgtacggcttcgagacaatcgaggaacgggccctgtttgaacgcctggtggcggtgtccgggattggacccaagctggcgcttcaggtcattggcgccgcaggcgtgggcgagatcgtcgcggccatcctggcggaggacgccgatagcttgagtcgcctgcctggcatcggccgcaaactcgcgagtcggttggtcgtggagttgcgcgagaagctcgacgacttggcgcccgctgccttgcgcgcccccgctcccgcgtctagcccgcagggctcggcggcggaggacgcggtgtcggcgcttgtcgcgctcgggtaccgccctcgggaggccgaagaggcggtgtctgcggtcggcagaggccgccagtccgtcgaagacaccatcaaggcggcgctgacgtatctgtacgcgcgagacgcgcgaaccgagccgctgtcgcaaccgtag

SEQ ID NO: 1496 - DNA, 648 bp, Artificial
  Alicyclobacillus acidocaldarius mutated SEQ ID NO 1481
gtgggaacgggggcgttttcggtgatcgctttcttgcgggggcgcgtggcgttcctcggtccgggttatgtcgatctcgacgtgagagacgtgggctaccgcgtgcacgtgtgcgaccgcacacaggcggcgctgaacctcggtgacaccgcattcttgtatacacaccatcatgtgcgcgaggacggctgggcgctgtacggcttcgagacaatcgaggaacgggccctgtttgaacgcctggtggcggtgtccgggattggacccaagctggcgcttcaggtcattggcgccgcaggcgtgggcgagatcgtcgcggccatcctggcggaggacgccgaaagcttgagtcgcctgcctggcatcggccgcaaactcgcgagtcggttggtcgtggagttgcgcgagaagctcgacgacttggcgcccgctgccttgcgcgcccccgctcccgcgtctagcccgcagggctcggcggcggaggacgcggtgtcggcgcttgtcgcgctcgggtaccgccctcgggaggccgaagaggcggtgtctgcggtcggcagaggccgccagtccgtcgaagacaccatcaaggcggcgctgacgtatctgtacgcgcgagacgcgcgaaccgagccgctgtcgaatccgtag

SEQ ID NO: 1497 - protein, 184 aa, Alicyclobacillus acidocaldarius
MESLRILGVDPGLARLGFGIIERGPGDSLHHVAHGCIETGADTPLPERLRHIFQQLTELCRTHRPAVMAVEELFFSRNTTTAFTVGQARGVALLAGAEAGLAVMEYTPMQVKQAVTGYGRADKRQVQEMVRLLLRLTSVPKPDDAADALAVAIAHAHAGRIGELEARLAAGKRTGWVWERGRFR

SEQ ID NO: 1498 - DNA, 555 bp, Alicyclobacillus acidocaldarius
gtggagtccttgcgcatccttggcgtggacccgggcttggcccggctgggattcggcattattgagcgagggccgggcgattcgctccaccatgtggcgcatggttgcatcgagacgggcgcggacacgcctttacctgagaggcttcggcatatctttcaacagttgacggagctctgccgcacacatcggcctgcggtcatggcggtggaggagctgttcttcagccgcaatacgacgacggctttcacggtcggccaggcgcgcggcgtggccctgttggcgggcgcggaggcggggcttgcggtgatggaatacacgccgatgcaggtcaagcaggctgtgacagggtatggtcgggcggacaaacggcaggttcaggagatggtgagactccttttgcggttgacgagcgtgccgaagcctgacgacgcggcagacgcgctggcggtcgccatcgcgcacgcgcacgctgggcgcatcggcgagctggaggcgagactggctgcaggcaagcggacgggctgggtgtgggaacgggggcgttttcggtga

SEQ ID NO: 1499 - protein, 136 aa, Rubrobacter xylanophilus
ILGIDPGTATMGWGVVRQEGSRLRYVQHGAITTPSGWGMPRRLDRLFAGVTELIRGYRPSAVAVEELFFNTNVTTAITVGQARGVALLAAYRAGVEVFEYTPLQVKQAITSYGRADKRQVQEMVRALLGLRSIPRP

SEQ ID NO: 1500 - protein, 138 aa, Paenibacillus  JDR-2
MRVLGIDPGIAIAGFGFIDKDGHKLKPVQYGCIQTAAHTPQEERLVQIYDSAVALMDKYKPDTVAVEKLFFNRNVTTAFAVGQARGVIILAAAQRGLPVAEYTPLQVKQAVVGYGKAEKRQVQEMVKMFLKLSAIPKP

SEQ ID NO: 1501 - protein, 136 aa, Desulfitobacterium hafniense
ILGIDPGTAIMGYGLIEKKGNRLFPVDYACWRTPAHTPMPERLLMLYHEIEAYIKEKQPHHVAVEELFFNRNTTTAISVGQARGVVLLAAAQCGLPVYEYTPLQVKQAVAGYGRADKQQIQQMVRALLGLQEIPKP

SEQ ID NO: 1502 - protein, 139 aa, Symbiobacterium thermophilum
MRILGIDPGTARMGYGIVEDAGAGRERAVEYGCLETPPDMRPELRLQALYRGLADLMARHRPDALAVEELFFGRNVTTAIHVGQARGVVLLAAADSGVPVREFTPMQVKMAVTGYGRANKAQVQRMVQALLGLPEIPKP

SEQ ID NO: 1503 - protein, 139 aa, Caldicellulosiruptor saccharolyticus
MRVLGIDPGIALTGYGIIESKNGSEFKVIDYGRIETSSSLKKSMRLLHLYTELCSIISLYQPDVVAIEELFFSKNSKTAITIGEARGVIILTCIQNNLSIYEYTPLQVKQSITGYGRADKTQIQKMVKSLLGLSEIPKP

SEQ ID NO: 1504 - protein, 184 aa, Artificial
  Alicyclobacillus acidocaldarius mutated SEQ ID NO 1497
MESLRILGVDPGLARLGFGIIERGPGDSIHHVAHGCIETGADTPLPERLRHIFQQLTELCRTHRPAVMAVEELFFSRNTTTAFTVGQARGVALLAGAEAGLAVMEYTPMQVKQAVTGYGRADKRQVQEMVRLLLRLTSVPKPDDAADALAVAIAHAHAGRIGELEARLAAGKRTGWVWERGRFR

SEQ ID NO: 1505 - protein, 184 aa, Artificial
  Alicyclobacillus acidocaldarius mutated SEQ ID NO 1497
MESLRILGVDPGLARLGFGIIERGPGDSLHHVAHGCIETGADTPLPERLRHIFQQLTELCRTHRPAVMAVEELFFSRNTTTAFTVGQARGVALLAGAEAGLAVMEYTPMQVKQAVTGYGRADKRQVQEMVRLLLRLTSVPKPDDAADALAVAIAHAHAGRIGELEARIAAGKRTGWVWERGRFR

SEQ ID NO: 1506 - protein, 184 aa, Artificial
  Alicyclobacillus acidocaldarius mutated SEQ ID NO 1497
MESLRILGVDPGLARLGFGIIERGPGDSLHHVAHGCIETGADTPLPERLRHIFQQLTELCRTHRPAIMAVEELFFSRNTTTAFTVGQARGVALLAGAEAGLAVMEYTPMQVKQAVTGYGRADKRQVQEMVRLLLRLTSVPKPDDAADALAVAIAHAHAGRIGELEARLAAGKRTGWVWERGRFR

SEQ ID NO: 1507 - protein, 184 aa, Artificial
  Alicyclobacillus acidocaldarius mutated SEQ ID NO 1497
MESLRILGVDPGLARLGFGIIERGPGDSLHHVAHGCIETGADTPLPDRLRHIFQQLTELCRTHRPAVMAVEELFFSRNTTTAFTVGQARGVALLAGAEAGLAVMEYTPMQVKQAVTGYGRADKRQVQEMVRLLLRLTSVPKPDDAADALAVAIAHAHAGRIGELEARLAAGKRTGWVWERGRFR

SEQ ID NO: 1508 - protein, 184 aa, Artificial
  Alicyclobacillus acidocaldarius mutated SEQ ID NO 1497
MESLRILGVDPGLARLGFGIIERGPGDSLHHVAHGCIETGADTPLPERLRHIFQQLTELCRTHRPAVMAVEELFFSRNTTTAFTVGQARGVALLAGAEAGLAVMEYTPMQVKQAVTGYGRADKRQVQEMVRLLLRLTSVPKPDDAADALAVAIAHAHAGRIGELEARLAAGKRTGWVWERGKFR

SEQ ID NO: 1509 - DNA, 555 bp, Artificial
  Alicyclobacillus acidocaldarius mutated SEQ ID NO 1498
gtggagtccttgcgcatccttggcgtggacccgggcttggcccggctgggattcggcattattgagcgagggccgggcgattcgattcaccatgtggcgcatggttgcatcgagacgggcgcggacacgcctttacctgagaggcttcggcatatctttcaacagttgacggagctctgccgcacacatcggcctgcggtcatggcggtggaggagctgttcttcagccgcaatacgacgacggctttcacggtcggccaggcgcgcggcgtggccctgttggcgggcgcggaggcggggcttgcggtgatggaatacacgccgatgcaggtcaagcaggctgtgacagggtatggtcgggcggacaaacggcaggttcaggagatggtgagactccttttgcggttgacgagcgtgccgaagcctgacgacgcggcagacgcgctggcggtcgccatcgcgcacgcgcacgctgggcgcatcggcgagctggaggcgagactggctgcaggcaagcggacgggctgggtgtgggaacgggggcgttttcggtga

SEQ ID NO: 1510 - DNA, 555 bp, Artificial
  Alicyclobacillus acidocaldarius mutated SEQ ID NO 1498
gtggagtccttgcgcatccttggcgtggacccgggcttggcccggctgggattcggcattattgagcgagggccgggcgattcgctccaccatgtggcgcatggttgcatcgagacgggcgcggacacgcctttacctgagaggcttcggcatatctttcaacagttgacggagctctgccgcacacatcggcctgcggtcatggcggtggaggagctgttcttcagccgcaatacgacgacggctttcacggtcggccaggcgcgcggcgtggccctgttggcgggcgcggaggcggggcttgcggtgatggaatacacgccgatgcaggtcaagcaggctgtgacagggtatggtcgggcggacaaacggcaggttcaggagatggtgagactccttttgcggttgacgagcgtgccgaagcctgacgacgcggcagacgcgctggcggtcgccatcgcgcacgcgcacgctgggcgcatcggcgagctggaggcgagaattgctgcaggcaagcggacgggctgggtgtgggaacgggggcgttttcggtga

SEQ ID NO: 1511 - DNA, 555 bp, Artificial
  Alicyclobacillus acidocaldarius mutated SEQ ID NO 1498
gtggagtccttgcgcatccttggcgtggacccgggcttggcccggctgggattcggcattattgagcgagggccgggcgattcgctccaccatgtggcgcatggttgcatcgagacgggcgcggacacgcctttacctgagaggcttcggcatatctttcaacagttgacggagctctgccgcacacatcggcctgcgattatggcggtggaggagctgttcttcagccgcaatacgacgacggctttcacggtcggccaggcgcgcggcgtggccctgttggcgggcgcggaggcggggcttgcggtgatggaatacacgccgatgcaggtcaagcaggctgtgacagggtatggtcgggcggacaaacggcaggttcaggagatggtgagactccttttgcggttgacgagcgtgccgaagcctgacgacgcggcagacgcgctggcggtcgccatcgcgcacgcgcacgctgggcgcatcggcgagctggaggcgagactggctgcaggcaagcggacgggctgggtgtgggaacgggggcgttttcggtga

SEQ ID NO: 1512 - DNA, 555 bp, Artificial
  Alicyclobacillus acidocaldarius mutated SEQ ID NO 1498
gtggagtccttgcgcatccttggcgtggacccgggcttggcccggctgggattcggcattattgagcgagggccgggcgattcgctccaccatgtggcgcatggttgcatcgagacgggcgcggacacgcctttacctgataggcttcggcatatctttcaacagttgacggagctctgccgcacacatcggcctgcggtcatggcggtggaggagctgttcttcagccgcaatacgacgacggctttcacggtcggccaggcgcgcggcgtggccctgttggcgggcgcggaggcggggcttgcggtgatggaatacacgccgatgcaggtcaagcaggctgtgacagggtatggtcgggcggacaaacggcaggttcaggagatggtgagactccttttgcggttgacgagcgtgccgaagcctgacgacgcggcagacgcgctggcggtcgccatcgcgcacgcgcacgctgggcgcatcggcgagctggaggcgagactggctgcaggcaagcggacgggctgggtgtgggaacgggggcgttttcggtga

SEQ ID NO: 1513 - DNA, 555 bp, Artificial
  Alicyclobacillus acidocaldarius mutated SEQ ID NO 1498
gtggagtccttgcgcatccttggcgtggacccgggcttggcccggctgggattcggcattattgagcgagggccgggcgattcgctccaccatgtggcgcatggttgcatcgagacgggcgcggacacgcctttacctgagaggcttcggcatatctttcaacagttgacggagctctgccgcacacatcggcctgcggtcatggcggtggaggagctgttcttcagccgcaatacgacgacggctttcacggtcggccaggcgcgcggcgtggccctgttggcgggcgcggaggcggggcttgcggtgatggaatacacgccgatgcaggtcaagcaggctgtgacagggtatggtcgggcggacaaacggcaggttcaggagatggtgagactccttttgcggttgacgagcgtgccgaagcctgacgacgcggcagacgcgctggcggtcgccatcgcgcacgcgcacgctgggcgcatcggcgagctggaggcgagactggctgcaggcaagcggacgggctgggtgtgggaacgggggaaatttcggtga

SEQ ID NO: 1514 - protein, 514 aa, Alicyclobacillus acidocaldarius
MTPVSTFPTGLEHVAIYLRKSRADLEAEARGEGETLTKHRRALLELAKQYHYSIDHIYEEIVSGELIVDRPEVQRLLHAVREGKYSAVLVMDIDRLGRGNQIDQGIIQQAFKQSGTLIITPRKVYNLEDELDEEFSEFEQFMARRELKIITRRMQRGRKLSAKEGKSITPYVPFGYKRDENLKLYPDPETAPIVRQIFEWSAEGLGIIKIAKKLNEMGVPAPRSCGWQRTTVQHILKNEVYLGRIVWDKKRDVKTTEGKYRSIKRPREEWIVHENAHEPIISQELWDRVVEIRKVNDHRTKDNYDLKNPFAGILRCKQCGRVMKRQPRPNRNGDTLQCYTTGCPTREVLLSRLEDRVLQSIEEFVQSYAAQSSVKKRADNRQKKLEALHRQKKSIQSKLSKLETQKNRLFDFLEQGIYDVQTFIERSKLVGEQIDQAKEELKICEQAIEREMLQQQHEEELIPAISEAIAMYRTASNAEIKNMALKSVIKEIHYYRPRSWSKSKEFEIDIYFRI

SEQ ID NO: 1515 - DNA, 1545 bp, Alicyclobacillus acidocaldarius
gtgacgcccgtgagtacctttccgactggattggaacacgtagctatttatcttagaaagtctcgcgcagatttagaagctgaagctcgtggcgaaggggaaaccttgacgaagcatcgtcgagcccttcttgaactggccaagcaataccactatagcattgaccacatttacgaggaaattgtctccggagagctcatcgtcgatcgccctgaagtacagagattgctacatgctgtccgtgagggaaaatacagtgctgtattggttatggatatcgaccgccttggtcgtgggaatcagatcgatcaaggcatcatacagcaagcttttaagcaatccggaaccctgatcataaccccccgaaaggtctacaaccttgaagatgaattggacgaggagttttcagagttcgagcagttcatggctcgtcgagagctgaaaatcattactcgtcgtatgcaacgtggacgaaaactttcggctaaagaagggaaatcgatcactccctatgttccgttcggttacaaaagagacgaaaatctcaagttatatccagaccccgaaactgcacctattgtccggcaaattttcgagtggagtgccgaagggttaggcatcattaagattgccaagaaattgaacgaaatgggtgttcctgcaccacgttcgtgtggctggcagcgaacgaccgttcaacacattttgaagaacgaagtctacctagggcgaatcgtctgggacaagaagcgagatgtgaagaccaccgaaggaaagtatcggtcgattaagcgcccacgtgaagagtggatcgtccatgaaaatgctcatgaacccatcatttctcaagaactgtgggatagagttgtagagattcgtaaggtgaatgaccatcggacgaaggataactatgatctgaagaatccgtttgctggaatcttgagatgcaaacagtgtggacgagtgatgaagagacaaccgcgcccgaatcgtaatggcgacacattgcagtgctatacgacaggatgtccgacgcgggaagtactcctttctagactcgaagatcgcgtattgcaatctatcgaagagtttgttcagtcatatgctgcccagtcaagcgtaaagaaacgcgctgataatcgccaaaagaaattagaggctctgcacaggcagaaaaagtccattcaatcaaaactcagcaagctagagacacaaaagaacaggctgtttgattttcttgaacaaggcatttatgatgtacaaacttttatagagagaagcaaattggtaggtgaacaaattgaccaggcaaaagaggaactcaaaatttgtgaacaagcaattgagcgcgaaatgctgcaacaacagcatgaagaggaattgattccggcgattagtgaggccatcgcaatgtaccgcactgcttccaatgcagaaattaagaacatggcattgaagtcggtcataaaggaaatacattattacagacctcgttcatggtcaaaatcgaaggaatttgaaatcgatatatatttccgtatctga

SEQ ID NO: 1516 - protein, 506 aa, Geobacillus kaustophilus
VFIYLRKSRKDIEEEKKAAESGASYDTLQRHRDNLLAVARKEGHNILGIFEEIVSGESIAERSEIQKLLRELETGVADAVLVMDIDRLGRGDMLDQGILDRAFRYSGTKIITPTEVYDPESETWELVFGVKSIVSREELKVITKRLQGGRRDSAAKGRSISKKPPYGYLRDEQLKLYPDPETSWVVVKIFEMVRDGHGRQAIAAELDRLGVKPPDEKRAFWSPSTISAIIKNEVYLGHIIWGKVKYIKQNGRYKRKKMPRERWYVKENAHAPLVSKELWEAANKAYRSRWRPSTVESKPLANPLAGLLKCEVCGYTMWYQPRKDRPHPLVRCPNPKCKGVQKGALLPLVEEKILQSLAEFVDQFEVQEDRKEQRSVIPLKQKAIEKKEKELRELHKQKDALHDLLERGVYTIETFLERQQTIVSRIKKTQEEIDQLREEIAKEQLKEKNISEYVPTVKKVLDAYRLTDDVEKKNRLLKSVLEKATYLRKPEWTKKDQFTIQLYPRI

SEQ ID NO: 1517 - protein, 508 aa, Alkaliphilus oremlandii
MEKVSIYLRKSRADIEAESRGEGETLAKHRSTLLKVAKEKKLSIVKIYEEIVSGESLMHRPEMLELLKNVESKKYDAVLVMDVDRLGRGNMQEQGLILETFKKSCTKIITPRKIYNLDDEFDEEYSEFEAFMARKELKMINRRLQNGRVRSIEDGNYISPNPPYGYEIDEGKDYRTLKPHPEQAEVVKMIFEWYVSGLGSGKIANKLNDLGYKSYTGIPWRSSSVLNMLKNLVYTGKVVWGRKDIKKSTEVGKVKDTVTRPKEEWIIADGKHPALVSEELFEKAQEILNKRYHVPYQLENGITNPLAGLIRCENCGASMVLRPYPDKDHQVMCYNNCGNKSSKLKYVEKEVLAGLAEWCLQYRAQWDIDNKSKRKKSKLTSSIPVLEKAVENLQKELVELENQKNSLHDFLERGIYDVDTYLERSQNLATRIDATKVSLSKAKLVLGQEMQREKAQIDIIPRIEKVLDVYPKINDPAHKNELLKSVLDYAAYSKDKSKRNDDFSLRLF

SEQ ID NO: 1518 - protein, 508 aa, Bacillus cereus
VCIYLRKSRKDVEEERRAIEEGSSYNALERHRKRLFAIAKAENHNIIDIFEEVASGESIQERPQMQQLLRKLEGNEIDGVLVIDLDRLGRGDMLDAGMIDRAFRYSSTKIITPTDVYDPDEESWELVFGIKSLISRQELKSITKRLQNGRIDSVKEGKHIGKKPPYGYLKDENLRLYPDPEKAWIVKKIFELMCDGKGRQMIAAELDRLGIDPPVTKRGAWDSSTITSIIKNEVYTGVIVWGKFKHKKRNGKYTRHKNPQEKWIMYENAHEPIISKELFDAANEAHSSRHKPAVITSKELTNPLAGILKCKLCGYTMLIQTRKDRPHNYLRCNNPACKGKQKQSVFNLVEEKLLYSLQQIVDEYQAQKVEEVEIDDSKLISFKEKAIISKEKELKELQAQKGNLHDLLEQGIYTVEIFLERQKNLVERITSIENDIEVLQKEIETEQIKEHNKTEFIPALKTVIESYHKTTNIELKNQLLKTILSTVTYYRHPDWKTNEFEIQVYFKI

SEQ ID NO: 1519 - protein, 507 aa, Bacillus cereus
VFIYLRKSRKDLEEEKKAMEHGQHYDTLERHRTQLLELAHKEHHNIIDIFEEVVSGEYISERPMMQKLLREVETGIADAVLVMDLDRLGRGDMVDQGTIYRVFRYSETFIITPTEVINPNDENQELTFSIKSLIAREELKTIVKRMQRGRKASAKEGKSISRVPAYGYLRDNNLKLYPDPEKSWVIPKIFELMANGIGRQAIAQELDRLGIAPPEGEYWNPSTISSIIKNEVYLGHIIWGKIRYIKQNGKYIRKKVSKERWQRHDNAHPPLVSEELFQKANTAHSKRWRPPTIKTKKLSNPLAGLLLCELCGHSMLYQPRKDRPNPQVRCVQPSCKGVQKGASLALVEQRILDGLKQIIESFEIQENMVQQKKRKNNIHLQQKALEKKEQQMINLQKQKNNLHDLLEKGVYDVETFLERQKSIAVRLKTTQKAIEELKHEIKKILEKEKHIHEFVPRIKNVLEAYYATNDIEKKNRLLKSVLEKATYLRKKIWQRKDEFLIELYTRI

SEQ ID NO: 1520 - protein, 508 aa, Bacillus cereus
VCIYLRKSRKDVEEERRAIEEGSSYNALERHRKRLFAIAKAENHNIIDIFEEVASGESIQERPQMQQLLRKLEGNEIDGVLVIDLDRLGRGDMLDAGMIDRAFRYSSTKIITPTDVYDPDDESWELVFGIKSLISRQELKSITKRLQNGRIDSVKEGKHIGKKPPYGYLKDENLRLYPDPEKAWIVKKIFELMCDGKGRQMIAAELDRLGIDPPVTKRGAWDSSTITSIIKNEVYTGVIVWGKFKHKKRNGKYTRHKNPQEKWIMYENAHEPIISKELFDAANEAHSSRHKPAVITSKKLTNPLAGILKCKLCGYTMLIQTRKDRPHNYLRCNNPACKGKQKQSVFNLVEEKLLYSLQQIVDEYQAQKVEEVEIDDSKLISFKEKAIISKEKELKELQAQKGNLHDLLEQGIYTVEIFLERQKNLVERITSIENDIEVLQKEIETEQIKEHNKTEFIPALKTVIESYHKTTNIELKNQLLKTILSTVTYYRHPDWKTNEFEIQVYFKI

SEQ ID NO: 1521 - protein, 514 aa, Artificial
  Alicyclobacillus acidocaldarius mutated SEQ ID NO 1514
MTPVSTFPTGLEHVAIYLRKSRADLEAEARGEGETLTKHRRALLELAKQYHYSIDHIYEEIVSGELIVDRPEVQRLLHAVREGKYSAVLVMDIDRLGRGNQIDQGIIQQAFKQSGTLIITPRKVYNLEDELDEEFSEFEQFMARRELKIITRRMQRGRKLSAKEGKSITPYVPFGYKRDENLKLYPDPETAPIVRQIFEWSAEGLGIIKIAKKLNEMGVPAPRSCGWQRTTVQHILKNEVYLGRIVWDKKRDVKTTEGKYRSIKRPREEWIVHENAHEPIISQELWDRVVEIRKVNDHRTKDNYDLKNPFAGILRCKQCGRVMKRQPRPNRNGDTLQCYTTGCPTREVLLSRLEDRVLQSIEEFVQSYAAQSSVKKRADNRQKKLEALHRQKKSIQSKLSKLETQKNKLFDFLEQGIYDVQTFIERSKLVGEQIDQAKEELKICEQAIEREMLQQQHEEELIPAISEAIAMYRTASNAEIKNMALKSVIKEIHYYRPRSWSKSKEFEIDIYFRI

SEQ ID NO: 1522 - protein, 514 aa, Artificial
  Alicyclobacillus acidocaldarius mutated SEQ ID NO 1514
MTPVSTFPTGLEHVAIYLRKSRADLEAEARGEGETLTKHRRALLELAKQYHYSIDHIYEEIVSGELIVDRPEVQRLLHAVREGKYSAVLVMDIDRLGRGNQIDQGIIQQAFKQSGTLIITPRKVYNLEDELDEEFSEFEQFMARRELKIITRRMQRGRKLSAKEGKSITPYVPFGYKRDENLKLYPDPETAPIVRQIFEWSAEGLGIIKIAKKLNEMGVPAPRSCGWNRTTVQHILKNEVYLGRIVWDKKRDVKTTEGKYRSIKRPREEWIVHENAHEPIISQELWDRVVEIRKVNDHRTKDNYDLKNPFAGILRCKQCGRVMKRQPRPNRNGDTLQCYTTGCPTREVLLSRLEDRVLQSIEEFVQSYAAQSSVKKRADNRQKKLEALHRQKKSIQSKLSKLETQKNRLFDFLEQGIYDVQTFIERSKLVGEQIDQAKEELKICEQAIEREMLQQQHEEELIPAISEAIAMYRTASNAEIKNMALKSVIKEIHYYRPRSWSKSKEFEIDIYFRI

SEQ ID NO: 1523 - protein, 514 aa, Artificial
  Alicyclobacillus acidocaldarius mutated SEQ ID NO 1514
MTPVSTFPTGLEHVAIYLRKSRADLEAEARGEGETLTKHRRALLELAKQYHYSIDHIYEEIVSGELIVDRPEVQRLLHAVREGKYSAVLVMDIDRLGRGNQIDQGIIQQAFKQSGTLIITPRKVYNLEDELDEEFSEFEQFMARRELKIITRRMQRGRKLSAKEGKSITPYVPFGYKRDENLKLYPDPETAPIVRQIFEWSAEGLGIIKIAKKLNEMGVPAPRSCGWQRTTVQHILKNEVYLGRIVWDKKRDVKTTEGKYRSIKRPREEWIVHENAHEPIISQELWDRVVEIRKVNDHRTKDNYDLKNPFAGILRCKQCGRVMKRQPRPNRNGDTLNCYTTGCPTREVLLSRLEDRVLQSIEEFVQSYAAQSSVKKRADNRQKKLEALHRQKKSIQSKLSKLETQKNRLFDFLEQGIYDVQTFIERSKLVGEQIDQAKEELKICEQAIEREMLQQQHEEELIPAISEAIAMYRTASNAEIKNMALKSVIKEIHYYRPRSWSKSKEFEIDIYFRI

SEQ ID NO: 1524 - protein, 514 aa, Artificial
  Alicyclobacillus acidocaldarius mutated SEQ ID NO 1514
MTPVSTFPTGLEHVAIYLRKSRADLEAEARGEGETLTKHRRALLELAKQYHYSIDHIYEEIVSGELIVDRPEVQRLLHAVREGKYSAVLVMDIDRLGRGNQIDQGIIQQAFKQSGTLIITPRKVYNLEDELDEEFSEFEQFMARRELKIITRRMQRGRKLSAKEGKSITPYVPFGYKRDENLKLYPDPETAPIVRQIFEWSAEGLGIIKIAKKLNEMGVPAPRSCGWQRTTVQHILKNEVYLGRIVWDKKRDVKTTEGKYRSIKRPREEWIVHENAHEPIISQELWDRVVEIRKVNDHRTKDNYDLKNPFAGILRCKQCGRVMKRQPRPNRNGDTLQCYTTGCPTREVLLSRLEDRVLQSIEEFVQSYAAQSSVKKRADNRQKKLEALHRQKKSIQSKLSKLETQKNRLFDFLEQGIYDVQTFIERSKIVGEQIDQAKEELKICEQAIEREMLQQQHEEELIPAISEAIAMYRTASNAEIKNMALKSVIKEIHYYRPRSWSKSKEFEIDIYFRI

SEQ ID NO: 1525 - protein, 514 aa, Artificial
  Alicyclobacillus acidocaldarius mutated SEQ ID NO 1514
MTPVSTFPTGLEHVAIYLRKSRADLEAEARGEGETLTKHRRALLELAKQYHYSIDHIYEEIVSGELIVDRPEVQRLLHAVREGKYSAVLVMDIDRLGRGNQIDQGIIQQAFKQSGTLIITPRKVYNLEDELDEEFSEFEQFMARRELKIITRRMQRGRKLSAKEGKSITPYVPFGYKRDENLKLYPDPETAPIVRQIFEWSAEGLGIIKIAKKLNEMGVPAPRSCGWQRTTVQHILKNEVYLGRIVWDKKRDVKTTEGKYRSIKRPREEWIIHENAHEPIISQELWDRVVEIRKVNDHRTKDNYDLKNPFAGILRCKQCGRVMKRQPRPNRNGDTLQCYTTGCPTREVLLSRLEDRVLQSIEEFVQSYAAQSSVKKRADNRQKKLEALHRQKKSIQSKLSKLETQKNRLFDFLEQGIYDVQTFIERSKLVGEQIDQAKEELKICEQAIEREMLQQQHEEELIPAISEAIAMYRTASNAEIKNMALKSVIKEIHYYRPRSWSKSKEFEIDIYFRI

SEQ ID NO: 1526 - DNA, 1545 bp, Artificial
  Alicyclobacillus acidocaldarius mutated SEQ ID NO 1515
gtgacgcccgtgagtacctttccgactggattggaacacgtagctatttatcttagaaagtctcgcgcagatttagaagctgaagctcgtggcgaaggggaaaccttgacgaagcatcgtcgagcccttcttgaactggccaagcaataccactatagcattgaccacatttacgaggaaattgtctccggagagctcatcgtcgatcgccctgaagtacagagattgctacatgctgtccgtgagggaaaatacagtgctgtattggttatggatatcgaccgccttggtcgtgggaatcagatcgatcaaggcatcatacagcaagcttttaagcaatccggaaccctgatcataaccccccgaaaggtctacaaccttgaagatgaattggacgaggagttttcagagttcgagcagttcatggctcgtcgagagctgaaaatcattactcgtcgtatgcaacgtggacgaaaactttcggctaaagaagggaaatcgatcactccctatgttccgttcggttacaaaagagacgaaaatctcaagttatatccagaccccgaaactgcacctattgtccggcaaattttcgagtggagtgccgaagggttaggcatcattaagattgccaagaaattgaacgaaatgggtgttcctgcaccacgttcgtgtggctggcagcgaacgaccgttcaacacattttgaagaacgaagtctacctagggcgaatcgtctgggacaagaagcgagatgtgaagaccaccgaaggaaagtatcggtcgattaagcgcccacgtgaagagtggatcgtccatgaaaatgctcatgaacccatcatttctcaagaactgtgggatagagttgtagagattcgtaaggtgaatgaccatcggacgaaggataactatgatctgaagaatccgtttgctggaatcttgagatgcaaacagtgtggacgagtgatgaagagacaaccgcgcccgaatcgtaatggcgacacattgcagtgctatacgacaggatgtccgacgcgggaagtactcctttctagactcgaagatcgcgtattgcaatctatcgaagagtttgttcagtcatatgctgcccagtcaagcgtaaagaaacgcgctgataatcgccaaaagaaattagaggctctgcacaggcagaaaaagtccattcaatcaaaactcagcaagctagagacacaaaagaacaaactgtttgattttcttgaacaaggcatttatgatgtacaaacttttatagagagaagcaaattggtaggtgaacaaattgaccaggcaaaagaggaactcaaaatttgtgaacaagcaattgagcgcgaaatgctgcaacaacagcatgaagaggaattgattccggcgattagtgaggccatcgcaatgtaccgcactgcttccaatgcagaaattaagaacatggcattgaagtcggtcataaaggaaatacattattacagacctcgttcatggtcaaaatcgaaggaatttgaaatcgatatatatttccgtatctga

SEQ ID NO: 1527 - DNA, 1545 bp, Artificial
  Alicyclobacillus acidocaldarius mutated SEQ ID NO 1515
gtgacgcccgtgagtacctttccgactggattggaacacgtagctatttatcttagaaagtctcgcgcagatttagaagctgaagctcgtggcgaaggggaaaccttgacgaagcatcgtcgagcccttcttgaactggccaagcaataccactatagcattgaccacatttacgaggaaattgtctccggagagctcatcgtcgatcgccctgaagtacagagattgctacatgctgtccgtgagggaaaatacagtgctgtattggttatggatatcgaccgccttggtcgtgggaatcagatcgatcaaggcatcatacagcaagcttttaagcaatccggaaccctgatcataaccccccgaaaggtctacaaccttgaagatgaattggacgaggagttttcagagttcgagcagttcatggctcgtcgagagctgaaaatcattactcgtcgtatgcaacgtggacgaaaactttcggctaaagaagggaaatcgatcactccctatgttccgttcggttacaaaagagacgaaaatctcaagttatatccagaccccgaaactgcacctattgtccggcaaattttcgagtggagtgccgaagggttaggcatcattaagattgccaagaaattgaacgaaatgggtgttcctgcaccacgttcgtgtggctggaatcgaacgaccgttcaacacattttgaagaacgaagtctacctagggcgaatcgtctgggacaagaagcgagatgtgaagaccaccgaaggaaagtatcggtcgattaagcgcccacgtgaagagtggatcgtccatgaaaatgctcatgaacccatcatttctcaagaactgtgggatagagttgtagagattcgtaaggtgaatgaccatcggacgaaggataactatgatctgaagaatccgtttgctggaatcttgagatgcaaacagtgtggacgagtgatgaagagacaaccgcgcccgaatcgtaatggcgacacattgcagtgctatacgacaggatgtccgacgcgggaagtactcctttctagactcgaagatcgcgtattgcaatctatcgaagagtttgttcagtcatatgctgcccagtcaagcgtaaagaaacgcgctgataatcgccaaaagaaattagaggctctgcacaggcagaaaaagtccattcaatcaaaactcagcaagctagagacacaaaagaacaggctgtttgattttcttgaacaaggcatttatgatgtacaaacttttatagagagaagcaaattggtaggtgaacaaattgaccaggcaaaagaggaactcaaaatttgtgaacaagcaattgagcgcgaaatgctgcaacaacagcatgaagaggaattgattccggcgattagtgaggccatcgcaatgtaccgcactgcttccaatgcagaaattaagaacatggcattgaagtcggtcataaaggaaatacattattacagacctcgttcatggtcaaaatcgaaggaatttgaaatcgatatatatttccgtatctga

SEQ ID NO: 1528 - DNA, 1545 bp, Artificial
  Alicyclobacillus acidocaldarius mutated SEQ ID NO 1515
gtgacgcccgtgagtacctttccgactggattggaacacgtagctatttatcttagaaagtctcgcgcagatttagaagctgaagctcgtggcgaaggggaaaccttgacgaagcatcgtcgagcccttcttgaactggccaagcaataccactatagcattgaccacatttacgaggaaattgtctccggagagctcatcgtcgatcgccctgaagtacagagattgctacatgctgtccgtgagggaaaatacagtgctgtattggttatggatatcgaccgccttggtcgtgggaatcagatcgatcaaggcatcatacagcaagcttttaagcaatccggaaccctgatcataaccccccgaaaggtctacaaccttgaagatgaattggacgaggagttttcagagttcgagcagttcatggctcgtcgagagctgaaaatcattactcgtcgtatgcaacgtggacgaaaactttcggctaaagaagggaaatcgatcactccctatgttccgttcggttacaaaagagacgaaaatctcaagttatatccagaccccgaaactgcacctattgtccggcaaattttcgagtggagtgccgaagggttaggcatcattaagattgccaagaaattgaacgaaatgggtgttcctgcaccacgttcgtgtggctggcagcgaacgaccgttcaacacattttgaagaacgaagtctacctagggcgaatcgtctgggacaagaagcgagatgtgaagaccaccgaaggaaagtatcggtcgattaagcgcccacgtgaagagtggatcgtccatgaaaatgctcatgaacccatcatttctcaagaactgtgggatagagttgtagagattcgtaaggtgaatgaccatcggacgaaggataactatgatctgaagaatccgtttgctggaatcttgagatgcaaacagtgtggacgagtgatgaagagacaaccgcgcccgaatcgtaatggcgacacattgaattgctatacgacaggatgtccgacgcgggaagtactcctttctagactcgaagatcgcgtattgcaatctatcgaagagtttgttcagtcatatgctgcccagtcaagcgtaaagaaacgcgctgataatcgccaaaagaaattagaggctctgcacaggcagaaaaagtccattcaatcaaaactcagcaagctagagacacaaaagaacaggctgtttgattttcttgaacaaggcatttatgatgtacaaacttttatagagagaagcaaattggtaggtgaacaaattgaccaggcaaaagaggaactcaaaatttgtgaacaagcaattgagcgcgaaatgctgcaacaacagcatgaagaggaattgattccggcgattagtgaggccatcgcaatgtaccgcactgcttccaatgcagaaattaagaacatggcattgaagtcggtcataaaggaaatacattattacagacctcgttcatggtcaaaatcgaaggaatttgaaatcgatatatatttccgtatctga

SEQ ID NO: 1529 - DNA, 1545 bp, Artificial
  Alicyclobacillus acidocaldarius mutated SEQ ID NO 1515
gtgacgcccgtgagtacctttccgactggattggaacacgtagctatttatcttagaaagtctcgcgcagatttagaagctgaagctcgtggcgaaggggaaaccttgacgaagcatcgtcgagcccttcttgaactggccaagcaataccactatagcattgaccacatttacgaggaaattgtctccggagagctcatcgtcgatcgccctgaagtacagagattgctacatgctgtccgtgagggaaaatacagtgctgtattggttatggatatcgaccgccttggtcgtgggaatcagatcgatcaaggcatcatacagcaagcttttaagcaatccggaaccctgatcataaccccccgaaaggtctacaaccttgaagatgaattggacgaggagttttcagagttcgagcagttcatggctcgtcgagagctgaaaatcattactcgtcgtatgcaacgtggacgaaaactttcggctaaagaagggaaatcgatcactccctatgttccgttcggttacaaaagagacgaaaatctcaagttatatccagaccccgaaactgcacctattgtccggcaaattttcgagtggagtgccgaagggttaggcatcattaagattgccaagaaattgaacgaaatgggtgttcctgcaccacgttcgtgtggctggcagcgaacgaccgttcaacacattttgaagaacgaagtctacctagggcgaatcgtctgggacaagaagcgagatgtgaagaccaccgaaggaaagtatcggtcgattaagcgcccacgtgaagagtggatcgtccatgaaaatgctcatgaacccatcatttctcaagaactgtgggatagagttgtagagattcgtaaggtgaatgaccatcggacgaaggataactatgatctgaagaatccgtttgctggaatcttgagatgcaaacagtgtggacgagtgatgaagagacaaccgcgcccgaatcgtaatggcgacacattgcagtgctatacgacaggatgtccgacgcgggaagtactcctttctagactcgaagatcgcgtattgcaatctatcgaagagtttgttcagtcatatgctgcccagtcaagcgtaaagaaacgcgctgataatcgccaaaagaaattagaggctctgcacaggcagaaaaagtccattcaatcaaaactcagcaagctagagacacaaaagaacaggctgtttgattttcttgaacaaggcatttatgatgtacaaacttttatagagagaagcaaaattgtaggtgaacaaattgaccaggcaaaagaggaactcaaaatttgtgaacaagcaattgagcgcgaaatgctgcaacaacagcatgaagaggaattgattccggcgattagtgaggccatcgcaatgtaccgcactgcttccaatgcagaaattaagaacatggcattgaagtcggtcataaaggaaatacattattacagacctcgttcatggtcaaaatcgaaggaatttgaaatcgatatatatttccgtatctga

SEQ ID NO: 1530 - DNA, 1545 bp, Artificial
  Alicyclobacillus acidocaldarius mutated SEQ ID NO 1515
gtgacgcccgtgagtacctttccgactggattggaacacgtagctatttatcttagaaagtctcgcgcagatttagaagctgaagctcgtggcgaaggggaaaccttgacgaagcatcgtcgagcccttcttgaactggccaagcaataccactatagcattgaccacatttacgaggaaattgtctccggagagctcatcgtcgatcgccctgaagtacagagattgctacatgctgtccgtgagggaaaatacagtgctgtattggttatggatatcgaccgccttggtcgtgggaatcagatcgatcaaggcatcatacagcaagcttttaagcaatccggaaccctgatcataaccccccgaaaggtctacaaccttgaagatgaattggacgaggagttttcagagttcgagcagttcatggctcgtcgagagctgaaaatcattactcgtcgtatgcaacgtggacgaaaactttcggctaaagaagggaaatcgatcactccctatgttccgttcggttacaaaagagacgaaaatctcaagttatatccagaccccgaaactgcacctattgtccggcaaattttcgagtggagtgccgaagggttaggcatcattaagattgccaagaaattgaacgaaatgggtgttcctgcaccacgttcgtgtggctggcagcgaacgaccgttcaacacattttgaagaacgaagtctacctagggcgaatcgtctgggacaagaagcgagatgtgaagaccaccgaaggaaagtatcggtcgattaagcgcccacgtgaagagtggatcattcatgaaaatgctcatgaacccatcatttctcaagaactgtgggatagagttgtagagattcgtaaggtgaatgaccatcggacgaaggataactatgatctgaagaatccgtttgctggaatcttgagatgcaaacagtgtggacgagtgatgaagagacaaccgcgcccgaatcgtaatggcgacacattgcagtgctatacgacaggatgtccgacgcgggaagtactcctttctagactcgaagatcgcgtattgcaatctatcgaagagtttgttcagtcatatgctgcccagtcaagcgtaaagaaacgcgctgataatcgccaaaagaaattagaggctctgcacaggcagaaaaagtccattcaatcaaaactcagcaagctagagacacaaaagaacaggctgtttgattttcttgaacaaggcatttatgatgtacaaacttttatagagagaagcaaattggtaggtgaacaaattgaccaggcaaaagaggaactcaaaatttgtgaacaagcaattgagcgcgaaatgctgcaacaacagcatgaagaggaattgattccggcgattagtgaggccatcgcaatgtaccgcactgcttccaatgcagaaattaagaacatggcattgaagtcggtcataaaggaaatacattattacagacctcgttcatggtcaaaatcgaaggaatttgaaatcgatatatatttccgtatctga

SEQ ID NO: 1531 - protein, 492 aa, Alicyclobacillus acidocaldarius
MLLSNGTTYMQERVHWGVHHIAPVNCMHLHNIKFFRSESTRFPKNFVRYLNEPFAESRVLVRQGFFEHKEGLHPNLRERKWYPANHFKGAKSNVYVRQAWLFSFDEWMEMSPCERRELFFSTLDLSPYAAKLRSSTPQGAKPISREAILRAFLAAPLEGISTFTQLHRRLESDLRFRYQCGFSLHESIPSVSTLSRVFQAIVDKGVAATLFAELVRQCRDEGLIEGEHVAIDSTAIHAYERKHPRSGVQPSNRANWGAKFDAFGNKLAWFGYKVHLAVDAKSELPMALTVTPANVYDGEMAIPLMEELHHHDWRIRFVLMDAGYDQTKNYEAARALGAQAIIPMNRRNEKEPPEGMDFDGTPRCTMGYRMTYWGVHNAWLKFRCPHATGQVDCPLGMAACSASNYGMVVKKHLDEDVRRYANPHRGSRTWKMLYDERTAVERCFARLKEWLTLDGVHVRGIEKVTVHAYIHAIVLLASALAMHRTNRIEQVA

SEQ ID NO: 1532 - DNA, 1479 bp, Alicyclobacillus acidocaldarius
atgctgctcagcaacggtactacctatatgcaggaacgggtgcactggggagttcatcatatcgcgcccgtaaattgtatgcatcttcataatatcaaattcttcaggagtgagtctaccaggtttcctaagaatttcgtcaggtatttgaatgagccttttgcagaatcacgagtccttgtgcggcaagggtttttcgagcacaaagaaggacttcaccccaacttgagagaaagaaaatggtatccagcaaaccatttcaagggggcgaagtccaacgtgtatgttcgacaagcgtggctcttttccttcgacgaatggatggaaatgagtccatgtgaacgacgtgagctctttttctcgaccctcgatttgagcccgtatgccgcgaagctgagaagttcgacaccccaaggggcaaagcccatctctcgagaagcgattttgcgcgcatttctcgcggcaccccttgagggcatttcgaccttcacgcagcttcaccgacgtttggagagcgatttgcgcttccgttaccagtgcggtttctcccttcacgaatccattccatctgtctcgactctaagccgcgtcttccaagctatcgtcgacaaaggggttgcggcgacgctatttgccgagttggtgcgtcaatgtcgtgacgaagggctcatcgagggcgaacacgtcgctatcgacagcacggcgatccatgcttatgagcggaaacacccacgctcaggtgtccagccctccaatcgggccaactggggcgcgaagttcgatgcctttggcaacaagctggcgtggtttggctacaaggtccatttagccgtcgatgcgaaaagtgaacttcctatggcgctcacggtgacgccagcgaacgtctacgatggagagatggccattcccctcatggaagagcttcatcaccacgactggcggattcgcttcgtgttgatggatgcaggatacgaccagacgaaaaactatgaagccgctcgagcattgggcgctcaggctatcatcccgatgaatcgccggaatgagaaagagccgccggaagggatggatttcgacggcacgccccgctgcacgatggggtaccgaatgacgtattggggcgtccataacgcctggctcaagtttcgctgtccgcacgcgacaggccaggtcgattgcccgcttggcatggctgcctgttctgcatcgaactatggcatggtcgtgaagaagcacctcgatgaggacgtccgtcgatacgcgaatccacatcgcggctctcgcacatggaagatgctttatgatgaacggaccgctgtagagcgctgttttgcacggctgaaagagtggctgacgctggacggcgtgcatgtacgtggcatcgagaaagtcaccgtacatgcgtacatccacgcgattgtgctcttggcatctgctctggcgatgcaccggacgaatcgtatcgagcaggtggcttaa

SEQ ID NO: 1533 - protein, 391 aa, Thermosinus carboxydivorans; identical to SEQ ID NO: 1312

SEQ ID NO: 1534 - protein, 403 aa, Syntrophomonas wolfei; identical to SEQ ID NO: 1314

SEQ ID NO: 1535 - protein, 411 aa, Desulfotomaculum reducens; identical to SEQ ID NO: 1313

SEQ ID NO: 1536 - protein, 395 aa, Syntrophomonas wolfei; identical to SEQ ID NO: 1315

SEQ ID NO: 1537 - protein, 395 aa, Syntrophomonas wolfei; identical to SEQ ID NO: 1316

SEQ ID NO: 1538 - protein, 492 aa, Artificial
  Alicyclobacillus acidocaldarius mutated SEQ ID NO 1531
MLLSNGTTYMQERVHWGVHHIAPVNCMHLHNIKFFRSESTRFPKNFVRYLNEPFAESRVLVRQGFFEHKDGLHPNLRERKWYPANHFKGAKSNVYVRQAWLFSFDEWMEMSPCERRELFFSTLDLSPYAAKLRSSTPQGAKPISREAILRAFLAAPLEGISTFTQLHRRLESDLRFRYQCGFSLHESIPSVSTLSRVFQAIVDKGVAATLFAELVRQCRDEGLIEGEHVAIDSTAIHAYERKHPRSGVQPSNRANWGAKFDAFGNKLAWFGYKVHLAVDAKSELPMALTVTPANVYDGEMAIPLMEELHHHDWRIRFVLMDAGYDQTKNYEAARALGAQAIIPMNRRNEKEPPEGMDFDGTPRCTMGYRMTYWGVHNAWLKFRCPHATGQVDCPLGMAACSASNYGMVVKKHLDEDVRRYANPHRGSRTWKMLYDERTAVERCFARLKEWLTLDGVHVRGIEKVTVHAYIHAIVLLASALAMHRTNRIEQVA

SEQ ID NO: 1539 - protein, 492 aa, Artificial
  Alicyclobacillus acidocaldarius mutated SEQ ID NO 1531
MLLSNGTTYMQERVHWGVHHIAPVNCMHLHNIKFFRSESTRFPKNFVRYLNEPFAESRVLVRQGFFEHKEGLHPNLRERKWYPANHFKGAKSNVYVRQAWLFSFDEWMEMSPCDRRELFFSTLDLSPYAAKLRSSTPQGAKPISREAILRAFLAAPLEGISTFTQLHRRLESDLRFRYQCGFSLHESIPSVSTLSRVFQAIVDKGVAATLFAELVRQCRDEGLIEGEHVAIDSTAIHAYERKHPRSGVQPSNRANWGAKFDAFGNKLAWFGYKVHLAVDAKSELPMALTVTPANVYDGEMAIPLMEELHHHDWRIRFVLMDAGYDQTKNYEAARALGAQAIIPMNRRNEKEPPEGMDFDGTPRCTMGYRMTYWGVHNAWLKFRCPHATGQVDCPLGMAACSASNYGMVVKKHLDEDVRRYANPHRGSRTWKMLYDERTAVERCFARLKEWLTLDGVHVRGIEKVTVHAYIHAIVLLASALAMHRTNRIEQVA

SEQ ID NO: 1540 - protein, 492 aa, Artificial
  Alicyclobacillus acidocaldarius mutated SEQ ID NO 1531
MLLSNGTTYMQERVHWGVHHIAPVNCMHLHNIKFFRSESTRFPKNFVRYLNEPFAESRVLVRQGFFEHKEGLHPNLRERKWYPANHFKGAKSNVYVRQAWLFSFDEWMEMSPCERRELFFSTLDLSPYAAKLRSSTPQGAKPISREAILRAFLAAPLEGISTFTQLHRRLESDLRFRYQCGFSLHESIPSVSTLSRVFQAIVDKGVAATLFAELVRQCRDEGLIEGEHVAIDSTAIHAYERKHPRSGVQPSNRANWGAKFDAFGNKLAWFGYKVHLAVDAKSELPMALTVTPANVYDGEMAIPLMEELHHHDWRIRFVLMDAGYDQTKNYEAARALGAQAIIPMNRRNEKEPPEGMDFDGTPRCTMGYRMTYWGVHNAWLKFRCPHATGQVDCPLGMAACSASNYGMVVKKHLDEDVRRYANPHRGSRTWKMLYDERTAIERCFARLKEWLTLDGVHVRGIEKVTVHAYIHAIVLLASALAMHRTNRIEQVA

SEQ ID NO: 1541 - protein, 492 aa, Artificial
  Alicyclobacillus acidocaldarius mutated SEQ ID NO 1531
MLLSNGTTYMQERVHWGVHHIAPVNCMHLHNIKFFRSESTRFPKNFVRYLNEPFAESRVLVRQGFFDHKEGLHPNLRERKWYPANHFKGAKSNVYVRQAWLFSFDEWMEMSPCERRELFFSTLDLSPYAAKLRSSTPQGAKPISREAILRAFLAAPLEGISTFTQLHRRLESDLRFRYQCGFSLHESIPSVSTLSRVFQAIVDKGVAATLFAELVRQCRDEGLIEGEHVAIDSTAIHAYERKHPRSGVQPSNRANWGAKFDAFGNKLAWFGYKVHLAVDAKSELPMALTVTPANVYDGEMAIPLMEELHHHDWRIRFVLMDAGYDQTKNYEAARALGAQAIIPMNRRNEKEPPEGMDFDGTPRCTMGYRMTYWGVHNAWLKFRCPHATGQVDCPLGMAACSASNYGMVVKKHLDEDVRRYANPHRGSRTWKMLYDERTAVERCFARLKEWLTLDGVHVRGIEKVTVHAYIHAIVLLASALAMHRTNRIEQVA

SEQ ID NO: 1542 - protein, 492 aa, Artificial
  Alicyclobacillus acidocaldarius mutated SEQ ID NO 1531
MLLSNGTTYMQERVHWGVHHIAPVNCMHLHNIKFFRSESTRFPKNFVRYLNEPFAESRVLVRQGFFEHKEGLHPNLRERKWYPANHFKGAKSNVYVRQAWLFSFDEWMEMSPCERRELFFSTLDLSPYAAKLRSSTPQGAKPISREAILRAFLAAPLEGISTFTQLHRRLESDLRFRYQCGFSLHESIPSVSTLSRVFQAIVDKGVAATLFAELVRQCRDEGLIEGEHVAIDSTAIHAYERKHPRSGVQPSNRANWGAKFDAFGNKLAWFGYKVHLAVDAKSELPMALTVTPANVYDGEMAIPLMEELHHHEWRIRFVLMDAGYDQTKNYEAARALGAQAIIPMNRRNEKEPPEGMDFDGTPRCTMGYRMTYWGVHNAWLKFRCPHATGQVDCPLGMAACSASNYGMVVKKHLDEDVRRYANPHRGSRTWKMLYDERTAVERCFARLKEWLTLDGVHVRGIEKVTVHAYIHAIVLLASALAMHRTNRIEQVA

SEQ ID NO: 1543 - DNA, 1479 bp, Artificial
  Alicyclobacillus acidocaldarius mutated SEQ ID NO 1532
atgctgctcagcaacggtactacctatatgcaggaacgggtgcactggggagttcatcatatcgcgcccgtaaattgtatgcatcttcataatatcaaattcttcaggagtgagtctaccaggtttcctaagaatttcgtcaggtatttgaatgagccttttgcagaatcacgagtccttgtgcggcaagggtttttcgagcacaaagatggacttcaccccaacttgagagaaagaaaatggtatccagcaaaccatttcaagggggcgaagtccaacgtgtatgttcgacaagcgtggctcttttccttcgacgaatggatggaaatgagtccatgtgaacgacgtgagctctttttctcgaccctcgatttgagcccgtatgccgcgaagctgagaagttcgacaccccaaggggcaaagcccatctctcgagaagcgattttgcgcgcatttctcgcggcaccccttgagggcatttcgaccttcacgcagcttcaccgacgtttggagagcgatttgcgcttccgttaccagtgcggtttctcccttcacgaatccattccatctgtctcgactctaagccgcgtcttccaagctatcgtcgacaaaggggttgcggcgacgctatttgccgagttggtgcgtcaatgtcgtgacgaagggctcatcgagggcgaacacgtcgctatcgacagcacggcgatccatgcttatgagcggaaacacccacgctcaggtgtccagccctccaatcgggccaactggggcgcgaagttcgatgcctttggcaacaagctggcgtggtttggctacaaggtccatttagccgtcgatgcgaaaagtgaacttcctatggcgctcacggtgacgccagcgaacgtctacgatggagagatggccattcccctcatggaagagcttcatcaccacgactggcggattcgcttcgtgttgatggatgcaggatacgaccagacgaaaaactatgaagccgctcgagcattgggcgctcaggctatcatcccgatgaatcgccggaatgagaaagagccgccggaagggatggatttcgacggcacgccccgctgcacgatggggtaccgaatgacgtattggggcgtccataacgcctggctcaagtttcgctgtccgcacgcgacaggccaggtcgattgcccgcttggcatggctgcctgttctgcatcgaactatggcatggtcgtgaagaagcacctcgatgaggacgtccgtcgatacgcgaatccacatcgcggctctcgcacatggaagatgctttatgatgaacggaccgctgtagagcgctgttttgcacggctgaaagagtggctgacgctggacggcgtgcatgtacgtggcatcgagaaagtcaccgtacatgcgtacatccacgcgattgtgctcttggcatctgctctggcgatgcaccggacgaatcgtatcgagcaggtggcttaa

SEQ ID NO: 1544 - DNA, 1479 bp, Artificial
  Alicyclobacillus acidocaldarius mutated SEQ ID NO 1532
atgctgctcagcaacggtactacctatatgcaggaacgggtgcactggggagttcatcatatcgcgcccgtaaattgtatgcatcttcataatatcaaattcttcaggagtgagtctaccaggtttcctaagaatttcgtcaggtatttgaatgagccttttgcagaatcacgagtccttgtgcggcaagggtttttcgagcacaaagaaggacttcaccccaacttgagagaaagaaaatggtatccagcaaaccatttcaagggggcgaagtccaacgtgtatgttcgacaagcgtggctcttttccttcgacgaatggatggaaatgagtccatgtgatcgacgtgagctctttttctcgaccctcgatttgagcccgtatgccgcgaagctgagaagttcgacaccccaaggggcaaagcccatctctcgagaagcgattttgcgcgcatttctcgcggcaccccttgagggcatttcgaccttcacgcagcttcaccgacgtttggagagcgatttgcgcttccgttaccagtgcggtttctcccttcacgaatccattccatctgtctcgactctaagccgcgtcttccaagctatcgtcgacaaaggggttgcggcgacgctatttgccgagttggtgcgtcaatgtcgtgacgaagggctcatcgagggcgaacacgtcgctatcgacagcacggcgatccatgcttatgagcggaaacacccacgctcaggtgtccagccctccaatcgggccaactggggcgcgaagttcgatgcctttggcaacaagctggcgtggtttggctacaaggtccatttagccgtcgatgcgaaaagtgaacttcctatggcgctcacggtgacgccagcgaacgtctacgatggagagatggccattcccctcatggaagagcttcatcaccacgactggcggattcgcttcgtgttgatggatgcaggatacgaccagacgaaaaactatgaagccgctcgagcattgggcgctcaggctatcatcccgatgaatcgccggaatgagaaagagccgccggaagggatggatttcgacggcacgccccgctgcacgatggggtaccgaatgacgtattggggcgtccataacgcctggctcaagtttcgctgtccgcacgcgacaggccaggtcgattgcccgcttggcatggctgcctgttctgcatcgaactatggcatggtcgtgaagaagcacctcgatgaggacgtccgtcgatacgcgaatccacatcgcggctctcgcacatggaagatgctttatgatgaacggaccgctgtagagcgctgttttgcacggctgaaagagtggctgacgctggacggcgtgcatgtacgtggcatcgagaaagtcaccgtacatgcgtacatccacgcgattgtgctcttggcatctgctctggcgatgcaccggacgaatcgtatcgagcaggtggcttaa

SEQ ID NO: 1545 - DNA, 1479 bp, Artificial
  Alicyclobacillus acidocaldarius mutated SEQ ID NO 1532
atgctgctcagcaacggtactacctatatgcaggaacgggtgcactggggagttcatcatatcgcgcccgtaaattgtatgcatcttcataatatcaaattcttcaggagtgagtctaccaggtttcctaagaatttcgtcaggtatttgaatgagccttttgcagaatcacgagtccttgtgcggcaagggtttttcgagcacaaagaaggacttcaccccaacttgagagaaagaaaatggtatccagcaaaccatttcaagggggcgaagtccaacgtgtatgttcgacaagcgtggctcttttccttcgacgaatggatggaaatgagtccatgtgaacgacgtgagctctttttctcgaccctcgatttgagcccgtatgccgcgaagctgagaagttcgacaccccaaggggcaaagcccatctctcgagaagcgattttgcgcgcatttctcgcggcaccccttgagggcatttcgaccttcacgcagcttcaccgacgtttggagagcgatttgcgcttccgttaccagtgcggtttctcccttcacgaatccattccatctgtctcgactctaagccgcgtcttccaagctatcgtcgacaaaggggttgcggcgacgctatttgccgagttggtgcgtcaatgtcgtgacgaagggctcatcgagggcgaacacgtcgctatcgacagcacggcgatccatgcttatgagcggaaacacccacgctcaggtgtccagccctccaatcgggccaactggggcgcgaagttcgatgcctttggcaacaagctggcgtggtttggctacaaggtccatttagccgtcgatgcgaaaagtgaacttcctatggcgctcacggtgacgccagcgaacgtctacgatggagagatggccattcccctcatggaagagcttcatcaccacgactggcggattcgcttcgtgttgatggatgcaggatacgaccagacgaaaaactatgaagccgctcgagcattgggcgctcaggctatcatcccgatgaatcgccggaatgagaaagagccgccggaagggatggatttcgacggcacgccccgctgcacgatggggtaccgaatgacgtattggggcgtccataacgcctggctcaagtttcgctgtccgcacgcgacaggccaggtcgattgcccgcttggcatggctgcctgttctgcatcgaactatggcatggtcgtgaagaagcacctcgatgaggacgtccgtcgatacgcgaatccacatcgcggctctcgcacatggaagatgctttatgatgaacggaccgctattgagcgctgttttgcacggctgaaagagtggctgacgctggacggcgtgcatgtacgtggcatcgagaaagtcaccgtacatgcgtacatccacgcgattgtgctcttggcatctgctctggcgatgcaccggacgaatcgtatcgagcaggtggcttaa

SEQ ID NO: 1546 - DNA, 1479 bp, Artificial
  Alicyclobacillus acidocaldarius mutated SEQ ID NO 1532
atgctgctcagcaacggtactacctatatgcaggaacgggtgcactggggagttcatcatatcgcgcccgtaaattgtatgcatcttcataatatcaaattcttcaggagtgagtctaccaggtttcctaagaatttcgtcaggtatttgaatgagccttttgcagaatcacgagtccttgtgcggcaagggtttttcgatcacaaagaaggacttcaccccaacttgagagaaagaaaatggtatccagcaaaccatttcaagggggcgaagtccaacgtgtatgttcgacaagcgtggctcttttccttcgacgaatggatggaaatgagtccatgtgaacgacgtgagctctttttctcgaccctcgatttgagcccgtatgccgcgaagctgagaagttcgacaccccaaggggcaaagcccatctctcgagaagcgattttgcgcgcatttctcgcggcaccccttgagggcatttcgaccttcacgcagcttcaccgacgtttggagagcgatttgcgcttccgttaccagtgcggtttctcccttcacgaatccattccatctgtctcgactctaagccgcgtcttccaagctatcgtcgacaaaggggttgcggcgacgctatttgccgagttggtgcgtcaatgtcgtgacgaagggctcatcgagggcgaacacgtcgctatcgacagcacggcgatccatgcttatgagcggaaacacccacgctcaggtgtccagccctccaatcgggccaactggggcgcgaagttcgatgcctttggcaacaagctggcgtggtttggctacaaggtccatttagccgtcgatgcgaaaagtgaacttcctatggcgctcacggtgacgccagcgaacgtctacgatggagagatggccattcccctcatggaagagcttcatcaccacgactggcggattcgcttcgtgttgatggatgcaggatacgaccagacgaaaaactatgaagccgctcgagcattgggcgctcaggctatcatcccgatgaatcgccggaatgagaaagagccgccggaagggatggatttcgacggcacgccccgctgcacgatggggtaccgaatgacgtattggggcgtccataacgcctggctcaagtttcgctgtccgcacgcgacaggccaggtcgattgcccgcttggcatggctgcctgttctgcatcgaactatggcatggtcgtgaagaagcacctcgatgaggacgtccgtcgatacgcgaatccacatcgcggctctcgcacatggaagatgctttatgatgaacggaccgctgtagagcgctgttttgcacggctgaaagagtggctgacgctggacggcgtgcatgtacgtggcatcgagaaagtcaccgtacatgcgtacatccacgcgattgtgctcttggcatctgctctggcgatgcaccggacgaatcgtatcgagcaggtggcttaa

SEQ ID NO: 1547 - DNA, 1479 bp, Artificial
  Alicyclobacillus acidocaldarius mutated SEQ ID NO 1532
atgctgctcagcaacggtactacctatatgcaggaacgggtgcactggggagttcatcatatcgcgcccgtaaattgtatgcatcttcataatatcaaattcttcaggagtgagtctaccaggtttcctaagaatttcgtcaggtatttgaatgagccttttgcagaatcacgagtccttgtgcggcaagggtttttcgagcacaaagaaggacttcaccccaacttgagagaaagaaaatggtatccagcaaaccatttcaagggggcgaagtccaacgtgtatgttcgacaagcgtggctcttttccttcgacgaatggatggaaatgagtccatgtgaacgacgtgagctctttttctcgaccctcgatttgagcccgtatgccgcgaagctgagaagttcgacaccccaaggggcaaagcccatctctcgagaagcgattttgcgcgcatttctcgcggcaccccttgagggcatttcgaccttcacgcagcttcaccgacgtttggagagcgatttgcgcttccgttaccagtgcggtttctcccttcacgaatccattccatctgtctcgactctaagccgcgtcttccaagctatcgtcgacaaaggggttgcggcgacgctatttgccgagttggtgcgtcaatgtcgtgacgaagggctcatcgagggcgaacacgtcgctatcgacagcacggcgatccatgcttatgagcggaaacacccacgctcaggtgtccagccctccaatcgggccaactggggcgcgaagttcgatgcctttggcaacaagctggcgtggtttggctacaaggtccatttagccgtcgatgcgaaaagtgaacttcctatggcgctcacggtgacgccagcgaacgtctacgatggagagatggccattcccctcatggaagagcttcatcaccacgaatggcggattcgcttcgtgttgatggatgcaggatacgaccagacgaaaaactatgaagccgctcgagcattgggcgctcaggctatcatcccgatgaatcgccggaatgagaaagagccgccggaagggatggatttcgacggcacgccccgctgcacgatggggtaccgaatgacgtattggggcgtccataacgcctggctcaagtttcgctgtccgcacgcgacaggccaggtcgattgcccgcttggcatggctgcctgttctgcatcgaactatggcatggtcgtgaagaagcacctcgatgaggacgtccgtcgatacgcgaatccacatcgcggctctcgcacatggaagatgctttatgatgaacggaccgctgtagagcgctgttttgcacggctgaaagagtggctgacgctggacggcgtgcatgtacgtggcatcgagaaagtcaccgtacatgcgtacatccacgcgattgtgctcttggcatctgctctggcgatgcaccggacgaatcgtatcgagcaggtggcttaa

SEQ ID NO: 1548 - protein, 974 aa, Alicyclobacillus acidocaldarius
MNFHPRHGPVRTFHWLSAPPRRTYSLLHGLRSMNFVNIIINSLKCVNSACVPLGVRPFSCRHKTTRADKGNVIEWSGTTVRQTARSLGWPMPASKLVLIDGNSILYRAFFALPPLTARDGTPTNAVYGFTTMILRLMSDEKPTHLAVAFDKSKTTFRHADFAAYKGTRQETPDELVQQFPLARRTLEALSIPMVEIDQYEADDVIGTLAKRAAEAGFDVRVVSGDKDLLQLVDDRIHVLLTRKGITEMEHFDEQAVARRYPGLKPAQVIDLKGLMGDPSDNIPGVPGVGEKTALKLLASFGTVEGVYDHLDEVQGQKLRERLEQHREDAFLSKRLATIACDAPIEVDLETLRYEGPDPARAIAWFRELDFRSLVDKISEEMSHDSTPTPSPAAASGASSEWSSFAYGLIEDAGAWQEAISSFSEPVGVMMDLADPDYHRAEIRGMAVATPKRAYYVRFGERLELSDVRPWLVSDRPKVAFDLKSMAFALDAHGIGLTSECGWQDVKLAAYLLNPQDGEVELSDVFARERGQELPAWEEGEREKWLAYTASQLPPLFESLAYTIRMQEMERLYQEVELPLAFVLAKMEITGFYVNREKLVAFGQELTERIKRITQEIYDLAGTSFNLNSPKQLGEILFDKLGLPALKKTKTGYSTSADVLEKLAPMHEIVQKILDYRLLAKLQSTYVEGLLKVIRKETGRVHTRFHQTLTATGRLSSSEPNLQNIPIRLEEGRRLRQVFEPTYKDWVIFAADYSQIELRILAHLSGDEALIDAFRRDMDIHTRTAADVFEVPPEQVTSLMRRQAKAVNFGIVYGISDFGLAQNLNIPQKEAKRFIESYFEKFPGVKRYMDEIVKQARERGYVTTLMNRRRYLPDIHSRNYQLRSFAERTAMNTPIQGSAADLIKLAMVRIDRAMRDAQMDARMLLQVHDELIFECPKDELAALEVLVRDNMENAMTLSVPLKVDTAYGPTWYDAK

SEQ ID NO: 1549 - DNA, 2925 bp, Alicyclobacillus acidocaldarius
gtgaacttccatccgcggcacggaccagttcgcaccttccactggctctctgcaccgccccggcggacgtactctctccttcatggccttcgctcgatgaattttgtgaacatcataatcaattcgttgaagtgtgtcaactcggcgtgcgtcccgctgggtgtgaggccgttttcgtgccgccacaagacgacgcgggccgacaaggggaatgtgatagaatggagcgggacaacagtgcgccaaacggcgcgaagtctggggtggcctatgccagcgtcgaaactcgtgttgattgatggaaatagcatcttgtatcgagcgttcttcgcgctgccgccgctcactgcgagggacggcacgcccacgaacgccgtgtacggctttacgacgatgatcttgcggctgatgtcggacgaaaagccgacgcatctggccgtcgcgtttgataaatcgaagacgacgtttcgccatgcggatttcgcggcgtacaaaggcacgcgccaggagacgcccgacgagctcgtgcaacagtttccgctcgcgcgccgcaccctggaggcgctgtccatcccgatggtcgagatcgaccaatacgaggccgacgacgtgatcggaacgctcgccaagcgagcggcggaggctggctttgacgtccgcgtggtctcgggtgacaaggacctgttgcagctggtcgacgatcggatccacgtgctcctgacgcgcaagggcatcaccgagatggagcactttgacgagcaggccgttgcccgccggtatccggggctcaagcccgcgcaggtgatcgatctcaagggcctcatgggcgatccgtccgacaacattccgggcgtgcctggggtgggcgaaaagacggcgctcaaactgctcgcgtcctttggcacggtcgagggcgtgtacgatcacctcgacgaagtccagggccagaagctgcgggagcgcctcgagcagcaccgggaggacgcgtttctctccaagcgcctcgccaccatcgcgtgcgacgcgcccatcgaggtggatctcgagacgctgcgatacgaagggccggatcccgcccgcgccatcgcctggttccgcgagctcgacttccgatccctcgtcgacaaaatttccgaggaaatgagccacgattcgacgccgaccccttcgccggcggccgcgagcggcgcgtcgagcgagtggagttcctttgcgtacggcctgattgaggacgcgggcgcctggcaggaggccatctcgtcgttcagcgaaccggtcggcgtcatgatggacttggcggatccggactatcaccgggcggagatccgcggcatggccgtcgcgacgccgaagcgcgcgtactacgttcgcttcggcgagcgactggagttgagcgacgtccggccatggctcgtgtcggatcggccgaaggtggcgttcgacctgaagtcgatggcgttcgcgctggacgcgcacggcatcggattgacgtcggagtgcggctggcaggacgtgaagctggctgcgtacctgctcaacccgcaggacggcgaggtcgaactgtccgatgtgttcgcccgcgagcgcggccaggaactgcccgcctgggaggagggcgagcgggagaagtggctcgcctacacggcgtctcagctgcctccgctcttcgagtccctggcgtacacgattcgcatgcaggagatggagcggctgtaccaagaggtggagcttcctctggcgttcgtgctggcgaagatggagatcacggggttttacgtgaatcgcgagaagctggtcgcatttgggcaggaattgacggagcgaatcaagcgaatcacgcaggagatctacgatctcgcgggcacttcgttcaacctcaactcgccgaagcagctcggcgagatcctgttcgacaagctcggcttgcctgcgctgaagaagacgaagaccggctattccacgagcgctgacgtgctcgaaaagctggcgcccatgcacgagatcgtgcagaagatcctcgattatcgtctgctggcgaagctgcagtcgacgtacgtcgagggcctactgaaagtcatccgcaaggagaccggccgggtgcacacccggtttcatcagacgctcacggcgaccggcaggctctcaagcagcgagcccaatctgcagaatatccccattcggctcgaggaggggcggaggctgcgccaggtgttcgagccgacctacaaggactgggtgattttcgccgccgactattcgcagatcgagttgcgcatcctggcccacctgtcgggcgacgaggcgctcatcgacgcgttccgccgcgacatggacatccacacgcggacggcggcggacgtgtttgaggtgccgcctgagcaggtgacgagcctgatgcgccgccaggcgaaggccgtgaacttcggcatcgtgtacgggatcagcgatttcggactcgcgcagaacttgaacatcccgcagaaagaggcgaaacggttcatcgagagttatttcgagaagtttcccggcgtcaagcgatacatggacgagatcgtcaagcaggcgcgcgagcgcggctatgtcacgacactgatgaaccgacggcggtatctgccggacatccacagccgcaattatcagctccgaagcttcgccgagcgcaccgcgatgaacacgcccatccagggaagcgccgcggatctgatcaagctcgcgatggtgcggatcgatcgcgccatgcgcgacgcgcagatggacgcgcgcatgttgctccaggtgcacgacgagctgatctttgagtgtccgaaggacgaactggccgcgctcgaagtgcttgtccgagacaacatggaaaacgccatgaccttgtctgtgccgctcaaggtggataccgcctacggcccgacgtggtacgacgccaagtga

SEQ ID NO: 1550 - protein, 942 aa, Alicyclobacillus acidocaldarius
MNFVNIIINSLKCVNSACVPLGVRPFSCRHKTTRADKGNVIEWSGTTVRQTARSLGWPMPASKLVLIDGNSILYRAFFALPPLTARDGTPTNAVYGFTTMILRLMSDEKPTHLAVAFDKSKTTFRHADFAAYKGTRQETPDELVQQFPLARRTLEALSIPMVEIDQYEADDVIGTLAKRAAEAGFDVRVVSGDKDLLQLVDDRIHVLLTRKGITEMEHFDEQAVARRYPGLKPAQVIDLKGLMGDPSDNIPGVPGVGEKTALKLLASFGTVEGVYDHLDEVQGQKLRERLEQHREDAFLSKRLATIACDAPIEVDLETLRYEGPDPARAIAWFRELDFRSLVDKISEEMSHDSTPTPSPAAASGASSEWSSFAYGLIEDAGAWQEAISSFSEPVGVMMDLADPDYHRAEIRGMAVATPKRAYYVRFGERLELSDVRPWLVSDRPKVAFDLKSMAFALDAHGIGLTSECGWQDVKLAAYLLNPQDGEVELSDVFARERGQELPAWEEGEREKWLAYTASQLPPLFESLAYTIRMQEMERLYQEVELPLAFVLAKMEITGFYVNREKLVAFGQELTERIKRITQEIYDLAGTSFNLNSPKQLGEILFDKLGLPALKKTKTGYSTSADVLEKLAPMHEIVQKILDYRLLAKLQSTYVEGLLKVIRKETGRVHTRFHQTLTATGRLSSSEPNLQNIPIRLEEGRRLRQVFEPTYKDWVIFAADYSQIELRILAHLSGDEALIDAFRRDMDIHTRTAADVFEVPPEQVTSLMRRQAKAVNFGIVYGISDFGLAQNLNIPQKEAKRFIESYFEKFPGVKRYMDEIVKQARERGYVTTLMNRRRYLPDIHSRNYQLRSFAERTAMNTPIQGSAADLIKLAMVRIDRAMRDAQMDARMLLQVHDELIFECPKDELAALEVLVRDNMENAMTLSVPLKVDTAYGPTWYDAK

SEQ ID NO: 1551 - protein, 873 aa, Geobacillus thermodenitrificans
KLVLIDGNSVAYRAFFALPLLHNDKGIHTNAVYGFTMMLNKILAEEQPTHLLVAFDAGKTTFRHETFQEYKGGRQQTPPELSEQFPLLRELLKAYRIPAYELDHYEADDIIGTLAARAEQEGFEVKIISGDRDLTQLASRHVTVDITKKGITDIEPYTPETVREKYGLTPEQIVDLKGLMGDKSDNIPGVPGIGEKTAVKLLKQFGTVENVLASIDEVKGEKLKENLRQHRDLALLSKQLASICRDAPVELSLDDIVYEGQDREKVIALFKELGFQSFLEKMAAPAAEGEKPLEEMEFAIVDVITEEMLADKAALVVEVMEENYHDAPIVGIALVNEHGRFFMRPETALADSQFLAWLADETKKKSMFDAKRAVVALKWKGIELRGVAFDLLLAAYLLNPAQDAGDIAAVAKMKQYEAVRSDEAVYGKGVKRSLPDEQTLAEHLVRKAAAIWALEQPFMDDLRNNEQDQLLTKLEQPLAAILAEMEFTGVNVDTKRLEQMGSELAEQLRAIEQRIYELAGQEFNINSPKQLGVILFEKLQLPVLKKTKTGYSTSADVLEKLAPHHEIVENILHYRQLGKLQSTYIEGLLKVVRPDTGKVHTMFNQALTQTGRLSSAEPNLQNIPIRLEEGRKIRQAFVPSEPDWLIFAADYSQIELRVLAHIADDDNLIEAFQRDLDIHTKTAMDIFHVSEEEVTANMRRQAKAVNFGIVYGISDYGLAQNLNITRKEAAEFIERYFASFPGVKQYMENIVQEAKQKGYVTTLLHRRRYLPDITSRNFNVRSFAERTAMNTPIQGSAADIIKKAMIDLAARLKEEQLQARLLLQVHDELILEAPKEEIERLCELVPEVMEQAVTLRVPLKVDYHYGPTWYDAK

SEQ ID NO: 1552 - protein, 873 aa, Geobacillus stearothermophilus; identical to SEQ ID NO: 1551

SEQ ID NO: 1553 - protein, 874 aa, Bacillus  G(2006)
NKLVLIDGNSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRSDEAVYGKGAKRAVPDEPVLAEHLVRKAAAIWALERPFLDELRRNEQDRLLVELEQPLSSILAEMEFAGVKVDTKRLEQMGEELAEQLRTVEQRIYELAGQEFNINSPKQLGVILFEKLQLPILKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFESFPGVKRYMENIVQEAKQKGYVTTLLHRRRYLPDITSRNFNVRSFAERMAMNTPIQGSAADIIKKAMIDLNARLKEERLQARLLLQVHDELILEAPKEEMERLCRLVPEVMEQAVTLRVPLKVDYHYGPTWYDAK

SEQ ID NO: 1554 - protein, 874 aa, Geobacillus stearothermophilus
NKLVLIDGNSVAYRAFFALPLLHNDKGIHTNAVYGFTMMLNKILAEEQPTHILVAFDAGKTTFRHETFQDYKGGRQQTPPELSEQFPLLRELLKAYRIPAYELDHYEADDIIGTMAARAEREGFAVKVISGDRDLTQLASPQVTVEITKKGITDIESYTPETVVEKYGLTPEQIVDLKGLMGDKSDNIPGVPGIGEKTAVKLLKQFGTVENVLASIDEIKGEKLKENLRQYRDLALLSKQLAAICRDAPVELTLDDIVYKGEDREKVVALFQELGFQSFLDKMAVQTDEGEKPLAGMDFAIADSVTDEMLADKAALVVEVVGDNYHHAPIVGIALANERGRFFLRPETALADPKFLAWLGDETKKKTMFDSKRAAVALKWKGIELRGVVFDLLLAAYLLDPAQAAGDVAAVAKMHQYEAVRSDEAVYGKGAKRTVPDEPTLAEHLVRKAAAIWALEEPLMDELRRNEQDRLLTELEQPLAGILANMEFTGVKVDTKRLEQMGAELTEQLQAVERRIYELAGQEFNINSPKQLGTVLFDKLQLPVLKKTKTGYSTSADVLEKLAPHHEIVEHILHYRQLGKLQSTYIEGLLKVVHPVTGKVHTMFNQALTQTGRLSSVEPNLQNIPIRLEEGRKIRQAFVPSEPDWLIFAADYSQIELRVLAHIAEDDNLIEAFRRGLDIHTKTAMDIFHVSEEDVTANMRRQAKAVNFGIVYGISDYGLAQNLNITRKEAAEFIERYFASFPGVKQYMDNIVQEAKQKGYVTTLLHRRRYLPDITSRNFNVRSFAERTAMNTPIQGSAADIIKKAMIDLSVRLREERLQARLLLQVHDELILEAPKEEIERLCRLVPEVMEQAVTLRVPLKVDYHYGPTWYDAK

SEQ ID NO: 1555 - protein, 974 aa, Artificial
  Alicyclobacillus acidocaldarius mutated SEQ ID NO 1548
MNFHPRHGPVRTFHWLSAPPRRTYSLLHGLRSMNFVNIIINSLKCVNSACVPLGVRPFSCRHKTTRADKGNVIEWSGTTVRQTARSLGWPMPASKLVLIDGNSILYRAFFALPPLTARDGTPTNAVYGFTTMILRLMSDEKPTHLAVAFDKSKTTFRHADFAAYKGTRQETPDELVQQFPLARRTLEALSIPMVEIDQYEADDVIGTLAKRAAEAGFDVRVVSGDKDLLQLVDDRIHVLLTRKGITEMEHFDEQAVARRYPGLKPAQVIDLKGLMGDPSDNIPGVPGVGEKTALKLLASFGTVEGVYDHLDEVQGQKLRERLEQHREDAFLSKRLATIACDAPIEVDLETLRYEGPDPARAIAWFRELDFRSLVDKISEEMSHDSTPTPSPAAASGASSEWSSFAYGLIEDAGAWQEAISSFSEPVGVMMDLADPDYHRAEIRGMAVATPKKAYYVRFGERLELSDVRPWLVSDRPKVAFDLKSMAFALDAHGIGLTSECGWQDVKLAAYLLNPQDGEVELSDVFARERGQELPAWEEGEREKWLAYTASQLPPLFESLAYTIRMQEMERLYQEVELPLAFVLAKMEITGFYVNREKLVAFGQELTERIKRITQEIYDLAGTSFNLNSPKQLGEILFDKLGLPALKKTKTGYSTSADVLEKLAPMHEIVQKILDYRLLAKLQSTYVEGLLKVIRKETGRVHTRFHQTLTATGRLSSSEPNLQNIPIRLEEGRRLRQVFEPTYKDWVIFAADYSQIELRILAHLSGDEALIDAFRRDMDIHTRTAADVFEVPPEQVTSLMRRQAKAVNFGIVYGISDFGLAQNLNIPQKEAKRFIESYFEKFPGVKRYMDEIVKQARERGYVTTLMNRRRYLPDIHSRNYQLRSFAERTAMNTPIQGSAADLIKLAMVRIDRAMRDAQMDARMLLQVHDELIFECPKDELAALEVLVRDNMENAMTLSVPLKVDTAYGPTWYDAK

SEQ ID NO: 1556 - protein, 974 aa, Artificial
  Alicyclobacillus acidocaldarius mutated SEQ ID NO 1548
MNFHPRHGPVRTFHWLSAPPRRTYSLLHGLRSMNFVNIIINSLKCVNSACVPLGVRPFSCRHKTTRADKGNVIEWSGTTVRQTARSLGWPMPASKLVLIDGNSILYRAFFALPPLTARDGTPTNAVYGFTTMILRLMSDEKPTHLAVAFDKSKTTFRHADFAAYKGTRQETPDELVQQFPLARRTLEALSIPMVEIDQYEADDVIGTLAKRAAEAGFDVRVVSGDKDLLQLVDDRIHVLLTRKGITEMEHFDEQAVARRYPGLKPAQVIDLKGLMGDPSDNIPGVPGVGEKTALKLLASFGTVEGVYDHLDEVQGQKLRERLEQHREDAFLSKRLATIACDAPIEVDLETLRYEGPDPARAIAWFRELDFRSLVDKISEEMSHDSTPTPSPAAASGASSEWSSFAYGLIEDAGAWQEAISSFSEPVGVMMDLADPDYHRAEIRGMAVATPKRAYYVRFGERLELSDVRPWLVSDRPKVAFDLKSMAFALDAHGIGLTSECGWQDVKLAAYLLNPQDGEVELSDVFARERGQELPAWEEGEREKWLAYTASQLPPLFESLAYTIRMQEMERLYQEVELPLAFVLAKMEITGFYVNREKLVAFGQELTERIKRITQEIYDLAGTSFNLNSPKQLGEILFDKLGLPALKKTKTGYSTSADVLEKLAPMHEIVQKILDYRLLAKLQSTYVEGLLKVIRKETGRVHTRFHQTLTATGRLSSSEPNLQNIPIRLEEGRRLRQVFEPTYKDWVIFAADYSQIELRILAHLSGDEALIDAFRRDMDIHTRTAADVFEVPPEQVTSLMRRQAKAVNFGIVYGISDFGLAQNLNIPQKEAKRFIESYFEKFPGVKRYMDEIVKQARERGYVTTLMNRRRYLPDIHSRNYQLRSFAERTAMNTPIQGSAADLIKLAMVRIDRAMRDAQMDARMLLQVHDELIFECPKDELAALEVLVKDNMENAMTLSVPLKVDTAYGPTWYDAK

SEQ ID NO: 1557 - protein, 974 aa, Artificial
  Alicyclobacillus acidocaldarius mutated SEQ ID NO 1548
MNFHPRHGPVRTFHWLSAPPRRTYSLLHGLRSMNFVNIIINSLKCVNSACVPLGVRPFSCRHKTTRADKGNVIEWSGTTVRQTARSLGWPMPASKLVLIDGNSILYRAFFALPPLTARDGTPTNAVYGFTTMILRLMSDEKPTHLAVAFDKSKTTFRHADFAAYKGTRQETPDELVQQFPLARRTLEALSIPMVEIDQYEADDVIGTLAKRAAEAGFDVRVVSGDKDLLQLVDERIHVLLTRKGITEMEHFDEQAVARRYPGLKPAQVIDLKGLMGDPSDNIPGVPGVGEKTALKLLASFGTVEGVYDHLDEVQGQKLRERLEQHREDAFLSKRLATIACDAPIEVDLETLRYEGPDPARAIAWFRELDFRSLVDKISEEMSHDSTPTPSPAAASGASSEWSSFAYGLIEDAGAWQEAISSFSEPVGVMMDLADPDYHRAEIRGMAVATPKRAYYVRFGERLELSDVRPWLVSDRPKVAFDLKSMAFALDAHGIGLTSECGWQDVKLAAYLLNPQDGEVELSDVFARERGQELPAWEEGEREKWLAYTASQLPPLFESLAYTIRMQEMERLYQEVELPLAFVLAKMEITGFYVNREKLVAFGQELTERIKRITQEIYDLAGTSFNLNSPKQLGEILFDKLGLPALKKTKTGYSTSADVLEKLAPMHEIVQKILDYRLLAKLQSTYVEGLLKVIRKETGRVHTRFHQTLTATGRLSSSEPNLQNIPIRLEEGRRLRQVFEPTYKDWVIFAADYSQIELRILAHLSGDEALIDAFRRDMDIHTRTAADVFEVPPEQVTSLMRRQAKAVNFGIVYGISDFGLAQNLNIPQKEAKRFIESYFEKFPGVKRYMDEIVKQARERGYVTTLMNRRRYLPDIHSRNYQLRSFAERTAMNTPIQGSAADLIKLAMVRIDRAMRDAQMDARMLLQVHDELIFECPKDELAALEVLVRDNMENAMTLSVPLKVDTAYGPTWYDAK

SEQ ID NO: 1558 - protein, 974 aa, Artificial
  Alicyclobacillus acidocaldarius mutated SEQ ID NO 1548
MNFHPRHGPVRTFHWLSAPPRRTYSLLHGLRSMNFVNIIINSLKCVNSACVPLGIRPFSCRHKTTRADKGNVIEWSGTTVRQTARSLGWPMPASKLVLIDGNSILYRAFFALPPLTARDGTPTNAVYGFTTMILRLMSDEKPTHLAVAFDKSKTTFRHADFAAYKGTRQETPDELVQQFPLARRTLEALSIPMVEIDQYEADDVIGTLAKRAAEAGFDVRVVSGDKDLLQLVDDRIHVLLTRKGITEMEHFDEQAVARRYPGLKPAQVIDLKGLMGDPSDNIPGVPGVGEKTALKLLASFGTVEGVYDHLDEVQGQKLRERLEQHREDAFLSKRLATIACDAPIEVDLETLRYEGPDPARAIAWFRELDFRSLVDKISEEMSHDSTPTPSPAAASGASSEWSSFAYGLIEDAGAWQEAISSFSEPVGVMMDLADPDYHRAEIRGMAVATPKRAYYVRFGERLELSDVRPWLVSDRPKVAFDLKSMAFALDAHGIGLTSECGWQDVKLAAYLLNPQDGEVELSDVFARERGQELPAWEEGEREKWLAYTASQLPPLFESLAYTIRMQEMERLYQEVELPLAFVLAKMEITGFYVNREKLVAFGQELTERIKRITQEIYDLAGTSFNLNSPKQLGEILFDKLGLPALKKTKTGYSTSADVLEKLAPMHEIVQKILDYRLLAKLQSTYVEGLLKVIRKETGRVHTRFHQTLTATGRLSSSEPNLQNIPIRLEEGRRLRQVFEPTYKDWVIFAADYSQIELRILAHLSGDEALIDAFRRDMDIHTRTAADVFEVPPEQVTSLMRRQAKAVNFGIVYGISDFGLAQNLNIPQKEAKRFIESYFEKFPGVKRYMDEIVKQARERGYVTTLMNRRRYLPDIHSRNYQLRSFAERTAMNTPIQGSAADLIKLAMVRIDRAMRDAQMDARMLLQVHDELIFECPKDELAALEVLVRDNMENAMTLSVPLKVDTAYGPTWYDAK

SEQ ID NO: 1559 - protein, 974 aa, Artificial
  Alicyclobacillus acidocaldarius mutated SEQ ID NO 1548
MNFHPRHGPVRTFHWLSAPPRRTYSLLHGLRSMNFVNIIINSLKCVNSACVPLGVRPFSCRHKTTRADKGNVIEWSGTTVRQTARSLGWPMPASKLVLIDGNSILYRAFFALPPLTARDGTPTNAVYGFTTMILRLMSDEKPTHLAVAFDKSKTTFRHADFAAYKGTRQETPDELVQQFPLARRTLEALSIPMVEIDQYEADDVIGTLAKRAAEAGFDVRVVSGDKDLLQLVDDRIHVLLTRKGITEMEHFDEQAVARRYPGLKPAQVIDLKGLMGDPSDNIPGVPGVGEKTALKLLASFGTVEGVYDHLDEVQGQKLRERLEQHREDAFLSKRLATIACDAPIEVDLETLRYEGPDPARAIAWFRELDFRSLVDKISEEMSHDSTPTPSPAAASGASSEWSSFAYGLIEDAGAWQEAISSFSEPVGVMMDLADPDYHRAEIRGMAVATPKRAYYVRFGERLELSDVRPWLVSDRPKVAFDLKSMAFALDAHGIGLTSDCGWQDVKLAAYLLNPQDGEVELSDVFARERGQELPAWEEGEREKWLAYTASQLPPLFESLAYTIRMQEMERLYQEVELPLAFVLAKMEITGFYVNREKLVAFGQELTERIKRITQEIYDLAGTSFNLNSPKQLGEILFDKLGLPALKKTKTGYSTSADVLEKLAPMHEIVQKILDYRLLAKLQSTYVEGLLKVIRKETGRVHTRFHQTLTATGRLSSSEPNLQNIPIRLEEGRRLRQVFEPTYKDWVIFAADYSQIELRILAHLSGDEALIDAFRRDMDIHTRTAADVFEVPPEQVTSLMRRQAKAVNFGIVYGISDFGLAQNLNIPQKEAKRFIESYFEKFPGVKRYMDEIVKQARERGYVTTLMNRRRYLPDIHSRNYQLRSFAERTAMNTPIQGSAADLIKLAMVRIDRAMRDAQMDARMLLQVHDELIFECPKDELAALEVLVRDNMENAMTLSVPLKVDTAYGPTWYDAK

SEQ ID NO: 1560 - DNA, 2925 bp, Artificial
  Alicyclobacillus acidocaldarius mutated SEQ ID NO 1549
gtgaacttccatccgcggcacggaccagttcgcaccttccactggctctctgcaccgccccggcggacgtactctctccttcatggccttcgctcgatgaattttgtgaacatcataatcaattcgttgaagtgtgtcaactcggcgtgcgtcccgctgggtgtgaggccgttttcgtgccgccacaagacgacgcgggccgacaaggggaatgtgatagaatggagcgggacaacagtgcgccaaacggcgcgaagtctggggtggcctatgccagcgtcgaaactcgtgttgattgatggaaatagcatcttgtatcgagcgttcttcgcgctgccgccgctcactgcgagggacggcacgcccacgaacgccgtgtacggctttacgacgatgatcttgcggctgatgtcggacgaaaagccgacgcatctggccgtcgcgtttgataaatcgaagacgacgtttcgccatgcggatttcgcggcgtacaaaggcacgcgccaggagacgcccgacgagctcgtgcaacagtttccgctcgcgcgccgcaccctggaggcgctgtccatcccgatggtcgagatcgaccaatacgaggccgacgacgtgatcggaacgctcgccaagcgagcggcggaggctggctttgacgtccgcgtggtctcgggtgacaaggacctgttgcagctggtcgacgatcggatccacgtgctcctgacgcgcaagggcatcaccgagatggagcactttgacgagcaggccgttgcccgccggtatccggggctcaagcccgcgcaggtgatcgatctcaagggcctcatgggcgatccgtccgacaacattccgggcgtgcctggggtgggcgaaaagacggcgctcaaactgctcgcgtcctttggcacggtcgagggcgtgtacgatcacctcgacgaagtccagggccagaagctgcgggagcgcctcgagcagcaccgggaggacgcgtttctctccaagcgcctcgccaccatcgcgtgcgacgcgcccatcgaggtggatctcgagacgctgcgatacgaagggccggatcccgcccgcgccatcgcctggttccgcgagctcgacttccgatccctcgtcgacaaaatttccgaggaaatgagccacgattcgacgccgaccccttcgccggcggccgcgagcggcgcgtcgagcgagtggagttcctttgcgtacggcctgattgaggacgcgggcgcctggcaggaggccatctcgtcgttcagcgaaccggtcggcgtcatgatggacttggcggatccggactatcaccgggcggagatccgcggcatggccgtcgcgacgccgaagaaagcgtactacgttcgcttcggcgagcgactggagttgagcgacgtccggccatggctcgtgtcggatcggccgaaggtggcgttcgacctgaagtcgatggcgttcgcgctggacgcgcacggcatcggattgacgtcggagtgcggctggcaggacgtgaagctggctgcgtacctgctcaacccgcaggacggcgaggtcgaactgtccgatgtgttcgcccgcgagcgcggccaggaactgcccgcctgggaggagggcgagcgggagaagtggctcgcctacacggcgtctcagctgcctccgctcttcgagtccctggcgtacacgattcgcatgcaggagatggagcggctgtaccaagaggtggagcttcctctggcgttcgtgctggcgaagatggagatcacggggttttacgtgaatcgcgagaagctggtcgcatttgggcaggaattgacggagcgaatcaagcgaatcacgcaggagatctacgatctcgcgggcacttcgttcaacctcaactcgccgaagcagctcggcgagatcctgttcgacaagctcggcttgcctgcgctgaagaagacgaagaccggctattccacgagcgctgacgtgctcgaaaagctggcgcccatgcacgagatcgtgcagaagatcctcgattatcgtctgctggcgaagctgcagtcgacgtacgtcgagggcctactgaaagtcatccgcaaggagaccggccgggtgcacacccggtttcatcagacgctcacggcgaccggcaggctctcaagcagcgagcccaatctgcagaatatccccattcggctcgaggaggggcggaggctgcgccaggtgttcgagccgacctacaaggactgggtgattttcgccgccgactattcgcagatcgagttgcgcatcctggcccacctgtcgggcgacgaggcgctcatcgacgcgttccgccgcgacatggacatccacacgcggacggcggcggacgtgtttgaggtgccgcctgagcaggtgacgagcctgatgcgccgccaggcgaaggccgtgaacttcggcatcgtgtacgggatcagcgatttcggactcgcgcagaacttgaacatcccgcagaaagaggcgaaacggttcatcgagagttatttcgagaagtttcccggcgtcaagcgatacatggacgagatcgtcaagcaggcgcgcgagcgcggctatgtcacgacactgatgaaccgacggcggtatctgccggacatccacagccgcaattatcagctccgaagcttcgccgagcgcaccgcgatgaacacgcccatccagggaagcgccgcggatctgatcaagctcgcgatggtgcggatcgatcgcgccatgcgcgacgcgcagatggacgcgcgcatgttgctccaggtgcacgacgagctgatctttgagtgtccgaaggacgaactggccgcgctcgaagtgcttgtccgagacaacatggaaaacgccatgaccttgtctgtgccgctcaaggtggataccgcctacggcccgacgtggtacgacgccaagtga

SEQ ID NO: 1561 - DNA, 2925 bp, Artificial
  Alicyclobacillus acidocaldarius mutated SEQ ID NO 1549
gtgaacttccatccgcggcacggaccagttcgcaccttccactggctctctgcaccgccccggcggacgtactctctccttcatggccttcgctcgatgaattttgtgaacatcataatcaattcgttgaagtgtgtcaactcggcgtgcgtcccgctgggtgtgaggccgttttcgtgccgccacaagacgacgcgggccgacaaggggaatgtgatagaatggagcgggacaacagtgcgccaaacggcgcgaagtctggggtggcctatgccagcgtcgaaactcgtgttgattgatggaaatagcatcttgtatcgagcgttcttcgcgctgccgccgctcactgcgagggacggcacgcccacgaacgccgtgtacggctttacgacgatgatcttgcggctgatgtcggacgaaaagccgacgcatctggccgtcgcgtttgataaatcgaagacgacgtttcgccatgcggatttcgcggcgtacaaaggcacgcgccaggagacgcccgacgagctcgtgcaacagtttccgctcgcgcgccgcaccctggaggcgctgtccatcccgatggtcgagatcgaccaatacgaggccgacgacgtgatcggaacgctcgccaagcgagcggcggaggctggctttgacgtccgcgtggtctcgggtgacaaggacctgttgcagctggtcgacgatcggatccacgtgctcctgacgcgcaagggcatcaccgagatggagcactttgacgagcaggccgttgcccgccggtatccggggctcaagcccgcgcaggtgatcgatctcaagggcctcatgggcgatccgtccgacaacattccgggcgtgcctggggtgggcgaaaagacggcgctcaaactgctcgcgtcctttggcacggtcgagggcgtgtacgatcacctcgacgaagtccagggccagaagctgcgggagcgcctcgagcagcaccgggaggacgcgtttctctccaagcgcctcgccaccatcgcgtgcgacgcgcccatcgaggtggatctcgagacgctgcgatacgaagggccggatcccgcccgcgccatcgcctggttccgcgagctcgacttccgatccctcgtcgacaaaatttccgaggaaatgagccacgattcgacgccgaccccttcgccggcggccgcgagcggcgcgtcgagcgagtggagttcctttgcgtacggcctgattgaggacgcgggcgcctggcaggaggccatctcgtcgttcagcgaaccggtcggcgtcatgatggacttggcggatccggactatcaccgggcggagatccgcggcatggccgtcgcgacgccgaagcgcgcgtactacgttcgcttcggcgagcgactggagttgagcgacgtccggccatggctcgtgtcggatcggccgaaggtggcgttcgacctgaagtcgatggcgttcgcgctggacgcgcacggcatcggattgacgtcggagtgcggctggcaggacgtgaagctggctgcgtacctgctcaacccgcaggacggcgaggtcgaactgtccgatgtgttcgcccgcgagcgcggccaggaactgcccgcctgggaggagggcgagcgggagaagtggctcgcctacacggcgtctcagctgcctccgctcttcgagtccctggcgtacacgattcgcatgcaggagatggagcggctgtaccaagaggtggagcttcctctggcgttcgtgctggcgaagatggagatcacggggttttacgtgaatcgcgagaagctggtcgcatttgggcaggaattgacggagcgaatcaagcgaatcacgcaggagatctacgatctcgcgggcacttcgttcaacctcaactcgccgaagcagctcggcgagatcctgttcgacaagctcggcttgcctgcgctgaagaagacgaagaccggctattccacgagcgctgacgtgctcgaaaagctggcgcccatgcacgagatcgtgcagaagatcctcgattatcgtctgctggcgaagctgcagtcgacgtacgtcgagggcctactgaaagtcatccgcaaggagaccggccgggtgcacacccggtttcatcagacgctcacggcgaccggcaggctctcaagcagcgagcccaatctgcagaatatccccattcggctcgaggaggggcggaggctgcgccaggtgttcgagccgacctacaaggactgggtgattttcgccgccgactattcgcagatcgagttgcgcatcctggcccacctgtcgggcgacgaggcgctcatcgacgcgttccgccgcgacatggacatccacacgcggacggcggcggacgtgtttgaggtgccgcctgagcaggtgacgagcctgatgcgccgccaggcgaaggccgtgaacttcggcatcgtgtacgggatcagcgatttcggactcgcgcagaacttgaacatcccgcagaaagaggcgaaacggttcatcgagagttatttcgagaagtttcccggcgtcaagcgatacatggacgagatcgtcaagcaggcgcgcgagcgcggctatgtcacgacactgatgaaccgacggcggtatctgccggacatccacagccgcaattatcagctccgaagcttcgccgagcgcaccgcgatgaacacgcccatccagggaagcgccgcggatctgatcaagctcgcgatggtgcggatcgatcgcgccatgcgcgacgcgcagatggacgcgcgcatgttgctccaggtgcacgacgagctgatctttgagtgtccgaaggacgaactggccgcgctcgaagtgcttgtcaaagacaacatggaaaacgccatgaccttgtctgtgccgctcaaggtggataccgcctacggcccgacgtggtacgacgccaagtga

SEQ ID NO: 1562 - DNA, 2925 bp, Artificial
  Alicyclobacillus acidocaldarius mutated SEQ ID NO 1549
gtgaacttccatccgcggcacggaccagttcgcaccttccactggctctctgcaccgccccggcggacgtactctctccttcatggccttcgctcgatgaattttgtgaacatcataatcaattcgttgaagtgtgtcaactcggcgtgcgtcccgctgggtgtgaggccgttttcgtgccgccacaagacgacgcgggccgacaaggggaatgtgatagaatggagcgggacaacagtgcgccaaacggcgcgaagtctggggtggcctatgccagcgtcgaaactcgtgttgattgatggaaatagcatcttgtatcgagcgttcttcgcgctgccgccgctcactgcgagggacggcacgcccacgaacgccgtgtacggctttacgacgatgatcttgcggctgatgtcggacgaaaagccgacgcatctggccgtcgcgtttgataaatcgaagacgacgtttcgccatgcggatttcgcggcgtacaaaggcacgcgccaggagacgcccgacgagctcgtgcaacagtttccgctcgcgcgccgcaccctggaggcgctgtccatcccgatggtcgagatcgaccaatacgaggccgacgacgtgatcggaacgctcgccaagcgagcggcggaggctggctttgacgtccgcgtggtctcgggtgacaaggacctgttgcagctggtcgacgaacggatccacgtgctcctgacgcgcaagggcatcaccgagatggagcactttgacgagcaggccgttgcccgccggtatccggggctcaagcccgcgcaggtgatcgatctcaagggcctcatgggcgatccgtccgacaacattccgggcgtgcctggggtgggcgaaaagacggcgctcaaactgctcgcgtcctttggcacggtcgagggcgtgtacgatcacctcgacgaagtccagggccagaagctgcgggagcgcctcgagcagcaccgggaggacgcgtttctctccaagcgcctcgccaccatcgcgtgcgacgcgcccatcgaggtggatctcgagacgctgcgatacgaagggccggatcccgcccgcgccatcgcctggttccgcgagctcgacttccgatccctcgtcgacaaaatttccgaggaaatgagccacgattcgacgccgaccccttcgccggcggccgcgagcggcgcgtcgagcgagtggagttcctttgcgtacggcctgattgaggacgcgggcgcctggcaggaggccatctcgtcgttcagcgaaccggtcggcgtcatgatggacttggcggatccggactatcaccgggcggagatccgcggcatggccgtcgcgacgccgaagcgcgcgtactacgttcgcttcggcgagcgactggagttgagcgacgtccggccatggctcgtgtcggatcggccgaaggtggcgttcgacctgaagtcgatggcgttcgcgctggacgcgcacggcatcggattgacgtcggagtgcggctggcaggacgtgaagctggctgcgtacctgctcaacccgcaggacggcgaggtcgaactgtccgatgtgttcgcccgcgagcgcggccaggaactgcccgcctgggaggagggcgagcgggagaagtggctcgcctacacggcgtctcagctgcctccgctcttcgagtccctggcgtacacgattcgcatgcaggagatggagcggctgtaccaagaggtggagcttcctctggcgttcgtgctggcgaagatggagatcacggggttttacgtgaatcgcgagaagctggtcgcatttgggcaggaattgacggagcgaatcaagcgaatcacgcaggagatctacgatctcgcgggcacttcgttcaacctcaactcgccgaagcagctcggcgagatcctgttcgacaagctcggcttgcctgcgctgaagaagacgaagaccggctattccacgagcgctgacgtgctcgaaaagctggcgcccatgcacgagatcgtgcagaagatcctcgattatcgtctgctggcgaagctgcagtcgacgtacgtcgagggcctactgaaagtcatccgcaaggagaccggccgggtgcacacccggtttcatcagacgctcacggcgaccggcaggctctcaagcagcgagcccaatctgcagaatatccccattcggctcgaggaggggcggaggctgcgccaggtgttcgagccgacctacaaggactgggtgattttcgccgccgactattcgcagatcgagttgcgcatcctggcccacctgtcgggcgacgaggcgctcatcgacgcgttccgccgcgacatggacatccacacgcggacggcggcggacgtgtttgaggtgccgcctgagcaggtgacgagcctgatgcgccgccaggcgaaggccgtgaacttcggcatcgtgtacgggatcagcgatttcggactcgcgcagaacttgaacatcccgcagaaagaggcgaaacggttcatcgagagttatttcgagaagtttcccggcgtcaagcgatacatggacgagatcgtcaagcaggcgcgcgagcgcggctatgtcacgacactgatgaaccgacggcggtatctgccggacatccacagccgcaattatcagctccgaagcttcgccgagcgcaccgcgatgaacacgcccatccagggaagcgccgcggatctgatcaagctcgcgatggtgcggatcgatcgcgccatgcgcgacgcgcagatggacgcgcgcatgttgctccaggtgcacgacgagctgatctttgagtgtccgaaggacgaactggccgcgctcgaagtgcttgtccgagacaacatggaaaacgccatgaccttgtctgtgccgctcaaggtggataccgcctacggcccgacgtggtacgacgccaagtga

SEQ ID NO: 1563 - DNA, 2925 bp, Artificial
  Alicyclobacillus acidocaldarius mutated SEQ ID NO 1549
gtgaacttccatccgcggcacggaccagttcgcaccttccactggctctctgcaccgccccggcggacgtactctctccttcatggccttcgctcgatgaattttgtgaacatcataatcaattcgttgaagtgtgtcaactcggcgtgcgtcccgctgggtattaggccgttttcgtgccgccacaagacgacgcgggccgacaaggggaatgtgatagaatggagcgggacaacagtgcgccaaacggcgcgaagtctggggtggcctatgccagcgtcgaaactcgtgttgattgatggaaatagcatcttgtatcgagcgttcttcgcgctgccgccgctcactgcgagggacggcacgcccacgaacgccgtgtacggctttacgacgatgatcttgcggctgatgtcggacgaaaagccgacgcatctggccgtcgcgtttgataaatcgaagacgacgtttcgccatgcggatttcgcggcgtacaaaggcacgcgccaggagacgcccgacgagctcgtgcaacagtttccgctcgcgcgccgcaccctggaggcgctgtccatcccgatggtcgagatcgaccaatacgaggccgacgacgtgatcggaacgctcgccaagcgagcggcggaggctggctttgacgtccgcgtggtctcgggtgacaaggacctgttgcagctggtcgacgatcggatccacgtgctcctgacgcgcaagggcatcaccgagatggagcactttgacgagcaggccgttgcccgccggtatccggggctcaagcccgcgcaggtgatcgatctcaagggcctcatgggcgatccgtccgacaacattccgggcgtgcctggggtgggcgaaaagacggcgctcaaactgctcgcgtcctttggcacggtcgagggcgtgtacgatcacctcgacgaagtccagggccagaagctgcgggagcgcctcgagcagcaccgggaggacgcgtttctctccaagcgcctcgccaccatcgcgtgcgacgcgcccatcgaggtggatctcgagacgctgcgatacgaagggccggatcccgcccgcgccatcgcctggttccgcgagctcgacttccgatccctcgtcgacaaaatttccgaggaaatgagccacgattcgacgccgaccccttcgccggcggccgcgagcggcgcgtcgagcgagtggagttcctttgcgtacggcctgattgaggacgcgggcgcctggcaggaggccatctcgtcgttcagcgaaccggtcggcgtcatgatggacttggcggatccggactatcaccgggcggagatccgcggcatggccgtcgcgacgccgaagcgcgcgtactacgttcgcttcggcgagcgactggagttgagcgacgtccggccatggctcgtgtcggatcggccgaaggtggcgttcgacctgaagtcgatggcgttcgcgctggacgcgcacggcatcggattgacgtcggagtgcggctggcaggacgtgaagctggctgcgtacctgctcaacccgcaggacggcgaggtcgaactgtccgatgtgttcgcccgcgagcgcggccaggaactgcccgcctgggaggagggcgagcgggagaagtggctcgcctacacggcgtctcagctgcctccgctcttcgagtccctggcgtacacgattcgcatgcaggagatggagcggctgtaccaagaggtggagcttcctctggcgttcgtgctggcgaagatggagatcacggggttttacgtgaatcgcgagaagctggtcgcatttgggcaggaattgacggagcgaatcaagcgaatcacgcaggagatctacgatctcgcgggcacttcgttcaacctcaactcgccgaagcagctcggcgagatcctgttcgacaagctcggcttgcctgcgctgaagaagacgaagaccggctattccacgagcgctgacgtgctcgaaaagctggcgcccatgcacgagatcgtgcagaagatcctcgattatcgtctgctggcgaagctgcagtcgacgtacgtcgagggcctactgaaagtcatccgcaaggagaccggccgggtgcacacccggtttcatcagacgctcacggcgaccggcaggctctcaagcagcgagcccaatctgcagaatatccccattcggctcgaggaggggcggaggctgcgccaggtgttcgagccgacctacaaggactgggtgattttcgccgccgactattcgcagatcgagttgcgcatcctggcccacctgtcgggcgacgaggcgctcatcgacgcgttccgccgcgacatggacatccacacgcggacggcggcggacgtgtttgaggtgccgcctgagcaggtgacgagcctgatgcgccgccaggcgaaggccgtgaacttcggcatcgtgtacgggatcagcgatttcggactcgcgcagaacttgaacatcccgcagaaagaggcgaaacggttcatcgagagttatttcgagaagtttcccggcgtcaagcgatacatggacgagatcgtcaagcaggcgcgcgagcgcggctatgtcacgacactgatgaaccgacggcggtatctgccggacatccacagccgcaattatcagctccgaagcttcgccgagcgcaccgcgatgaacacgcccatccagggaagcgccgcggatctgatcaagctcgcgatggtgcggatcgatcgcgccatgcgcgacgcgcagatggacgcgcgcatgttgctccaggtgcacgacgagctgatctttgagtgtccgaaggacgaactggccgcgctcgaagtgcttgtccgagacaacatggaaaacgccatgaccttgtctgtgccgctcaaggtggataccgcctacggcccgacgtggtacgacgccaagtga

SEQ ID NO: 1564 - DNA, 2925 bp, Artificial
  Alicyclobacillus acidocaldarius mutated SEQ ID NO 1549
gtgaacttccatccgcggcacggaccagttcgcaccttccactggctctctgcaccgccccggcggacgtactctctccttcatggccttcgctcgatgaattttgtgaacatcataatcaattcgttgaagtgtgtcaactcggcgtgcgtcccgctgggtgtgaggccgttttcgtgccgccacaagacgacgcgggccgacaaggggaatgtgatagaatggagcgggacaacagtgcgccaaacggcgcgaagtctggggtggcctatgccagcgtcgaaactcgtgttgattgatggaaatagcatcttgtatcgagcgttcttcgcgctgccgccgctcactgcgagggacggcacgcccacgaacgccgtgtacggctttacgacgatgatcttgcggctgatgtcggacgaaaagccgacgcatctggccgtcgcgtttgataaatcgaagacgacgtttcgccatgcggatttcgcggcgtacaaaggcacgcgccaggagacgcccgacgagctcgtgcaacagtttccgctcgcgcgccgcaccctggaggcgctgtccatcccgatggtcgagatcgaccaatacgaggccgacgacgtgatcggaacgctcgccaagcgagcggcggaggctggctttgacgtccgcgtggtctcgggtgacaaggacctgttgcagctggtcgacgatcggatccacgtgctcctgacgcgcaagggcatcaccgagatggagcactttgacgagcaggccgttgcccgccggtatccggggctcaagcccgcgcaggtgatcgatctcaagggcctcatgggcgatccgtccgacaacattccgggcgtgcctggggtgggcgaaaagacggcgctcaaactgctcgcgtcctttggcacggtcgagggcgtgtacgatcacctcgacgaagtccagggccagaagctgcgggagcgcctcgagcagcaccgggaggacgcgtttctctccaagcgcctcgccaccatcgcgtgcgacgcgcccatcgaggtggatctcgagacgctgcgatacgaagggccggatcccgcccgcgccatcgcctggttccgcgagctcgacttccgatccctcgtcgacaaaatttccgaggaaatgagccacgattcgacgccgaccccttcgccggcggccgcgagcggcgcgtcgagcgagtggagttcctttgcgtacggcctgattgaggacgcgggcgcctggcaggaggccatctcgtcgttcagcgaaccggtcggcgtcatgatggacttggcggatccggactatcaccgggcggagatccgcggcatggccgtcgcgacgccgaagcgcgcgtactacgttcgcttcggcgagcgactggagttgagcgacgtccggccatggctcgtgtcggatcggccgaaggtggcgttcgacctgaagtcgatggcgttcgcgctggacgcgcacggcatcggattgacgtcggattgcggctggcaggacgtgaagctggctgcgtacctgctcaacccgcaggacggcgaggtcgaactgtccgatgtgttcgcccgcgagcgcggccaggaactgcccgcctgggaggagggcgagcgggagaagtggctcgcctacacggcgtctcagctgcctccgctcttcgagtccctggcgtacacgattcgcatgcaggagatggagcggctgtaccaagaggtggagcttcctctggcgttcgtgctggcgaagatggagatcacggggttttacgtgaatcgcgagaagctggtcgcatttgggcaggaattgacggagcgaatcaagcgaatcacgcaggagatctacgatctcgcgggcacttcgttcaacctcaactcgccgaagcagctcggcgagatcctgttcgacaagctcggcttgcctgcgctgaagaagacgaagaccggctattccacgagcgctgacgtgctcgaaaagctggcgcccatgcacgagatcgtgcagaagatcctcgattatcgtctgctggcgaagctgcagtcgacgtacgtcgagggcctactgaaagtcatccgcaaggagaccggccgggtgcacacccggtttcatcagacgctcacggcgaccggcaggctctcaagcagcgagcccaatctgcagaatatccccattcggctcgaggaggggcggaggctgcgccaggtgttcgagccgacctacaaggactgggtgattttcgccgccgactattcgcagatcgagttgcgcatcctggcccacctgtcgggcgacgaggcgctcatcgacgcgttccgccgcgacatggacatccacacgcggacggcggcggacgtgtttgaggtgccgcctgagcaggtgacgagcctgatgcgccgccaggcgaaggccgtgaacttcggcatcgtgtacgggatcagcgatttcggactcgcgcagaacttgaacatcccgcagaaagaggcgaaacggttcatcgagagttatttcgagaagtttcccggcgtcaagcgatacatggacgagatcgtcaagcaggcgcgcgagcgcggctatgtcacgacactgatgaaccgacggcggtatctgccggacatccacagccgcaattatcagctccgaagcttcgccgagcgcaccgcgatgaacacgcccatccagggaagcgccgcggatctgatcaagctcgcgatggtgcggatcgatcgcgccatgcgcgacgcgcagatggacgcgcgcatgttgctccaggtgcacgacgagctgatctttgagtgtccgaaggacgaactggccgcgctcgaagtgcttgtccgagacaacatggaaaacgccatgaccttgtctgtgccgctcaaggtggataccgcctacggcccgacgtggtacgacgccaagtga

SEQ ID NO: 1565 - protein, 383 aa, Alicyclobacillus acidocaldarius
MKIHRAYRYELAPNRMQRVMLAKHAGVARFAYNWGLARRIALHEEAGQSTNAIEQHRELNRLKKTDFPWMYEVSKCAPQEALRDLDRAFQHFFRGLNEGRKVGFPRFKKKGRDDSFRLTGSIRVLDNAVQLPRLGRIRLKEKPYVEGRILSATVKREADRWYVSLATETEIPDPVPPSGEPVGVDLGVSWFLTLSDGTKIKAPKPLRRYLRRLERLSKRHSRKKPGSRNRRKSALALARLHRKIRNIRQDFLHKVTTELAKTKRAIVMEDLHVRGMVQNRALARAISDMGFGEFRRMLTYKCAWYGSELIIAPRFYASSKTCSACGYVISELPLSVREWTCPACSTRHDRDINAAKNLLRIGTASSAGSDACGDPSGGAALGC

SEQ ID NO: 1566 - DNA, 1152 bp, Alicyclobacillus acidocaldarius
gtgaagattcatcgggcgtatcggtatgagttggcgccgaatcggatgcaacgggtcatgcttgcgaagcacgcaggtgtggcccgatttgcgtacaattgggggcttgcccgacgcatcgcgctccatgaagaggcggggcaaagcacgaacgccatcgaacagcaccgggaactcaaccgcctgaagaaaaccgacttcccgtggatgtacgaggtctccaagtgcgctccgcaggaagcgctgcgggacttggatcgcgcgtttcaacacttttttcgcgggttgaatgaggggcgcaaggtcggattccctcggttcaagaaaaaagggcgcgacgattcgtttcgcctgacgggttcgattcgcgttttggacaacgccgtacaactgcctcggctcgggcggattcggctgaaagagaaaccgtatgtcgaaggccgaatcttgtcggcgacggtgaagcgggaggcggaccgatggtatgtgagtttggcgacagaaacggagatccccgaccctgtgccgccttcgggcgagcctgtgggtgtagatttaggggtttcgtggtttctcacgttgtccgacgggacgaaaatcaaggcgccaaagccgttgcgccgataccttcgccgcttagagcggttgtcgaagcggcatagccgaaagaaacccggctctcgaaatcggcggaagtcggcgttggcgcttgctcgtctgcaccggaagatccgcaacatacggcaggactttttgcacaaggtgacgacggagctcgcgaaaaccaagcgagcgatcgtcatggaagacctgcatgtgcgaggcatggtgcagaatcgagcgttggcgcgagccatttcggacatgggttttggcgagtttcggcgaatgctgacgtacaagtgcgcgtggtatggttcggaactcatcatcgcgcctcggttttacgcgagcagcaagacgtgctcggcgtgcgggtacgtgataagcgagttgccattgtcggtgcgggagtggacgtgcccggcgtgcagcacgcggcatgaccgcgacatcaacgcagcgaaaaatcttttgagaatcggtaccgcgagttccgcgggaagtgacgcctgtggagatccctctggcggggcggccttgggctgctag

SEQ ID NO: 1567 - protein, 358 aa, Heliobacterium modesticaldum
MKINRAYRYELKPNVAQRILLAQHAGTARFAYNWGLARRITLYEAEKKSTNAIAQHRELNQLKQTEFPWMYEVSKCAPQEALRDLDKAFKNFFRGLKLGQKVGFPRFKKKGQDDSFRLTGAIKVNGKAVQLPRLGVIRLKEEPWIRGRILSATVSREADRWFVSLACEVEIPDPAPVLGPIVGIDVGLNHFAVLSDGTKVEAPKPLDKFLKRLRRLSKKHSRKQKGSTNRKKSALALARLHRRIRNIRQDFLHKLTTNLAKTKSEIVMEDLNVRGMMRNGSLARHIADVGWGEFRRQLGYKTAWYGSKLTLVHRFYPSSKTCSACGYVREELPLSVREWDCPSCGVHHDRDHNAAKNL

SEQ ID NO: 1568 - protein, 374 aa, Xylella fastidiosa
AHRIALDPNNVQATHLSRVAGVARFAYNWALAEWRHQYEACTLDSALPKPSQHSLRRQLNAIKREQFPWMGEVTKNAPQMAIIQLGQAFQNFFAGRAKYPKFRKKGAHDRFTLTNDQFDLDASRIRIPRLGWVRMRETLRFAGRIMSATVSRVAARWFVSITVDVPDPSHLPQAENQGVVGVDLGVLALATLSTGETICGPRPHRALLGRVRRLSRSVSRKVKDSANRHKAKATLAHLHARIAAIRLDALHKLTSDLTRRFHTIGIENLNVKGMVKNRHLARSIADMGFFEFRRQLEYKAAMRGGQVVVADRFFASSKMCSTCGHTLKELPLSVRQWACLGCGTRHDRDVNAAVNLKNMAVSSTVSACGEEGTG

SEQ ID NO: 1569 - protein, 359 aa, Synechococcus  JA-3-3Ab
NNRQKTLAAQHAGVARHAYNWGLAICKQAVESKQKLPTAIDLHKRLVAEVKKENPWYYQVSKCAPQQALRNLEQAFKRWRSGLGKFPRFKRKGVRDSFYLEGSIRISGDRIKVPILGWLRCAELLPTATPKNVVISLRAGHWYVSFKYEAPAPQVEKTGEVVGVDLGINRLATCSDGEVFENPKPYYKAKKRLARLQRRLSRKQKGSANRKKAVAQLAKAHKRVADIRQDNLHKLTTYLAKKYRVVVIEDLQVKNLLKNHKLAGALSDCGFYEFRRQLEYKARLYGCQVVVADRFYPSSQLCSRCGHRQKMPLQERMFCCPCCGLELDRDLNAALNLLRWYRTTSSSGGSDACGDPSGG

SEQ ID NO: 1570 - protein, 374 aa, Xylella fastidiosa
AHRIALDPNNVQATHLSRVAGVARFAYNWALAEWRHQYEACTLDSALPKPSQHSLRRQLNAIKREQFPWMGEVTKNAPQMAIIQLGQAFQNFFTGRAKYPKFRKKGAHDRFTLTNDQFDLNASRIRIPRLGWVRMRETLRFAGRIMSATVSRVAARWFVSITVDVPDPSHLPQAENQGAVGVDLGVLALATLSTGETICGPRPHRALLGRVRRLSRSVSRKVKDSANRHKAKATLAHLHARIAAIRLDALHKLTSDLTRRFHTIGIENLNVKGMVKNRHLARSIADMGFFEFRRQLEYKAAMRGGQVVVADRFFASSKMCSTCGHTLKELPLSVRQWACLGCGTRHDRDVNAAVNLKNMAVSSTVSACGEEGTG

SEQ ID NO: 1571 - protein, 359 aa, Synechococcus  JA-3-3Ab
NNRQKTLAAQHAGVARHAYNWGLAICKQAVESKQKLPTAIDLHKRLVAEVKKENPWYYQVSKCAPQQALRNLEQAFKRWRSGLGKFPRFKRKGVRDSFYLEGSIRISGDRIKVPILGWLRCAELLPTATPKNVVISLRAGHWYVSFKYEAPAPQVEKTGEVVGVDLGINRLATCSDGEVFENPKPYYKAKKRLARLQRRLSRKQKGSANRKKAVAQLAKAHKRVAGIRQDNLHKLTTYLAKKYRVVVIEDLQVKNLLKNHKLAGALSDCGFYEFRRQLEYKARLYGCQVVVADRFYPSSQLCSRCGHRQKMPLQERMFCCPCCGLELDRDLNAALNLLRWYRTTSSSGGSDACGDPSGG

SEQ ID NO: 1572 - protein, 383 aa, Artificial
  Alicyclobacillus acidocaldarius mutated SEQ ID NO 1565
MKIHRAYRYELAPNRMQRVMLAKHAGVARFAYNWGLARRIALHEEAGQSTNAIEQHRELNRLKKTDFPWMYEVSKCAPQEALRDLDRAFQHFFRGLNEGRKVGFPRFKKKGRDDSFRLTGSIRVLDNAVQLPRLGRIRLKEKPYVEGRILSATVKREADRWYVSLATETEIPDPVPPSGEPVGVDLGVSWFLTLSDGTKIKAPKPLRRYLRRLERLSKRHSRKKPGSRNRRKSALALARLHRKIKNIRQDFLHKVTTELAKTKRAIVMEDLHVRGMVQNRALARAISDMGFGEFRRMLTYKCAWYGSELIIAPRFYASSKTCSACGYVISELPLSVREWTCPACSTRHDRDINAAKNLLRIGTASSAGSDACGDPSGGAALGC

SEQ ID NO: 1573 - protein, 383 aa, Artificial
  Alicyclobacillus acidocaldarius mutated SEQ ID NO 1565
MKIHRAYRYELAPNRMQRVMLAKHAGVARFAYNWGLARRIALHEEAGQSTNAIEQHRELNRLKKTDFPWMYEVSKCAPQEALRDLDRAFQHFFRGLNEGRKVGFPRFKKKGRDDSFRLTGSIRVLDNAVQLPRLGRIRLKEKPYVEGKILSATVKREADRWYVSLATETEIPDPVPPSGEPVGVDLGVSWFLTLSDGTKIKAPKPLRRYLRRLERLSKRHSRKKPGSRNRRKSALALARLHRKIRNIRQDFLHKVTTELAKTKRAIVMEDLHVRGMVQNRALARAISDMGFGEFRRMLTYKCAWYGSELIIAPRFYASSKTCSACGYVISELPLSVREWTCPACSTRHDRDINAAKNLLRIGTASSAGSDACGDPSGGAALGC

SEQ ID NO: 1574 - protein, 383 aa, Artificial
  Alicyclobacillus acidocaldarius mutated SEQ ID NO 1565
MKIHRAYRYELAPNRMQRVMLAKHAGVARFAYNWGLARRIALHEEAGQSTNAIEQHRELNRLKKTDFPWMYEVSKCAPQEALRDLDRAFQHFFRGLNEGRKVGFPRFKKKGRDDSFRLTGSIRVLDNAVQLPRLGRIRLKEKPYVEGRILSATVKREADRWYVSLATETEIPDPVPPSGEPVGVDLGVSWFLTLSDGTKIKAPKPLRRYIRRLERLSKRHSRKKPGSRNRRKSALALARLHRKIRNIRQDFLHKVTTELAKTKRAIVMEDLHVRGMVQNRALARAISDMGFGEFRRMLTYKCAWYGSELIIAPRFYASSKTCSACGYVISELPLSVREWTCPACSTRHDRDINAAKNLLRIGTASSAGSDACGDPSGGAALGC

SEQ ID NO: 1575 - protein, 383 aa, Artificial
  Alicyclobacillus acidocaldarius mutated SEQ ID NO 1565
MKIHRAYRYELAPNRMQRVMLAKHAGVARFAYNWGLARRIALHEEAGQSTNAIEQHRELNRLKKTDFPWMYEVSKCAPQEALRDLDRAFQHFFRGLNEGRKVGFPRFKKKGRDDSFRLTGSIRVLDNAVQLPRLGRIRLKEKPYVEGRILSATVKREADRWYVSLATETEIPDPVPPSGEPVGVDLGVSWFLTLSDGTKIKAPKPLRRYLRRLERLSKRHSRKKPGSRNRRKSALALARLHRKIRNIRQDFLHKVTTDLAKTKRAIVMEDLHVRGMVQNRALARAISDMGFGEFRRMLTYKCAWYGSELIIAPRFYASSKTCSACGYVISELPLSVREWTCPACSTRHDRDINAAKNLLRIGTASSAGSDACGDPSGGAALGC

SEQ ID NO: 1576 - protein, 383 aa, Artificial
  Alicyclobacillus acidocaldarius mutated SEQ ID NO 1565
MKIHRAYRYELAPNRMQRVMLAKHAGVARFAYNWGLARRIALHEEAGQSTNAIENHRELNRLKKTDFPWMYEVSKCAPQEALRDLDRAFQHFFRGLNEGRKVGFPRFKKKGRDDSFRLTGSIRVLDNAVQLPRLGRIRLKEKPYVEGRILSATVKREADRWYVSLATETEIPDPVPPSGEPVGVDLGVSWFLTLSDGTKIKAPKPLRRYLRRLERLSKRHSRKKPGSRNRRKSALALARLHRKIRNIRQDFLHKVTTELAKTKRAIVMEDLHVRGMVQNRALARAISDMGFGEFRRMLTYKCAWYGSELIIAPRFYASSKTCSACGYVISELPLSVREWTCPACSTRHDRDINAAKNLLRIGTASSAGSDACGDPSGGAALGC

SEQ ID NO: 1577 - DNA, 1152 bp, Artificial
  Alicyclobacillus acidocaldarius mutated SEQ ID NO 1566
gtgaagattcatcgggcgtatcggtatgagttggcgccgaatcggatgcaacgggtcatgcttgcgaagcacgcaggtgtggcccgatttgcgtacaattgggggcttgcccgacgcatcgcgctccatgaagaggcggggcaaagcacgaacgccatcgaacagcaccgggaactcaaccgcctgaagaaaaccgacttcccgtggatgtacgaggtctccaagtgcgctccgcaggaagcgctgcgggacttggatcgcgcgtttcaacacttttttcgcgggttgaatgaggggcgcaaggtcggattccctcggttcaagaaaaaagggcgcgacgattcgtttcgcctgacgggttcgattcgcgttttggacaacgccgtacaactgcctcggctcgggcggattcggctgaaagagaaaccgtatgtcgaaggccgaatcttgtcggcgacggtgaagcgggaggcggaccgatggtatgtgagtttggcgacagaaacggagatccccgaccctgtgccgccttcgggcgagcctgtgggtgtagatttaggggtttcgtggtttctcacgttgtccgacgggacgaaaatcaaggcgccaaagccgttgcgccgataccttcgccgcttagagcggttgtcgaagcggcatagccgaaagaaacccggctctcgaaatcggcggaagtcggcgttggcgcttgctcgtctgcaccggaagatcaaaaacatacggcaggactttttgcacaaggtgacgacggagctcgcgaaaaccaagcgagcgatcgtcatggaagacctgcatgtgcgaggcatggtgcagaatcgagcgttggcgcgagccatttcggacatgggttttggcgagtttcggcgaatgctgacgtacaagtgcgcgtggtatggttcggaactcatcatcgcgcctcggttttacgcgagcagcaagacgtgctcggcgtgcgggtacgtgataagcgagttgccattgtcggtgcgggagtggacgtgcccggcgtgcagcacgcggcatgaccgcgacatcaacgcagcgaaaaatcttttgagaatcggtaccgcgagttccgcgggaagtgacgcctgtggagatccctctggcggggcggccttgggctgctag

SEQ ID NO: 1578 - DNA, 1152 bp, Artificial
  Alicyclobacillus acidocaldarius mutated SEQ ID NO 1566
gtgaagattcatcgggcgtatcggtatgagttggcgccgaatcggatgcaacgggtcatgcttgcgaagcacgcaggtgtggcccgatttgcgtacaattgggggcttgcccgacgcatcgcgctccatgaagaggcggggcaaagcacgaacgccatcgaacagcaccgggaactcaaccgcctgaagaaaaccgacttcccgtggatgtacgaggtctccaagtgcgctccgcaggaagcgctgcgggacttggatcgcgcgtttcaacacttttttcgcgggttgaatgaggggcgcaaggtcggattccctcggttcaagaaaaaagggcgcgacgattcgtttcgcctgacgggttcgattcgcgttttggacaacgccgtacaactgcctcggctcgggcggattcggctgaaagagaaaccgtatgtcgaaggcaaaatcttgtcggcgacggtgaagcgggaggcggaccgatggtatgtgagtttggcgacagaaacggagatccccgaccctgtgccgccttcgggcgagcctgtgggtgtagatttaggggtttcgtggtttctcacgttgtccgacgggacgaaaatcaaggcgccaaagccgttgcgccgataccttcgccgcttagagcggttgtcgaagcggcatagccgaaagaaacccggctctcgaaatcggcggaagtcggcgttggcgcttgctcgtctgcaccggaagatccgcaacatacggcaggactttttgcacaaggtgacgacggagctcgcgaaaaccaagcgagcgatcgtcatggaagacctgcatgtgcgaggcatggtgcagaatcgagcgttggcgcgagccatttcggacatgggttttggcgagtttcggcgaatgctgacgtacaagtgcgcgtggtatggttcggaactcatcatcgcgcctcggttttacgcgagcagcaagacgtgctcggcgtgcgggtacgtgataagcgagttgccattgtcggtgcgggagtggacgtgcccggcgtgcagcacgcggcatgaccgcgacatcaacgcagcgaaaaatcttttgagaatcggtaccgcgagttccgcgggaagtgacgcctgtggagatccctctggcggggcggccttgggctgctag

SEQ ID NO: 1579 - DNA, 1152 bp, Artificial
  Alicyclobacillus acidocaldarius mutated SEQ ID NO 1566
gtgaagattcatcgggcgtatcggtatgagttggcgccgaatcggatgcaacgggtcatgcttgcgaagcacgcaggtgtggcccgatttgcgtacaattgggggcttgcccgacgcatcgcgctccatgaagaggcggggcaaagcacgaacgccatcgaacagcaccgggaactcaaccgcctgaagaaaaccgacttcccgtggatgtacgaggtctccaagtgcgctccgcaggaagcgctgcgggacttggatcgcgcgtttcaacacttttttcgcgggttgaatgaggggcgcaaggtcggattccctcggttcaagaaaaaagggcgcgacgattcgtttcgcctgacgggttcgattcgcgttttggacaacgccgtacaactgcctcggctcgggcggattcggctgaaagagaaaccgtatgtcgaaggccgaatcttgtcggcgacggtgaagcgggaggcggaccgatggtatgtgagtttggcgacagaaacggagatccccgaccctgtgccgccttcgggcgagcctgtgggtgtagatttaggggtttcgtggtttctcacgttgtccgacgggacgaaaatcaaggcgccaaagccgttgcgccgatacattcgccgcttagagcggttgtcgaagcggcatagccgaaagaaacccggctctcgaaatcggcggaagtcggcgttggcgcttgctcgtctgcaccggaagatccgcaacatacggcaggactttttgcacaaggtgacgacggagctcgcgaaaaccaagcgagcgatcgtcatggaagacctgcatgtgcgaggcatggtgcagaatcgagcgttggcgcgagccatttcggacatgggttttggcgagtttcggcgaatgctgacgtacaagtgcgcgtggtatggttcggaactcatcatcgcgcctcggttttacgcgagcagcaagacgtgctcggcgtgcgggtacgtgataagcgagttgccattgtcggtgcgggagtggacgtgcccggcgtgcagcacgcggcatgaccgcgacatcaacgcagcgaaaaatcttttgagaatcggtaccgcgagttccgcgggaagtgacgcctgtggagatccctctggcggggcggccttgggctgctag

SEQ ID NO: 1580 - DNA, 1152 bp, Artificial
  Alicyclobacillus acidocaldarius mutated SEQ ID NO 1566
gtgaagattcatcgggcgtatcggtatgagttggcgccgaatcggatgcaacgggtcatgcttgcgaagcacgcaggtgtggcccgatttgcgtacaattgggggcttgcccgacgcatcgcgctccatgaagaggcggggcaaagcacgaacgccatcgaacagcaccgggaactcaaccgcctgaagaaaaccgacttcccgtggatgtacgaggtctccaagtgcgctccgcaggaagcgctgcgggacttggatcgcgcgtttcaacacttttttcgcgggttgaatgaggggcgcaaggtcggattccctcggttcaagaaaaaagggcgcgacgattcgtttcgcctgacgggttcgattcgcgttttggacaacgccgtacaactgcctcggctcgggcggattcggctgaaagagaaaccgtatgtcgaaggccgaatcttgtcggcgacggtgaagcgggaggcggaccgatggtatgtgagtttggcgacagaaacggagatccccgaccctgtgccgccttcgggcgagcctgtgggtgtagatttaggggtttcgtggtttctcacgttgtccgacgggacgaaaatcaaggcgccaaagccgttgcgccgataccttcgccgcttagagcggttgtcgaagcggcatagccgaaagaaacccggctctcgaaatcggcggaagtcggcgttggcgcttgctcgtctgcaccggaagatccgcaacatacggcaggactttttgcacaaggtgacgacggatctcgcgaaaaccaagcgagcgatcgtcatggaagacctgcatgtgcgaggcatggtgcagaatcgagcgttggcgcgagccatttcggacatgggttttggcgagtttcggcgaatgctgacgtacaagtgcgcgtggtatggttcggaactcatcatcgcgcctcggttttacgcgagcagcaagacgtgctcggcgtgcgggtacgtgataagcgagttgccattgtcggtgcgggagtggacgtgcccggcgtgcagcacgcggcatgaccgcgacatcaacgcagcgaaaaatcttttgagaatcggtaccgcgagttccgcgggaagtgacgcctgtggagatccctctggcggggcggccttgggctgctag

SEQ ID NO: 1581 - DNA, 1152 bp, Artificial
  Alicyclobacillus acidocaldarius mutated SEQ ID NO 1566
gtgaagattcatcgggcgtatcggtatgagttggcgccgaatcggatgcaacgggtcatgcttgcgaagcacgcaggtgtggcccgatttgcgtacaattgggggcttgcccgacgcatcgcgctccatgaagaggcggggcaaagcacgaacgccatcgaaaatcaccgggaactcaaccgcctgaagaaaaccgacttcccgtggatgtacgaggtctccaagtgcgctccgcaggaagcgctgcgggacttggatcgcgcgtttcaacacttttttcgcgggttgaatgaggggcgcaaggtcggattccctcggttcaagaaaaaagggcgcgacgattcgtttcgcctgacgggttcgattcgcgttttggacaacgccgtacaactgcctcggctcgggcggattcggctgaaagagaaaccgtatgtcgaaggccgaatcttgtcggcgacggtgaagcgggaggcggaccgatggtatgtgagtttggcgacagaaacggagatccccgaccctgtgccgccttcgggcgagcctgtgggtgtagatttaggggtttcgtggtttctcacgttgtccgacgggacgaaaatcaaggcgccaaagccgttgcgccgataccttcgccgcttagagcggttgtcgaagcggcatagccgaaagaaacccggctctcgaaatcggcggaagtcggcgttggcgcttgctcgtctgcaccggaagatccgcaacatacggcaggactttttgcacaaggtgacgacggagctcgcgaaaaccaagcgagcgatcgtcatggaagacctgcatgtgcgaggcatggtgcagaatcgagcgttggcgcgagccatttcggacatgggttttggcgagtttcggcgaatgctgacgtacaagtgcgcgtggtatggttcggaactcatcatcgcgcctcggttttacgcgagcagcaagacgtgctcggcgtgcgggtacgtgataagcgagttgccattgtcggtgcgggagtggacgtgcccggcgtgcagcacgcggcatgaccgcgacatcaacgcagcgaaaaatcttttgagaatcggtaccgcgagttccgcgggaagtgacgcctgtggagatccctctggcggggcggccttgggctgctag

SEQ ID NO: 1582 - protein, 566 aa, Alicyclobacillus acidocaldarius
MREAFQLFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYTEAQKTA

SEQ ID NO: 1583 - DNA, 1701 bp, Alicyclobacillus acidocaldarius
gtgcgggaggctttccagttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1584 - protein, 542 aa, Bacillus coagulans
VGPSQLLSKLCDEIELEKTINDLVKWDSVRCHISPGTRIKALVLNILCSGKPLYKVHEFYQNLDSEMLFDTSVSPDQLNDDALGRALDYLYEAEAWKVYSTLALKTLKKLNLPIGILHNDTTSISVYGEYKQPKEDGLQITYGYSKAHRPDLKQIVLGMGVTPERIPILAKVENGNTSDKSWNVEFIQKMRKILSHEDWKNLIYQADSALITTENLAEIQQQNLSFISRLPDTFGLSTELKKEAWLLNNWERVGSLSNKKDAAIYQIQAFERQIQNLPYRFLVVHSNNLDQRKEKTLNRAIEKEEIQLKKEIEKLSKVIFHCKEDALEAIQSFKKKQKASYFCYKLNVQMSDQPIKRKKRGRPKKDEQTKREQIYQIQLESFEKDHDFIENKKKMLSTFVLITNKLDEETLSNQEVLRVYKGQSAAETRFRLIKDSQMIDAIYLKTPERVEALGIVYVMALLIYGILEYRVRKELKEKNLSLILKGKRKLYQPTGQALLEQLEDITVILINQNQQKIRLLPDNIDSQAKKIIELCGYDLSIY

SEQ ID NO: 1585 - protein, 542 aa, Bacillus coagulans
VGPSQLLSKLCDEIELEKTINNLVKWDSVRCHISPGTRIKALVLNILCSGKPLYKVHEFYQNLDSEMLFDTSISPDQLNDDALGRALDYLYKAEAWKVYSTLALKALKKLNLPIGVLHNDTTSISVYGEYKQPKEDGLQITYGYSKAHRPDLKQIVLGMGVTPERIPILAKVENGNTSDKSWNVEFIQKMRKILSHEDWKNLIYQADSALITTENLAEIQQQNLSFISRLPDTFGLSTELKKEAWLLNNWERVGSLSNKKDAAIYQIQAFERQIQNLPYRFLVVHSNNLDQRKEKTLNRAIEKEEIKLKKEIEKLSKVIFHCKEDALEAIQSFKKKQKASYFCYKLNVQMSDQPIKRKKRGRPKKDEQTKREQIYQIQLESFEKDHDFIENKKRMLSTFVLITNKLDEETLSNQEVLRVYKGQSAVETRFRLIKDSQMIDAIYLKTPERVEALGIVYVMALLIYGILEYRVRKELKEKNLSLILKGKRKLYQPTGQALLEQLEDITVILINQNRQKLRLLPDNIDSQAKKIIELCGYDLSIY

SEQ ID NO: 1586 - protein, 542 aa, Bacillus coagulans
VGPSQLLSKLCDEIELEKTINDLVKWDSVRCHISPGTRIKALVLNILCSGKPLYKVHEFYQNLDSEMLFDTSVSPDQLNDDALGRALDYLYEAEAWKVYSTLALKALKKLNLPIGILHNDTTSISVYGEYKQPKEDGLQITYGYSKAHRPDLKQIVLGMGVTPERIPILAKVENGNTSDKSWNVEFIQKMRKILSHEDWKNLIYQADSALITTENLAEIQQQNLSFISRLPDTFGLSTELKKEAWLLNNWERVGSLSNKKDAAIYQIQAFERQIQNLPYRFLVVHSNNLDQRKEKTLNRAIEKEEIQLKKEIEKLSKVIFHCKEDALEAIQSFKKKQKASYFCYKLNVQMSDQPIKRKKRGRPKKDEQTKREQIYQIQLESFEKDHDFIENKKKMLSTFVLITNKLDEETLSNQEVLRVYKGQSAAETRFRLIKDSQMIDAIYLKTPERVEALGIVYVMALLIYGILEYRVRKELKEKNLSLILKGKRKLSQPTGQALLEQLEDITVILINQNQQKIRLLPDNIDSQAKKIIELCGYDLSIY

SEQ ID NO: 1587 - protein, 538 aa, Bacillus coagulans
PQSCKLCDEIELEKTINNLVKWDSVRCHISPGTRIKALVLNILCSGKPLYKVHEFYQNLDSEMLFDTSISPDQLNDDALGRALDYLYKAEAWKVYSTLALKALKKLNLPIGVLHNDTTSISVYGEYKQPKEDGLQITYGYSKAHRPDLKQIVLGMGVTPERIPILAKVENGNTSDKSWNVEFIQKMRKILSHEDWKNLIYQADSALITTENLAEIQQQNLSFISRLPDTFGLSTELKKEAWLLNNWERVGSLSNKKDAAIYQIQAFERQIQNLPYRFLVVHSNNLDQRKEKTLNRAIEKEEIQLKKEIEKLSKVIFHCKEDALEAIQSFKKKQKASYFCYKLNVQMSDQPIKRKKRGRPKKDEQTKREQIYQIQLESFEKDHDFIENKKKMLSTFVLITNKLDEETLSNQEVLRVYKGQSAAETRFRLIKDSQMIDAIYLKTPERVEALGIVYVMALLIYGILEYRVRKELKEKNLSLILKGKRKLYQPTGQALLEQLEDITVILINQNRQKLRLLPDNIDSQAKKIIELCGYDLSIY

SEQ ID NO: 1588 - protein, 349 aa, Moorella thermoacetica
MRFFRAGPAALISRLCDVLKIAEIIDAVVDWDPAQCHLSPGNRVKALIINLLVDREALYHVERFYENQDLEVLFGAEQQVRPEDFNDDALGRALDKLFTSGQLKKLFSSIALTAAATHNVSIAGIHVDTTSISVQGAYDGEGDLDITFGFSKDHRPDLKQFLIGLTVNRDGLPILAQSLDGNSSDKSWYPQVIEELVQTFKPEKLKEVIFVADCALVTKDNLALLVQEEGNKPALQFISLLPENFGLNKEIKAEAFRTGTWQEIGKLSPKKDAACYKSQSFVREIDGRDYRLIVVHSTTLDKRKENSLLKKWAKQREVLEKAAKDLSRRPFACKADARKAIELFLREYR

SEQ ID NO: 1589 - protein, 566 aa, Artificial
  Alicyclobacillus acidocaldarius mutated SEQ ID NO 1582
MREAFQLFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDEPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYTEAQKTA

SEQ ID NO: 1590 - protein, 566 aa, Artificial
  Alicyclobacillus acidocaldarius mutated SEQ ID NO 1582
MREAFQLFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFKRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYTEAQKTA

SEQ ID NO: 1591 - protein, 566 aa, Artificial
  Alicyclobacillus acidocaldarius mutated SEQ ID NO 1582
MREAFQLFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSLYTEAQKTA

SEQ ID NO: 1592 - protein, 566 aa, Artificial
  Alicyclobacillus acidocaldarius mutated SEQ ID NO 1582
MREAFQLFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNIYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYTEAQKTA

SEQ ID NO: 1593 - protein, 566 aa, Artificial
  Alicyclobacillus acidocaldarius mutated SEQ ID NO 1582
MREAFQLFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWRDKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYTEAQKTA

SEQ ID NO: 1594 - DNA, 1701 bp, Artificial
  Alicyclobacillus acidocaldarius mutated SEQ ID NO 1583
gtgcgggaggctttccagttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgaaccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1595 - DNA, 1701 bp, Artificial
  Alicyclobacillus acidocaldarius mutated SEQ ID NO 1583
gtgcgggaggctttccagttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttcaaacgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1596 - DNA, 1701 bp, Artificial
  Alicyclobacillus acidocaldarius mutated SEQ ID NO 1583
gtgcgggaggctttccagttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcttatacacggaagcgcaaaaaacggcttga

SEQ ID NO: 1597 - DNA, 1701 bp, Artificial
  Alicyclobacillus acidocaldarius mutated SEQ ID NO 1583
gtgcgggaggctttccagttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacatttacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1598 - DNA, 1701 bp, Artificial
  Alicyclobacillus acidocaldarius mutated SEQ ID NO 1583
gtgcgggaggctttccagttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagataaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1599 - protein, 175 aa, Alicyclobacillus acidocaldarius
MLMDAGYDQTKNYEAARALGAQAIIPMNRRNEKEPPEGMDFDGTPRCTMGYRMTYWGAEGDWLKFRCPHATGQVDCPLGMAACSASNYGMVVKKRLDEDVRRYANPHRGSRTWKMLYDERTAVERCFARLKEWLTLDGVHVRGIEKVTAHAYINASVLLASALAMHRTNRIEQVA

SEQ ID NO: 1600 - DNA, 528 bp, Alicyclobacillus acidocaldarius
gtgttaatggatgcaggatacgaccagacgaaaaactatgaagccgctcgagcattaggtgctcaggctatcatcccgatgaatcgccggaatgagaaagagccgccggaagggatggatttcgacggcacgccccgctgcacgatggggtatcggatgacgtattggggcgcagagggcgactggctcaagtttcgctgtccgcacgcgacaggccaggtcgattgtccgcttggcatggctgcctgttccgcgtcgaattacggtatggtcgtgaagaagcgtctcgacgaggacgtccgtcgatacgcgaatccacatcgcggctctcgcacatggaagatgctttatgatgaacggaccgctgtagagcgctgttttgcacggctgaaagagtggctgacgcttgacggcgtgcatgtgcggggtatcgagaaggtcacagcgcatgcgtacatcaacgccagtgtactgttggcgtctgctctggcgatgcaccggacgaatcgtatcgagcaggtggcttaa

SEQ ID NO: 1601 - protein, 176 aa, Syntrophomonas wolfei
LMDAGYDQKSIYELIRKDYKAQAIIPLNHRGAKEPPEGLDWDATPICSAGYRMAYWGGSNGVNKFRCPHVMGKCDCPFGSSWCSDSNYGMVVKTRARQDSRLFIVPHRGTSNWKLLYNKRTSVERCFGRLKEHLGLETGLNVRGIKKVKTHAYLSVITMIASVIAINKDKSSTDIA

SEQ ID NO: 1602 - protein, 167 aa, Thermosinus carboxydivorans
MDMGYDAKDVYQAAYERQAQAIIPLNRRKEKLPPEGMDENRTPTCSMGYPMVYWGCEREKGILKFRCPHVCGKVNCPNGSAWCSPSNYGLVIKKKVEDDPRSFCTPHRGTREWEKLYAERTSVERAFSRLKEQLGANTVRVQGIKKVTAHLMLCCIALLAGTIAVNR

SEQ ID NO: 1603 - protein, 176 aa, Desulfotomaculum reducens
MDMGYDSKDIYSVVMNDFNAQAIIPINSRGSKDHPEGCDFDGTPICSMGQRMVFWGSDAKAGTNKYRCPHVMGKCDCPYGSAWCSPSSYGLVVKTKVKDDPRMNCIPARGTKNWQSLYNKRTSVERCFGRLKQHLGANSIRTRGLEKVTLHITLSCIALLAGSIAVAKTKRIEQAA

SEQ ID NO: 1604 - protein, 168 aa, Syntrophomonas wolfei
LMDAGYDHREIYSVIRDKYHAQAIIALNKRGAKQPPEGFDWDGTPICSARYRMVYWGSYQGVNKFRCPHIMGKCDCPFGSAWCSDSNYGMVVKTKVKDDPRLFSSPHRGSANWQKQYNLRTYSERCFSRFKENLGLEDGLNVRKITKVETHAYLCAITMIAAVIAINQ

SEQ ID NO: 1605 - protein, 168 aa, Syntrophomonas wolfei; identical to SEQ ID NO: 1604

SEQ ID NO: 1606 - protein, 175 aa, Artificial
  Alicyclobacillus acidocaldarius mutated SEQ ID NO 1599
MLMDAGYDQTKNYEAARALGAQAIIPMNRRNEKEPPEGMDFDGTPRCTMGYRMTYWGAEGDWLKFRCPHATGQVDCPLGMAACSASNYGMVVKKRLDEDVRRYANPHRGSRTWKMLYDERTAVERCFARLKEWLTLDGVHVRGIEKVTAHAYINASVLLASALAMHRTNRIDQVA

SEQ ID NO: 1607 - protein, 175 aa, Artificial
  Alicyclobacillus acidocaldarius mutated SEQ ID NO 1599
MLMDAGYDQTKNYEAARALGAQAIIPMNRRNEKEPPEGMDFDGTPRCTMGYRMTYWGAEGDWLKFRCPHATGQVDCPLGMAACSASNYGMVVKKRLDEDVRRYANPHRGSRTWKMLYDERTAIERCFARLKEWLTLDGVHVRGIEKVTAHAYINASVLLASALAMHRTNRIEQVA

SEQ ID NO: 1608 - protein, 175 aa, Artificial
  Alicyclobacillus acidocaldarius mutated SEQ ID NO 1599
MLMDAGYDQTKNYEAARALGAQAIIPMNRRNEKEPPEGMDFDGTPRCTMGYRMTYWGAEGDWLKFRCPHATGQVDCPLGMAACSASNYGMVVKKRLDEDVRRYANPHRGSRTWKMLYDERTAVERCFARLKEWLTLDGVHVRGIEKVTAHAYIQASVLLASALAMHRTNRIEQVA

SEQ ID NO: 1609 - protein, 175 aa, Artificial
  Alicyclobacillus acidocaldarius mutated SEQ ID NO 1599
MLMDAGYDQTKNYEAARALGAQAIIPMNRRNEKEPPEGMDFDGTPRCTMGYRMTYWGAEGDWLKFRCPHATGQVDCPLGMAACSASNYGMVVKKRLDEDIRRYANPHRGSRTWKMLYDERTAVERCFARLKEWLTLDGVHVRGIEKVTAHAYINASVLLASALAMHRTNRIEQVA

SEQ ID NO: 1610 - protein, 175 aa, Artificial
  Alicyclobacillus acidocaldarius mutated SEQ ID NO 1599
MIMDAGYDQTKNYEAARALGAQAIIPMNRRNEKEPPEGMDFDGTPRCTMGYRMTYWGAEGDWLKFRCPHATGQVDCPLGMAACSASNYGMVVKKRLDEDVRRYANPHRGSRTWKMLYDERTAVERCFARLKEWLTLDGVHVRGIEKVTAHAYINASVLLASALAMHRTNRIEQVA

SEQ ID NO: 1611 - DNA, 528 bp, Artificial
  Alicyclobacillus acidocaldarius mutated SEQ ID NO 1600
gtgttaatggatgcaggatacgaccagacgaaaaactatgaagccgctcgagcattaggtgctcaggctatcatcccgatgaatcgccggaatgagaaagagccgccggaagggatggatttcgacggcacgccccgctgcacgatggggtatcggatgacgtattggggcgcagagggcgactggctcaagtttcgctgtccgcacgcgacaggccaggtcgattgtccgcttggcatggctgcctgttccgcgtcgaattacggtatggtcgtgaagaagcgtctcgacgaggacgtccgtcgatacgcgaatccacatcgcggctctcgcacatggaagatgctttatgatgaacggaccgctgtagagcgctgttttgcacggctgaaagagtggctgacgcttgacggcgtgcatgtgcggggtatcgagaaggtcacagcgcatgcgtacatcaacgccagtgtactgttggcgtctgctctggcgatgcaccggacgaatcgtatcgatcaggtggcttaa

SEQ ID NO: 1612 - DNA, 528 bp, Artificial
  Alicyclobacillus acidocaldarius mutated SEQ ID NO 1600
gtgttaatggatgcaggatacgaccagacgaaaaactatgaagccgctcgagcattaggtgctcaggctatcatcccgatgaatcgccggaatgagaaagagccgccggaagggatggatttcgacggcacgccccgctgcacgatggggtatcggatgacgtattggggcgcagagggcgactggctcaagtttcgctgtccgcacgcgacaggccaggtcgattgtccgcttggcatggctgcctgttccgcgtcgaattacggtatggtcgtgaagaagcgtctcgacgaggacgtccgtcgatacgcgaatccacatcgcggctctcgcacatggaagatgctttatgatgaacggaccgctattgagcgctgttttgcacggctgaaagagtggctgacgcttgacggcgtgcatgtgcggggtatcgagaaggtcacagcgcatgcgtacatcaacgccagtgtactgttggcgtctgctctggcgatgcaccggacgaatcgtatcgagcaggtggcttaa

SEQ ID NO: 1613 - DNA, 528 bp, Artificial
  Alicyclobacillus acidocaldarius mutated SEQ ID NO 1600
gtgttaatggatgcaggatacgaccagacgaaaaactatgaagccgctcgagcattaggtgctcaggctatcatcccgatgaatcgccggaatgagaaagagccgccggaagggatggatttcgacggcacgccccgctgcacgatggggtatcggatgacgtattggggcgcagagggcgactggctcaagtttcgctgtccgcacgcgacaggccaggtcgattgtccgcttggcatggctgcctgttccgcgtcgaattacggtatggtcgtgaagaagcgtctcgacgaggacgtccgtcgatacgcgaatccacatcgcggctctcgcacatggaagatgctttatgatgaacggaccgctgtagagcgctgttttgcacggctgaaagagtggctgacgcttgacggcgtgcatgtgcggggtatcgagaaggtcacagcgcatgcgtacatccaagccagtgtactgttggcgtctgctctggcgatgcaccggacgaatcgtatcgagcaggtggcttaa

SEQ ID NO: 1614 - DNA, 528 bp, Artificial
  Alicyclobacillus acidocaldarius mutated SEQ ID NO 1600
gtgttaatggatgcaggatacgaccagacgaaaaactatgaagccgctcgagcattaggtgctcaggctatcatcccgatgaatcgccggaatgagaaagagccgccggaagggatggatttcgacggcacgccccgctgcacgatggggtatcggatgacgtattggggcgcagagggcgactggctcaagtttcgctgtccgcacgcgacaggccaggtcgattgtccgcttggcatggctgcctgttccgcgtcgaattacggtatggtcgtgaagaagcgtctcgacgaggacattcgtcgatacgcgaatccacatcgcggctctcgcacatggaagatgctttatgatgaacggaccgctgtagagcgctgttttgcacggctgaaagagtggctgacgcttgacggcgtgcatgtgcggggtatcgagaaggtcacagcgcatgcgtacatcaacgccagtgtactgttggcgtctgctctggcgatgcaccggacgaatcgtatcgagcaggtggcttaa

SEQ ID NO: 1615 - DNA, 528 bp, Artificial
  Alicyclobacillus acidocaldarius mutated SEQ ID NO 1600
gtgattatggatgcaggatacgaccagacgaaaaactatgaagccgctcgagcattaggtgctcaggctatcatcccgatgaatcgccggaatgagaaagagccgccggaagggatggatttcgacggcacgccccgctgcacgatggggtatcggatgacgtattggggcgcagagggcgactggctcaagtttcgctgtccgcacgcgacaggccaggtcgattgtccgcttggcatggctgcctgttccgcgtcgaattacggtatggtcgtgaagaagcgtctcgacgaggacgtccgtcgatacgcgaatccacatcgcggctctcgcacatggaagatgctttatgatgaacggaccgctgtagagcgctgttttgcacggctgaaagagtggctgacgcttgacggcgtgcatgtgcggggtatcgagaaggtcacagcgcatgcgtacatcaacgccagtgtactgttggcgtctgctctggcgatgcaccggacgaatcgtatcgagcaggtggcttaa

SEQ ID NO: 1616 - protein, 163 aa, Alicyclobacillus acidocaldarius
MNAEGTSMLNRVILIGRLTADPELRYTNNGTAVASFTLAVDRMRSGPNGERQTDFINVVVWQKQAEIVAQYLQKGRLAAVDGRLQIRSYDNRDGQRVRVAEVVAETVRFLDRGPDQAQGSGYSAAGAQTRQQRPTPSSAPPFEDDPFADDSQLIDISEDDLPF

SEQ ID NO: 1617 - DNA, 492 bp, Alicyclobacillus acidocaldarius
gtgaacgcggaggggacgagcatgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgatcgatatctccgaagatgatcttccgttttga

SEQ ID NO: 1618 - protein, 105 aa, Pelotomaculum thermopropionicum
MLNKVILIGRLTQDPELRYTPGGVAVARFTLAVNRARLNKQGERETDFIDVVVWQKQAETCANYIRKGRLVAVEGRLQVRSYDDSQGIRRKAAEVVAETVRFLDR

SEQ ID NO: 1619 - protein, 88 aa, Bacillus halodurans
MLNRVVLVGRLTRDPELRYTPNGVAVANFTLAVNRPFSNQQGEREADFINCVVWRKQAENVANYLKKGSLAGVDGRIQTRSYDNNEGR

SEQ ID NO: 1620 - protein, 164 aa, Bacillus cereus
MMNRVILVGRLTKDPDLRYTPNGVAVATFTLAVNRAFTNQQGEREADFINCVIWRKQAENVANYLKKGSLAGVDGRLQTRNYEGQDGRRVYVTEVLAESVQFLEPRNSGGEQRGSFNQQPSGAGFGNQGSNPFGQSGNSGFTKNDDPFSNVGQPIDISDDDLPF

SEQ ID NO: 1621 - protein, 164 aa, Geobacillus kaustophilus
MINRVILVGRLTRDPELRYTPSGVAVATFTLAVNRPFTNQQGERETDFIQCVVWRRQAENVANFLKKGSLAGVDGRLQTRSYENQEGRRVYVTEVVADSVQFLEPKGTSEQRGATAGGYYGDPFPFGQDQNHQYPNEKGFGRIDDDPFANDGQPIDISDDDLPF

SEQ ID NO: 1622 - protein, 108 aa, Symbiobacterium thermophilum
MLNSVVLIGRLTKDPELRYTPSGKAVATLRLAVDRGTVNQQGERETDFIDIVVWEKQAETVANYLQKGRLVAVQGRLQIRQYTTQDGQKREKAEVVATTVRFLDSARD

SEQ ID NO: 1623 - protein, 163 aa, Artificial
  Alicyclobacillus acidocaldarius mutated SEQ ID NO 1616
MNAEGTSMLNRVILIGRLTADPELRYTNNGTAVASFTLAVDRMRSGPNGERQTDFINVVVWQKQAEIVAQYLQKGRLAAVDGRLQIRSYDNRDGQRVRVAEVVAETVRFLDRGPDQAQGSGYSAAGAQTRQQRPTPSSAPPFEDDPFADDSNLIDISEDDLPF

SEQ ID NO: 1624 - protein, 163 aa, Artificial
  Alicyclobacillus acidocaldarius mutated SEQ ID NO 1616
MNAEGTSMLNRVILIGRLTADPELRYTNNGTAVASFTLAVDRMRSGPNGERQTDFINVVVWQKQAEIVAQYLQKGRLAAVDGRLQIRSYDNRDGNRVRVAEVVAETVRFLDRGPDQAQGSGYSAAGAQTRQQRPTPSSAPPFEDDPFADDSQLIDISEDDLPF

SEQ ID NO: 1625 - protein, 163 aa, Artificial
  Alicyclobacillus acidocaldarius mutated SEQ ID NO 1616
MNAEGTSMLNRVILIGRLTADPELRYTNNGTAVASFTLAVDRMRSGPNGERQTDFINVVVWQKQAEIVAQYLQKGRLAAVDGRLQIRSYDNRDGQRVRIAEVVAETVRFLDRGPDQAQGSGYSAAGAQTRQQRPTPSSAPPFEDDPFADDSQLIDISEDDLPF

SEQ ID NO: 1626 - protein, 163 aa, Artificial
  Alicyclobacillus acidocaldarius mutated SEQ ID NO 1616
MNAEGTSMLNRVILIGRLTADPELRYTNNGTAVASFTLAVDRMRSGPNGERQTDFINVVVWQKQAEIVAQYLQKGRLAAVDGRLQIRSYDNRDGQRVRVAEIVAETVRFLDRGPDQAQGSGYSAAGAQTRQQRPTPSSAPPFEDDPFADDSQLIDISEDDLPF

SEQ ID NO: 1627 - protein, 163 aa, Artificial
  Alicyclobacillus acidocaldarius mutated SEQ ID NO 1616
MNAEGTSMLNRVILIGRLTADPELRYTNNGTAVASFTLAVDRMRSGPNGERQTDFINVVVWQKQAEIVAQYLQKGRLAAVDGRLQIRSYDNRDGQRVRVAEVVAETVRFLDRGPDQAQGSGYSAAGAQTRQQRPTPSSAPPFEDDPFADESQLIDISEDDLPF

SEQ ID NO: 1628 - DNA, 492 bp, Artificial
  Alicyclobacillus acidocaldarius mutated SEQ ID NO 1617
gtgaacgcggaggggacgagcatgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtaatttgatcgatatctccgaagatgatcttccgttttga

SEQ ID NO: 1629 - DNA, 492 bp, Artificial
  Alicyclobacillus acidocaldarius mutated SEQ ID NO 1617
gtgaacgcggaggggacgagcatgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggaatcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgatcgatatctccgaagatgatcttccgttttga

SEQ ID NO: 1630 - DNA, 492 bp, Artificial
  Alicyclobacillus acidocaldarius mutated SEQ ID NO 1617
gtgaacgcggaggggacgagcatgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcattgccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgatcgatatctccgaagatgatcttccgttttga

SEQ ID NO: 1631 - DNA, 492 bp, Artificial
  Alicyclobacillus acidocaldarius mutated SEQ ID NO 1617
gtgaacgcggaggggacgagcatgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaaattgtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgatcgatatctccgaagatgatcttccgttttga

SEQ ID NO: 1632 - DNA, 492 bp, Artificial
  Alicyclobacillus acidocaldarius mutated SEQ ID NO 1617
gtgaacgcggaggggacgagcatgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgaaagtcagttgatcgatatctccgaagatgatcttccgttttga

SEQ ID NO: 1633 - protein, 510 aa, Alicyclobacillus acidocaldarius
MEEQIHLLRHRLFGTSSEKRRKPQTDPDSIQLPLFNEAEVEADAQASEETVEGNAEATSEGVETETITYERRKPRAARERDAWLYQGEADEVVEYRLSDDERVCSKCAGELHEMSREITRRVKIIPAQMKKVEYVRYVYTCRHCEAQDVETPVVRAPMPKPVQAKSLATPEAVAYVMAKKFVDGMPLYRQEQQFARHGYPLSRQTLANWVVHAAETWLEPLYAKLRQVLLAQRYLHADETTLQVLHEAGRAAQTQSYMWVYRSSMNGPPLVLYDYQETRSAEHPRRFLAGFQGYLHVDGYAGYEGLPDVTLVGCWAHARRKFDEALKAVPSKERKGKTAAEEGLSYCNALYAVEKKLKNASAEERQRVRMAKSKPILDAFLAWLEKQEQQVLPKSALGRAVSYVLKQWPKLIRYVENGYLEIDNNRCERSLKPFVIGRKNWLFANTPRGARASAVTYSIVETAKENGLNPTAYLTYLFERMPNIDLKDEAAFEALLPWSEGLPEGIRVRK

SEQ ID NO: 1634 - DNA, 1533 bp, Alicyclobacillus acidocaldarius
ttggaagagcagatccatctgctccgtcatcgtctgtttggcacatcgagcgaaaagcgccgcaagccccagaccgatcccgacagcatccagctcccgttgttcaacgaagccgaagtcgaggcggacgcccaagcttcggaagagaccgtggaaggcaatgcggaagcgacgtcggaaggcgtggagacggagaccatcacgtatgagcgccggaagcctcgtgcggcgcgggagcgtgacgcctggctgtatcagggcgaagcagacgaggtcgtcgaataccgactgtcagatgacgagcgagtctgctcgaaatgtgcgggtgagcttcacgagatgagccgtgagatcacgcgacgcgtgaaaatcatcccggcgcagatgaaaaaagtcgagtacgtgcggtacgtgtacacctgccggcactgtgaagcgcaggacgtggagacccctgtggtgcgcgcgccgatgccgaagccggtgcaggcgaagagtctcgcgacgccggaagcggtggcatacgtgatggcgaagaagttcgtcgacgggatgccattgtaccgacaggagcaacagtttgcgcggcacgggtatccgttatcccgccagacgctggcgaattgggtagtgcacgcggcggagacgtggttagagccgctctatgcgaaactccgccaagtgctcttggctcagcgctatctgcatgcggacgaaacgactctgcaagtgttacatgaagccgggcgcgcggcgcagacccagtcgtacatgtgggtgtaccgcagcagcatgaatggaccgccccttgtcctgtacgattaccaggaaacgcggagcgcggagcatccgcggcggttcttggcagggtttcaagggtatctgcacgtggatggatacgcgggctatgagggcttaccggatgtcacccttgtcggatgttgggcacatgcgcggcgaaaatttgacgaagccctcaaggcggtgccttccaaagagcgaaagggcaagacggctgccgaagaaggattatcgtattgcaacgcgctgtacgcggtggagaagaagctgaaaaacgcaagtgccgaagagcggcaacgtgtgcggatggccaaaagtaagcccattctggacgcgtttttggcatggcttgaaaagcaggaacagcaggtgttgccgaaaagcgcgttgggacgagcggtgagctatgtcctgaagcagtggcccaagctgattcggtatgtcgaaaacgggtatttggaaatcgacaacaaccgatgcgagcggtcattgaagccatttgtgatcggacggaagaactggctttttgccaatacgccgcgaggagcacgagccagtgctgtgacatacagcatcgtggagacagcgaaggagaatggactgaatccgaccgcgtatttgacgtatctctttgaacggatgccgaacattgacctcaaggatgaagcggcgttcgaggcattgttgccttggtccgaagggctccctgaagggattcgagtgagaaaatga

SEQ ID NO: 1635 - protein, 481 aa, Syntrophomonas wolfei
EEQYRLSRQKQFGTSSEKTTPEQINLFNEAEDIVDPEIKEPDIETITYERKKKQPGQKADKLKDLPVEVIEYRLLEHEQVCPCCQGSLHEMSTQIRQEIKVIPAQVKVVQHVQYIYSCRQCEKENITTPIIKAQMPNPILPGSLASPSILAYIMDQKYTNSMPLYRQEQQLSRLGIELSRQTMANWVLNVADPWLKIIYDRLHVELLDRDILHADETTLQVLKEPGRSAETKSYMWLYRTGRDGPPIVLYEYQTTRASKHPDRFLSGFKGYLQTDGYSAYGKLTGITLVGCWAHARRKFTEALKALPAAQKDKPVAASVGLEYCNRLFAIERQLKDVSDKERYDKRLEKSKPLLDEFYIWLKKQKQQTLPKSTFGQAITYCLNQWDCLNSFLLDGRLEIDNNRAERSIKPFVIGRKNWLFTNTPRGARGSAIIYSVIETAKENNLKPYNYMFYLFEQLPNVDTGDQAAIDRLLPWSDTLPE

SEQ ID NO: 1636 - protein, 485 aa, Syntrophomonas wolfei
EEQFRLSRQKQFGASSEKTTPEQINLFNEAEDITDPKLEEPSLETVTYQRKKKQAGQREDKLKDLPVEIIEYRLEKHEQICPCCQGELHEMSIQVRHEIKIIPAQAISVKHVQYIYACRRCEKENITTPIIKAEMPKPILPGSLASPSILAYIMDQKYTNSLPLYRQEQQFSRLGIELSRQTMANWLLAAADPWLKIIYDRLHEQLLEKDILHADETTLQVLKEPGRRAESKSYMWLYRTGRDGPPIVLYDYQTTRASKHPDSFLSGFKGYLQTDGYSGYGSLTSVTLAGCWAHARRKFTEALKALPAEQKDKPVAASIGLGYCNKLFAIERQLKDMSCQERYEKRLELTRPLLNEFYAWLKRQRQQTLPKSMFGQAITYCLNQWDALNTFLLDGRLEIDNNRAERSIKPFVIGRKNFLFSNTPRGARGSAIIYSIIETAKENNLKPYDYLVYLFEQLPNVDTSDQTAVDRLMPWSDTLPEGCRI

SEQ ID NO: 1637 - protein, 390 aa, Moorella thermoacetica
MSTEVRQELKIIPAQVKVVKHIRYVYACRHCEREELTTPVVTAPMPAPVLPGSPVSPSLLAYVMHQKYGEGLPLYRQEQQFKSLGLELSRQTLANWVLHGANTWLTHIYDRLHEYLLKRDILHADETTLQVLREPGREAATKSFLWLYRTGRDGPSIVLYDYQTTRASKHPCRFLAGFKGYLHVDGYAGYNELPDVTLVGCWAHARRKFDEALKALPEDKRNAAVAAREGLEFCNRLFTIERDLKDKTPEERYQLRQVRSKPVLDAFLAWLKTQKSRVLPKSSFGQAINYCLGQWDKLTAFLQDGRLELDNNRSERSIKPFVIGRKNWLFANTPRGAKASAITYSIIETAKDNGLNPFQYLIYLFERLPNLDLKDKDALDQLLPWSASLP

SEQ ID NO: 1638 - protein, 480 aa, Bacillus selenitireducens
MQKKKFGTSSEKTDERFEQGSLFNESEKEQDAAEEEPTVEAITYERKKKRKARKDLTENLYTETVTYTLPVEDQVCSCCNGELHIMKTQVKDELEIIPAEVKVKRYETTIYSCRHCERTGTRNPIVKAPSPERPFPGSLASPSIVSYMINQKFVQGVPLYRQEQEFKRMDVPISRQTMSNWIIEASEQMLEPIWDLMIRILTSLDVLHADETTVQVLKEDGKEAAAKSYMWLYRSGSHDVPIVIYDYQPGRASKYPRRFLEGFTGYLHVDGYGGYHALKPKVELVGCWAHARRKFFDAVQTLPDDRDSTTSAAKKGLNAIDELYRIEREIQNEYKTPEEFYEARKERIEPPLEAFSAWVESMKPKILSKSLLGKAVIYASNQMEHLRTFLKDGRLAIDNNRAERSIKPFVIGRKNWIFSNTPRGAKSSSIIYSMIETAKENQLKPQAYLNYLFENLPSSKQSEMEQFLPWSDSLPRMIFV

SEQ ID NO: 1639 - protein, 483 aa, Alkaliphilus metalliredigens
EEQFRLSQAQKYGSSSEKTDPDQMSIFNEAEKFSVKLDEEPEAEEVLTKRRTGKSKSKKKYEDLPIEEVHYTLSDEERQCPKCDHTLHEMKTEVRKELKIIPAQVKVVHHIKQVYACRGCDAIDSDNGGTIITAPMPKPVLPGSMVSPSVLAFIMENKYNQALPLYRQEASFVNYGIDLSRQNMASWIIQGAEKWLSPLYDRMHTHLKQSPVIHADESPLKVLDEKDKSQSYMWLYATAETSEYPIYLYEYQPSRAKKHPKQFLEGFTGFLQTDGYAGYNGVENVVQVGCLAHARRKYTDAIKALPEGSDVSLTKANEGLSLLRKIYRLEKSFKEMEPEVRYEARIEQTQPVLDAYKTWLEVEEKRTLPKSKLGQAISYSLKQWDKLAAFMKDGRIAIDNNLAERGIKPFVLGRKNYLFAKSPKGATASALCYSIIETAKANKLIPFQYLTYLFEQLPNLDIEDPEALDAMLPWAESLPNEVR

SEQ ID NO: 1640 - protein, 510 aa, Artificial
  Alicyclobacillus acidocaldarius mutated SEQ ID NO 1633
MEEQIHLLRHRLFGTSSEKRRKPQTDPDSIQLPLFNEAEVDADAQASEETVEGNAEATSEGVETETITYERRKPRAARERDAWLYQGEADEVVEYRLSDDERVCSKCAGELHEMSREITRRVKIIPAQMKKVEYVRYVYTCRHCEAQDVETPVVRAPMPKPVQAKSLATPEAVAYVMAKKFVDGMPLYRQEQQFARHGYPLSRQTLANWVVHAAETWLEPLYAKLRQVLLAQRYLHADETTLQVLHEAGRAAQTQSYMWVYRSSMNGPPLVLYDYQETRSAEHPRRFLAGFQGYLHVDGYAGYEGLPDVTLVGCWAHARRKFDEALKAVPSKERKGKTAAEEGLSYCNALYAVEKKLKNASAEERQRVRMAKSKPILDAFLAWLEKQEQQVLPKSALGRAVSYVLKQWPKLIRYVENGYLEIDNNRCERSLKPFVIGRKNWLFANTPRGARASAVTYSIVETAKENGLNPTAYLTYLFERMPNIDLKDEAAFEALLPWSEGLPEGIRVRK

SEQ ID NO: 1641 - protein, 510 aa, Artificial
  Alicyclobacillus acidocaldarius mutated SEQ ID NO 1633
MEEQIHLLRHRLFGTSSEKRRKPQTDPDSIQLPLFNEAEVEADAQASEETVEGNAEATSEGVETETITYERRKPRAARERDAWLYQGEADDVVEYRLSDDERVCSKCAGELHEMSREITRRVKIIPAQMKKVEYVRYVYTCRHCEAQDVETPVVRAPMPKPVQAKSLATPEAVAYVMAKKFVDGMPLYRQEQQFARHGYPLSRQTLANWVVHAAETWLEPLYAKLRQVLLAQRYLHADETTLQVLHEAGRAAQTQSYMWVYRSSMNGPPLVLYDYQETRSAEHPRRFLAGFQGYLHVDGYAGYEGLPDVTLVGCWAHARRKFDEALKAVPSKERKGKTAAEEGLSYCNALYAVEKKLKNASAEERQRVRMAKSKPILDAFLAWLEKQEQQVLPKSALGRAVSYVLKQWPKLIRYVENGYLEIDNNRCERSLKPFVIGRKNWLFANTPRGARASAVTYSIVETAKENGLNPTAYLTYLFERMPNIDLKDEAAFEALLPWSEGLPEGIRVRK

SEQ ID NO: 1642 - protein, 510 aa, Artificial
  Alicyclobacillus acidocaldarius mutated SEQ ID NO 1633
MEEQIHLLRHRLFGTSSEKRRKPQTDPDSINLPLFNEAEVEADAQASEETVEGNAEATSEGVETETITYERRKPRAARERDAWLYQGEADEVVEYRLSDDERVCSKCAGELHEMSREITRRVKIIPAQMKKVEYVRYVYTCRHCEAQDVETPVVRAPMPKPVQAKSLATPEAVAYVMAKKFVDGMPLYRQEQQFARHGYPLSRQTLANWVVHAAETWLEPLYAKLRQVLLAQRYLHADETTLQVLHEAGRAAQTQSYMWVYRSSMNGPPLVLYDYQETRSAEHPRRFLAGFQGYLHVDGYAGYEGLPDVTLVGCWAHARRKFDEALKAVPSKERKGKTAAEEGLSYCNALYAVEKKLKNASAEERQRVRMAKSKPILDAFLAWLEKQEQQVLPKSALGRAVSYVLKQWPKLIRYVENGYLEIDNNRCERSLKPFVIGRKNWLFANTPRGARASAVTYSIVETAKENGLNPTAYLTYLFERMPNIDLKDEAAFEALLPWSEGLPEGIRVRK

SEQ ID NO: 1643 - protein, 510 aa, Artificial
  Alicyclobacillus acidocaldarius mutated SEQ ID NO 1633
MEEQIHLLRHRLFGTSSEKRRKPQTDPDSIQLPLFNEAEVEADAQASEETVEGNAEATSEGVETETITYERRKPRAARERDAWLYQGEADEVVEYRLSDDERVCSKCAGELHEMSREITRRVKIIPAQMKKVEYVRYVYTCRHCEAQDVETPVVRAPMPKPVQAKSLATPEAVAYVMAKKFVDGMPLYRQEQQFARHGYPLSRQTLANWVVHAAETWLEPLYAKLRQVLLAQRYLHADETTLQVLHEAGRAAQTQSYMWVYRSSMNGPPLVLYDYQETRSAEHPRRFLAGFQGYLHVDGYAGYEGLPDVTLVGCWAHARRKFDEALKAVPSKERKGKTAAEEGLSYCNALYAVEKKLKNASAEERQRVRMAKSKPILDAFLAWLEKQEQQVLPKSALGRAVSYVLKQWPKLIRYVENGYLEIDNNRCERSLKPFVIGRKNWLFANTPRGARASAVTYSIVETAKDNGLNPTAYLTYLFERMPNIDLKDEAAFEALLPWSEGLPEGIRVRK

SEQ ID NO: 1644 - protein, 510 aa, Artificial
  Alicyclobacillus acidocaldarius mutated SEQ ID NO 1633
MEEQIHLLRHRLFGTSSEKRRKPQTDPDSIQLPLFNEAEVEADAQASEETVEGNAEATSEGVETETITYERRKPRAARERDAWLYQGEADEVVEYRLSDDERVCSKCAGELHEMSREITKRVKIIPAQMKKVEYVRYVYTCRHCEAQDVETPVVRAPMPKPVQAKSLATPEAVAYVMAKKFVDGMPLYRQEQQFARHGYPLSRQTLANWVVHAAETWLEPLYAKLRQVLLAQRYLHADETTLQVLHEAGRAAQTQSYMWVYRSSMNGPPLVLYDYQETRSAEHPRRFLAGFQGYLHVDGYAGYEGLPDVTLVGCWAHARRKFDEALKAVPSKERKGKTAAEEGLSYCNALYAVEKKLKNASAEERQRVRMAKSKPILDAFLAWLEKQEQQVLPKSALGRAVSYVLKQWPKLIRYVENGYLEIDNNRCERSLKPFVIGRKNWLFANTPRGARASAVTYSIVETAKENGLNPTAYLTYLFERMPNIDLKDEAAFEALLPWSEGLPEGIRVRK

SEQ ID NO: 1645 - DNA, 1533 bp, Artificial
  Alicyclobacillus acidocaldarius mutated SEQ ID NO 1634
ttggaagagcagatccatctgctccgtcatcgtctgtttggcacatcgagcgaaaagcgccgcaagccccagaccgatcccgacagcatccagctcccgttgttcaacgaagccgaagtcgatgcggacgcccaagcttcggaagagaccgtggaaggcaatgcggaagcgacgtcggaaggcgtggagacggagaccatcacgtatgagcgccggaagcctcgtgcggcgcgggagcgtgacgcctggctgtatcagggcgaagcagacgaggtcgtcgaataccgactgtcagatgacgagcgagtctgctcgaaatgtgcgggtgagcttcacgagatgagccgtgagatcacgcgacgcgtgaaaatcatcccggcgcagatgaaaaaagtcgagtacgtgcggtacgtgtacacctgccggcactgtgaagcgcaggacgtggagacccctgtggtgcgcgcgccgatgccgaagccggtgcaggcgaagagtctcgcgacgccggaagcggtggcatacgtgatggcgaagaagttcgtcgacgggatgccattgtaccgacaggagcaacagtttgcgcggcacgggtatccgttatcccgccagacgctggcgaattgggtagtgcacgcggcggagacgtggttagagccgctctatgcgaaactccgccaagtgctcttggctcagcgctatctgcatgcggacgaaacgactctgcaagtgttacatgaagccgggcgcgcggcgcagacccagtcgtacatgtgggtgtaccgcagcagcatgaatggaccgccccttgtcctgtacgattaccaggaaacgcggagcgcggagcatccgcggcggttcttggcagggtttcaagggtatctgcacgtggatggatacgcgggctatgagggcttaccggatgtcacccttgtcggatgttgggcacatgcgcggcgaaaatttgacgaagccctcaaggcggtgccttccaaagagcgaaagggcaagacggctgccgaagaaggattatcgtattgcaacgcgctgtacgcggtggagaagaagctgaaaaacgcaagtgccgaagagcggcaacgtgtgcggatggccaaaagtaagcccattctggacgcgtttttggcatggcttgaaaagcaggaacagcaggtgttgccgaaaagcgcgttgggacgagcggtgagctatgtcctgaagcagtggcccaagctgattcggtatgtcgaaaacgggtatttggaaatcgacaacaaccgatgcgagcggtcattgaagccatttgtgatcggacggaagaactggctttttgccaatacgccgcgaggagcacgagccagtgctgtgacatacagcatcgtggagacagcgaaggagaatggactgaatccgaccgcgtatttgacgtatctctttgaacggatgccgaacattgacctcaaggatgaagcggcgttcgaggcattgttgccttggtccgaagggctccctgaagggattcgagtgagaaaatga

SEQ ID NO: 1646 - DNA, 1533 bp, Artificial
  Alicyclobacillus acidocaldarius mutated SEQ ID NO 1634
ttggaagagcagatccatctgctccgtcatcgtctgtttggcacatcgagcgaaaagcgccgcaagccccagaccgatcccgacagcatccagctcccgttgttcaacgaagccgaagtcgaggcggacgcccaagcttcggaagagaccgtggaaggcaatgcggaagcgacgtcggaaggcgtggagacggagaccatcacgtatgagcgccggaagcctcgtgcggcgcgggagcgtgacgcctggctgtatcagggcgaagcagacgatgtcgtcgaataccgactgtcagatgacgagcgagtctgctcgaaatgtgcgggtgagcttcacgagatgagccgtgagatcacgcgacgcgtgaaaatcatcccggcgcagatgaaaaaagtcgagtacgtgcggtacgtgtacacctgccggcactgtgaagcgcaggacgtggagacccctgtggtgcgcgcgccgatgccgaagccggtgcaggcgaagagtctcgcgacgccggaagcggtggcatacgtgatggcgaagaagttcgtcgacgggatgccattgtaccgacaggagcaacagtttgcgcggcacgggtatccgttatcccgccagacgctggcgaattgggtagtgcacgcggcggagacgtggttagagccgctctatgcgaaactccgccaagtgctcttggctcagcgctatctgcatgcggacgaaacgactctgcaagtgttacatgaagccgggcgcgcggcgcagacccagtcgtacatgtgggtgtaccgcagcagcatgaatggaccgccccttgtcctgtacgattaccaggaaacgcggagcgcggagcatccgcggcggttcttggcagggtttcaagggtatctgcacgtggatggatacgcgggctatgagggcttaccggatgtcacccttgtcggatgttgggcacatgcgcggcgaaaatttgacgaagccctcaaggcggtgccttccaaagagcgaaagggcaagacggctgccgaagaaggattatcgtattgcaacgcgctgtacgcggtggagaagaagctgaaaaacgcaagtgccgaagagcggcaacgtgtgcggatggccaaaagtaagcccattctggacgcgtttttggcatggcttgaaaagcaggaacagcaggtgttgccgaaaagcgcgttgggacgagcggtgagctatgtcctgaagcagtggcccaagctgattcggtatgtcgaaaacgggtatttggaaatcgacaacaaccgatgcgagcggtcattgaagccatttgtgatcggacggaagaactggctttttgccaatacgccgcgaggagcacgagccagtgctgtgacatacagcatcgtggagacagcgaaggagaatggactgaatccgaccgcgtatttgacgtatctctttgaacggatgccgaacattgacctcaaggatgaagcggcgttcgaggcattgttgccttggtccgaagggctccctgaagggattcgagtgagaaaatga

SEQ ID NO: 1647 - DNA, 1533 bp, Artificial
  Alicyclobacillus acidocaldarius mutated SEQ ID NO 1634
ttggaagagcagatccatctgctccgtcatcgtctgtttggcacatcgagcgaaaagcgccgcaagccccagaccgatcccgacagcatcaatctcccgttgttcaacgaagccgaagtcgaggcggacgcccaagcttcggaagagaccgtggaaggcaatgcggaagcgacgtcggaaggcgtggagacggagaccatcacgtatgagcgccggaagcctcgtgcggcgcgggagcgtgacgcctggctgtatcagggcgaagcagacgaggtcgtcgaataccgactgtcagatgacgagcgagtctgctcgaaatgtgcgggtgagcttcacgagatgagccgtgagatcacgcgacgcgtgaaaatcatcccggcgcagatgaaaaaagtcgagtacgtgcggtacgtgtacacctgccggcactgtgaagcgcaggacgtggagacccctgtggtgcgcgcgccgatgccgaagccggtgcaggcgaagagtctcgcgacgccggaagcggtggcatacgtgatggcgaagaagttcgtcgacgggatgccattgtaccgacaggagcaacagtttgcgcggcacgggtatccgttatcccgccagacgctggcgaattgggtagtgcacgcggcggagacgtggttagagccgctctatgcgaaactccgccaagtgctcttggctcagcgctatctgcatgcggacgaaacgactctgcaagtgttacatgaagccgggcgcgcggcgcagacccagtcgtacatgtgggtgtaccgcagcagcatgaatggaccgccccttgtcctgtacgattaccaggaaacgcggagcgcggagcatccgcggcggttcttggcagggtttcaagggtatctgcacgtggatggatacgcgggctatgagggcttaccggatgtcacccttgtcggatgttgggcacatgcgcggcgaaaatttgacgaagccctcaaggcggtgccttccaaagagcgaaagggcaagacggctgccgaagaaggattatcgtattgcaacgcgctgtacgcggtggagaagaagctgaaaaacgcaagtgccgaagagcggcaacgtgtgcggatggccaaaagtaagcccattctggacgcgtttttggcatggcttgaaaagcaggaacagcaggtgttgccgaaaagcgcgttgggacgagcggtgagctatgtcctgaagcagtggcccaagctgattcggtatgtcgaaaacgggtatttggaaatcgacaacaaccgatgcgagcggtcattgaagccatttgtgatcggacggaagaactggctttttgccaatacgccgcgaggagcacgagccagtgctgtgacatacagcatcgtggagacagcgaaggagaatggactgaatccgaccgcgtatttgacgtatctctttgaacggatgccgaacattgacctcaaggatgaagcggcgttcgaggcattgttgccttggtccgaagggctccctgaagggattcgagtgagaaaatga

SEQ ID NO: 1648 - DNA, 1533 bp, Artificial
  Alicyclobacillus acidocaldarius mutated SEQ ID NO 1634
ttggaagagcagatccatctgctccgtcatcgtctgtttggcacatcgagcgaaaagcgccgcaagccccagaccgatcccgacagcatccagctcccgttgttcaacgaagccgaagtcgaggcggacgcccaagcttcggaagagaccgtggaaggcaatgcggaagcgacgtcggaaggcgtggagacggagaccatcacgtatgagcgccggaagcctcgtgcggcgcgggagcgtgacgcctggctgtatcagggcgaagcagacgaggtcgtcgaataccgactgtcagatgacgagcgagtctgctcgaaatgtgcgggtgagcttcacgagatgagccgtgagatcacgcgacgcgtgaaaatcatcccggcgcagatgaaaaaagtcgagtacgtgcggtacgtgtacacctgccggcactgtgaagcgcaggacgtggagacccctgtggtgcgcgcgccgatgccgaagccggtgcaggcgaagagtctcgcgacgccggaagcggtggcatacgtgatggcgaagaagttcgtcgacgggatgccattgtaccgacaggagcaacagtttgcgcggcacgggtatccgttatcccgccagacgctggcgaattgggtagtgcacgcggcggagacgtggttagagccgctctatgcgaaactccgccaagtgctcttggctcagcgctatctgcatgcggacgaaacgactctgcaagtgttacatgaagccgggcgcgcggcgcagacccagtcgtacatgtgggtgtaccgcagcagcatgaatggaccgccccttgtcctgtacgattaccaggaaacgcggagcgcggagcatccgcggcggttcttggcagggtttcaagggtatctgcacgtggatggatacgcgggctatgagggcttaccggatgtcacccttgtcggatgttgggcacatgcgcggcgaaaatttgacgaagccctcaaggcggtgccttccaaagagcgaaagggcaagacggctgccgaagaaggattatcgtattgcaacgcgctgtacgcggtggagaagaagctgaaaaacgcaagtgccgaagagcggcaacgtgtgcggatggccaaaagtaagcccattctggacgcgtttttggcatggcttgaaaagcaggaacagcaggtgttgccgaaaagcgcgttgggacgagcggtgagctatgtcctgaagcagtggcccaagctgattcggtatgtcgaaaacgggtatttggaaatcgacaacaaccgatgcgagcggtcattgaagccatttgtgatcggacggaagaactggctttttgccaatacgccgcgaggagcacgagccagtgctgtgacatacagcatcgtggagacagcgaaggataatggactgaatccgaccgcgtatttgacgtatctctttgaacggatgccgaacattgacctcaaggatgaagcggcgttcgaggcattgttgccttggtccgaagggctccctgaagggattcgagtgagaaaatga

SEQ ID NO: 1649 - DNA, 1533 bp, Artificial
  Alicyclobacillus acidocaldarius mutated SEQ ID NO 1634
ttggaagagcagatccatctgctccgtcatcgtctgtttggcacatcgagcgaaaagcgccgcaagccccagaccgatcccgacagcatccagctcccgttgttcaacgaagccgaagtcgaggcggacgcccaagcttcggaagagaccgtggaaggcaatgcggaagcgacgtcggaaggcgtggagacggagaccatcacgtatgagcgccggaagcctcgtgcggcgcgggagcgtgacgcctggctgtatcagggcgaagcagacgaggtcgtcgaataccgactgtcagatgacgagcgagtctgctcgaaatgtgcgggtgagcttcacgagatgagccgtgagatcacgaaacgcgtgaaaatcatcccggcgcagatgaaaaaagtcgagtacgtgcggtacgtgtacacctgccggcactgtgaagcgcaggacgtggagacccctgtggtgcgcgcgccgatgccgaagccggtgcaggcgaagagtctcgcgacgccggaagcggtggcatacgtgatggcgaagaagttcgtcgacgggatgccattgtaccgacaggagcaacagtttgcgcggcacgggtatccgttatcccgccagacgctggcgaattgggtagtgcacgcggcggagacgtggttagagccgctctatgcgaaactccgccaagtgctcttggctcagcgctatctgcatgcggacgaaacgactctgcaagtgttacatgaagccgggcgcgcggcgcagacccagtcgtacatgtgggtgtaccgcagcagcatgaatggaccgccccttgtcctgtacgattaccaggaaacgcggagcgcggagcatccgcggcggttcttggcagggtttcaagggtatctgcacgtggatggatacgcgggctatgagggcttaccggatgtcacccttgtcggatgttgggcacatgcgcggcgaaaatttgacgaagccctcaaggcggtgccttccaaagagcgaaagggcaagacggctgccgaagaaggattatcgtattgcaacgcgctgtacgcggtggagaagaagctgaaaaacgcaagtgccgaagagcggcaacgtgtgcggatggccaaaagtaagcccattctggacgcgtttttggcatggcttgaaaagcaggaacagcaggtgttgccgaaaagcgcgttgggacgagcggtgagctatgtcctgaagcagtggcccaagctgattcggtatgtcgaaaacgggtatttggaaatcgacaacaaccgatgcgagcggtcattgaagccatttgtgatcggacggaagaactggctttttgccaatacgccgcgaggagcacgagccagtgctgtgacatacagcatcgtggagacagcgaaggagaatggactgaatccgaccgcgtatttgacgtatctctttgaacggatgccgaacattgacctcaaggatgaagcggcgttcgaggcattgttgccttggtccgaagggctccctgaagggattcgagtgagaaaatga

SEQ ID NO: 1650 - protein, 176 aa, Alicyclobacillus acidocaldarius
MAMGLSILQPYALDIALFSGILAIICLVIASVALSRSARLKRKFNRLKEVTSAADLERVFEETKDAVRKLEMKLREAEEHLRIVEEALQSKVSTPAILRYNAFAEVGSDLSYSVALIDGKGDGVVITSIYGREDSVTYGKPVQGGDSPYMLTEEERAVIEEALRGAPRRRTTAQIS

SEQ ID NO: 1651 - DNA, 531 bp, Alicyclobacillus acidocaldarius
atggccatggggctttctattcttcagccgtacgcgctcgacatcgcgctgttcagcggcatcttggcgatcatctgtctcgtgatcgcgtccgtcgctctatcgcgctccgcgcgcttgaagcggaagttcaaccggctgaaagaggtgacgagcgcagcggacctcgagcgggttttcgaagagaccaaagacgcggttcgcaaacttgaaatgaaactgcgcgaagctgaggagcacctgcgtatagtcgaagaagcgcttcagtccaaggtctccacgcccgccatcctgcgctacaacgcttttgccgaagtgggcagcgatctcagctactcggtcgcgctcatcgatgggaagggcgacggtgtcgtaatcacctcgatttatgggcgagaggattccgtcacctacggaaagccagtgcaagggggagattctccgtatatgttgacggaagaggagcgcgcggtcatcgaagaagccctccgcggtgcaccgcgacggcgaaccacagcccagatctcctga

SEQ ID NO: 1652 - protein, 162 aa, Alkaliphilus oremlandii
MAFITNILEEYRDILFIASLGLNILTIIFLIINMGISSNLKEKYRKLVRGTDGKQIESILFEHLDKIEDVHQRLNQFEGKLEIFNNRLSFCVQRVGIIRYNAFDDTGSDLSYSIALLDENNDGIIITGIYGRIETVSYAKPVKNGVSNYSLSVEELQALERA

SEQ ID NO: 1653 - protein, 159 aa, Clostridium tetani
IQIFQNYSVFIVLGLIIATIILFFIVVVQAKAINRLEKRYRKFMRGVDNKNLEELINTYLDKVDKASEECQYAKELYKSLEDRLNICVQKIAIIRYRAFEDVGSDLSFSVALLDYKDSGIIITGIYGRNESTTYAKPIDKGISRYELSEEENHVLKEAM

SEQ ID NO: 1654 - protein, 162 aa, Thermoanaerobacter  X514
LDIISQNATLIILFLSVLSIIELIFILIINGKFLRLNRTYNKIIKTLEKGDVFDIFSRILTENEEIKNKLDKLRMDLNSLDKETKTAIKKVGIVRYNAFSDVGSDLSFSIALLDSNDNGIVLSGIYGRNETATFAKPIERGQSKYPLSAEEVQAIERAKRKA

SEQ ID NO: 1655 - protein, 159 aa, Clostridium perfringens
LNILTQYSTYITIGLIVLVLIQFILLIVALRSLSKVENKFRKIMRGVNNKNLEELINSYLDKVEEVKKDSEETLETNKMLKAQIEKCTQKVSVIRYKAFEDVGSDLSFSVALLDGENNGVILTGIYGRDYSTTYAKPIDKGISRYDLSEEELHVLNAAM

SEQ ID NO: 1656 - protein, 156 aa, Symbiobacterium thermophilum
LLQQDPLLVAFTALGFCIVAIVIMLIVLVRQSILLRRYRSLLRGNTNASLEDLLIQQQQATADLRAAQESIRRRLSDLESASQKYLQRIGIVRYNAFPDVGADLSFSCALLDGEDNGVVVTSLYGRSECRTYAKPIRGGSSSYALTDEEKQALRLA

SEQ ID NO: 1657 - protein, 176 aa, Artificial
  Alicyclobacillus acidocaldarius mutated SEQ ID NO 1650
MAMGLSILQPYALDIALFSGILAIICLVIASVALSRSARLKRKFNRLKEVTSAADLERVFEETKDAVRKLEMKLREAEEHLRIVEEALQSKVSTPAILRYNAFAEVGSDLSYSVALIDGKGDGVVITSIYGREDSVTYGKPVQGGESPYMLTEEERAVIEEALRGAPRRRTTAQIS

SEQ ID NO: 1658 - protein, 176 aa, Artificial
  Alicyclobacillus acidocaldarius mutated SEQ ID NO 1650
MAMGLSILQPYALDIALFSGILAIICLVIASVALSRSARLKRKFNRLKEVTSAADLERVFEETKDAVRKLEMKLREAEEHLRIVEEALQSKVSTPAILRYNAFAEVGSDLSYSVALIDGKGDGVVITSIYGREDSITYGKPVQGGDSPYMLTEEERAVIEEALRGAPRRRTTAQIS

SEQ ID NO: 1659 - protein, 176 aa, Artificial
  Alicyclobacillus acidocaldarius mutated SEQ ID NO 1650
MAMGLSILQPYALDIALFSGILAIICLVIASVALSRSARLKRKFNRLKEVTSAADLERVFEETKDAVRKLEMKLREAEEHLRLVEEALQSKVSTPAILRYNAFAEVGSDLSYSVALIDGKGDGVVITSIYGREDSVTYGKPVQGGDSPYMLTEEERAVIEEALRGAPRRRTTAQIS

SEQ ID NO: 1660 - protein, 176 aa, Artificial
  Alicyclobacillus acidocaldarius mutated SEQ ID NO 1650
MAMGLSILQPYAIDIALFSGILAIICLVIASVALSRSARLKRKFNRLKEVTSAADLERVFEETKDAVRKLEMKLREAEEHLRIVEEALQSKVSTPAILRYNAFAEVGSDLSYSVALIDGKGDGVVITSIYGREDSVTYGKPVQGGDSPYMLTEEERAVIEEALRGAPRRRTTAQIS

SEQ ID NO: 1661 - protein, 176 aa, Artificial
  Alicyclobacillus acidocaldarius mutated SEQ ID NO 1650
MAMGLSILQPYALDIALFSGILAIICLVIASVALSRSARLKRRFNRLKEVTSAADLERVFEETKDAVRKLEMKLREAEEHLRIVEEALQSKVSTPAILRYNAFAEVGSDLSYSVALIDGKGDGVVITSIYGREDSVTYGKPVQGGDSPYMLTEEERAVIEEALRGAPRRRTTAQIS

SEQ ID NO: 1662 - DNA, 531 bp, Artificial
  Alicyclobacillus acidocaldarius mutated SEQ ID NO 1651
atggccatggggctttctattcttcagccgtacgcgctcgacatcgcgctgttcagcggcatcttggcgatcatctgtctcgtgatcgcgtccgtcgctctatcgcgctccgcgcgcttgaagcggaagttcaaccggctgaaagaggtgacgagcgcagcggacctcgagcgggttttcgaagagaccaaagacgcggttcgcaaacttgaaatgaaactgcgcgaagctgaggagcacctgcgtatagtcgaagaagcgcttcagtccaaggtctccacgcccgccatcctgcgctacaacgcttttgccgaagtgggcagcgatctcagctactcggtcgcgctcatcgatgggaagggcgacggtgtcgtaatcacctcgatttatgggcgagaggattccgtcacctacggaaagccagtgcaagggggagaatctccgtatatgttgacggaagaggagcgcgcggtcatcgaagaagccctccgcggtgcaccgcgacggcgaaccacagcccagatctcctga

SEQ ID NO: 1663 - DNA, 531 bp, Artificial
  Alicyclobacillus acidocaldarius mutated SEQ ID NO 1651
atggccatggggctttctattcttcagccgtacgcgctcgacatcgcgctgttcagcggcatcttggcgatcatctgtctcgtgatcgcgtccgtcgctctatcgcgctccgcgcgcttgaagcggaagttcaaccggctgaaagaggtgacgagcgcagcggacctcgagcgggttttcgaagagaccaaagacgcggttcgcaaacttgaaatgaaactgcgcgaagctgaggagcacctgcgtatagtcgaagaagcgcttcagtccaaggtctccacgcccgccatcctgcgctacaacgcttttgccgaagtgggcagcgatctcagctactcggtcgcgctcatcgatgggaagggcgacggtgtcgtaatcacctcgatttatgggcgagaggattccattacctacggaaagccagtgcaagggggagattctccgtatatgttgacggaagaggagcgcgcggtcatcgaagaagccctccgcggtgcaccgcgacggcgaaccacagcccagatctcctga

SEQ ID NO: 1664 - DNA, 531 bp, Artificial
  Alicyclobacillus acidocaldarius mutated SEQ ID NO 1651
atggccatggggctttctattcttcagccgtacgcgctcgacatcgcgctgttcagcggcatcttggcgatcatctgtctcgtgatcgcgtccgtcgctctatcgcgctccgcgcgcttgaagcggaagttcaaccggctgaaagaggtgacgagcgcagcggacctcgagcgggttttcgaagagaccaaagacgcggttcgcaaacttgaaatgaaactgcgcgaagctgaggagcacctgcgtttagtcgaagaagcgcttcagtccaaggtctccacgcccgccatcctgcgctacaacgcttttgccgaagtgggcagcgatctcagctactcggtcgcgctcatcgatgggaagggcgacggtgtcgtaatcacctcgatttatgggcgagaggattccgtcacctacggaaagccagtgcaagggggagattctccgtatatgttgacggaagaggagcgcgcggtcatcgaagaagccctccgcggtgcaccgcgacggcgaaccacagcccagatctcctga

SEQ ID NO: 1665 - DNA, 531 bp, Artificial
  Alicyclobacillus acidocaldarius mutated SEQ ID NO 1651
atggccatggggctttctattcttcagccgtacgcgattgacatcgcgctgttcagcggcatcttggcgatcatctgtctcgtgatcgcgtccgtcgctctatcgcgctccgcgcgcttgaagcggaagttcaaccggctgaaagaggtgacgagcgcagcggacctcgagcgggttttcgaagagaccaaagacgcggttcgcaaacttgaaatgaaactgcgcgaagctgaggagcacctgcgtatagtcgaagaagcgcttcagtccaaggtctccacgcccgccatcctgcgctacaacgcttttgccgaagtgggcagcgatctcagctactcggtcgcgctcatcgatgggaagggcgacggtgtcgtaatcacctcgatttatgggcgagaggattccgtcacctacggaaagccagtgcaagggggagattctccgtatatgttgacggaagaggagcgcgcggtcatcgaagaagccctccgcggtgcaccgcgacggcgaaccacagcccagatctcctga

SEQ ID NO: 1666 - DNA, 531 bp, Artificial
  Alicyclobacillus acidocaldarius mutated SEQ ID NO 1651
atggccatggggctttctattcttcagccgtacgcgctcgacatcgcgctgttcagcggcatcttggcgatcatctgtctcgtgatcgcgtccgtcgctctatcgcgctccgcgcgcttgaagcggcgtttcaaccggctgaaagaggtgacgagcgcagcggacctcgagcgggttttcgaagagaccaaagacgcggttcgcaaacttgaaatgaaactgcgcgaagctgaggagcacctgcgtatagtcgaagaagcgcttcagtccaaggtctccacgcccgccatcctgcgctacaacgcttttgccgaagtgggcagcgatctcagctactcggtcgcgctcatcgatgggaagggcgacggtgtcgtaatcacctcgatttatgggcgagaggattccgtcacctacggaaagccagtgcaagggggagattctccgtatatgttgacggaagaggagcgcgcggtcatcgaagaagccctccgcggtgcaccgcgacggcgaaccacagcccagatctcctga

SEQ ID NO: 1667 - protein, 371 aa, Alicyclobacillus acidocaldarius
MDIRRVELHDFRNYAKAEIELSPGVNVLVGENGQGKTNALEAMLLIAVGKSHRAHRDRDLIRWEQDRARILLEASTRYGDRRLTLELGPEGRRAFANGVQVGRMTEFVGQVQVVLFAPEDLDLVKGSPRVRRRFLDTELGQMEPLYLHHLSLYNRALLQRNRWLKTAPLSPDDDVLATFDRQIAFHGAHVIHRRLRFLARLRAYAARIYSDIASGREEFALAYRSSVSGVEEGMSVEEMADTVQRALEKNRAQDLRFGTTSAGPHRDDILLFLDGREVHTAASQGQQRTIALSLRLAEIDFMHEELGEYPVLLLDDVLSELDDLRQRNLVLGMSRKVQTVITTTSLNRLGQELDDFRLFRVCSGIIAEERV

SEQ ID NO: 1668 - DNA, 1116 bp, Alicyclobacillus acidocaldarius
atggacatccgccgcgttgaactccacgactttcgcaactatgcgaaggccgagatcgagttgtcgccaggagtgaacgtgctcgtcggcgagaacggccagggaaagacgaacgccctggaagcgatgctgctcatcgccgtgggcaagtcgcacagggctcatcgggatcgcgatctcatccgctgggaacaggaccgcgcgcgcatcctgttggaggcctcgacgcggtacggagaccggcgcctgacgttggaactggggccagaggggcgcagggcgttcgccaacggcgttcaggtgggccggatgaccgagtttgtcggccaggtgcaggtggtgctctttgcgccggaggacctcgatctcgtcaagggcagtccccgcgttcggcgcaggtttctcgacacggaactgggacagatggagcccttgtatctccaccacctgagcctttacaatcgcgcgctcttgcagcgaaaccgctggctgaagaccgcaccgctgtctccggacgacgacgtgctcgccacgtttgaccgacagattgcctttcacggggcgcacgtgattcaccggcgcctccggtttctcgcgcggttgcgcgcatacgccgctcgcatctacagcgacatcgcgagcggccgggaagagtttgcgctcgcgtaccgaagttcggtctccggcgtcgaggaaggcatgagcgtggaggagatggcagacaccgtgcaacgcgcgctcgaaaaaaaccgggcgcaggatctgcgctttggcacgacgagcgccggcccccaccgggacgacatcctgctctttctcgacggccgggaggtgcacacggccgccagccagggacagcagcggaccattgcgctgtcgcttcggctcgccgagatcgatttcatgcacgaggagctcggcgagtatcccgtgctgctgctcgacgacgtcctgtccgaactcgacgatctccgccagcgcaacctcgtgcttgggatgagccgcaaggtgcagacggtcatcaccacgaccagcctcaatcggctcggccaggagctggacgatttccggctgttccgagtttgttctggtataatagccgaagaacgtgtctga

SEQ ID NO: 1669 - protein, 370 aa, Bacillus subtilis
MYIQNLELTSYRNYDHAELQFENKVNVIIGENAQGKTNLMEAIYVLSMAKSHRTSNDKELIRWDKDYAKIEGRVMKQNGAIPMQLVISKKGKKGKVNHIEQQKLSQYVGALNTIMFAPEDLNLVKGSPQVRRRFLDMEIGQVSPVYLHDLSLYQKILSQRNHFLKQLQTRKQTDRTMLDVLTDQLVEVAAKVVVKRLQFTAQLEKWAQPIHAGISRGLEELTLKYHTALDVSDPLDLSKIGDSYQEAFSKLREKEIERGVTLSGPHRDDVLFYVNGRDVQTYGSQGQQRTTALSLKLAEIDLIHEEIGEYPILLLDDVLSELDDYRQSHLLHTIQGRVQTFVTTTSVDGIDHETLRQAGMFRVQNGALVK

SEQ ID NO: 1670 - protein, 372 aa, Pediococcus pentosaceus
MYLKTLELHNFRNYADLVVEFGSGINVLLGENAQGKTNLLESIYFLALTRSHRTNSDRDLISWKTKAARVSGSVQKEHTVTPLEINLSSKGKNAKVNHLEQSRLSQYVGQLNVILFAPEDLSIVKGSPAVRRKFIDMEFGQMSSKYLYNSAQYRSVLKQRNQYIKQLQFNPKGDQVYLDVLSDQLAAHGAEIIFQRIQFLKKLEKWSQEVHKEISQGKEKLSFQYVSPISSDQADTTEKIYAALQALFQKQREKELQQGKTLVGPHLDDVRFMVNDKNVSTFGSQGQQRTTALSVKLAEIDLMKEETGEYPVLLLDDVLSELDDSRQTHLLTAIQNKVQTFITTTSLSGVAQQLINEPHVFNIDHGVLMQSK

SEQ ID NO: 1671 - protein, 370 aa, Bacillus licheniformis
MYIQNLTLSSYRNYERLDLQFENKVNVIIGENAQGKTNLMEAIYVLAMAKSHRTSNDKELIRWDEDYAKIEGRVIKKNGSVPIQLVISKKGKKGKVNHIEQQKLSQYVGAVNTIMFAPEDLNLVKGSPQVRRRFLDMEIGQVSPVYLHDLSLYQKILSQRNHFLKQLQTRKQTDQTMLDVLTEQLTEFAAKVVMKRLQFVDQLEKWAQPIHSGISRGLEELTLKYHTSLHVSDSPDLSKMINSYQETFSKLRDKEIERGVSLSGPHRDDVLFYVNGRDVQTYGSQGQQRTTALSLKLAEIDLIQEEIGEYPILLLDDVLSELDDYRQSHLLHTIQGRVQTFVTTTSVDGIDHKTLNEAEIFRVENGTLSD

SEQ ID NO: 1672 - protein, 364 aa, Paenibacillus larvae
MFLQRLTLHHYRNYQHVELVTDRNVNIFVGPNAQGKTNLLESIYVLALTKSHRTHHDKELIQWEGESALLQGDVEKKYGSYSLDLAISSKGKKAKINGLEQKKLSQFIGALNVVLFAPEDLEIIKGNPGIRRRFLDMEIGQVYPGYLYDLSQYQKVLAQRNNMLKKAFPAPSAEHAAMLDIWNEQLAQFGVKIMKKRQNFIKKLQNWAEQIHDGITNGGEELTIRYQPSFAVQDFEDETVLMEQFMIKLSQIKDQEIRRGVSLAGPHRDDLLFYINDKEVQTYGSQGQQRTTALSLKLAEIELIHSEVGEYPILLLDDVLSELDEYRQTQLIQTFQKKVQTFITTTGLESVHLDQLEDASVFRV

SEQ ID NO: 1673 - protein, 370 aa, Bacillus amyloliquefaciens
MYIQNLELTSYRNYERAELQFENKVNVIIGENAQGKTNLMEAIYVLSMAKSHRTSNDKELIRWDEDYAKIEGRVMKRNGDIPMQLVISKKGKKGKVNHIEQQKLSQYVGALNTIMFAPEDLNLVKGSPQVRRRFLDMEIGQVSAVYLYDLSLYQKILSQRNHFLKQLQSRKQTDRTMLDVLTDQLIEAAAKVVAKRLQFTAQLEKWAQPIHSGISRGLEELTLKYHTALDVSDPKDLSKIGNSYQESFSKLKEKEIERGVTLFGPHRDDVLFYVNGRDVQTYGSQGQQRTTALSLKLAEIDLIHEEIGEYPILLLDDVLSELDDYRQSHLLHTIQGRVQTFVTTTSVDGIDHDTLHQAGMFRVENGTLVK

SEQ ID NO: 1674 - protein, 371 aa, Artificial
  Alicyclobacillus acidocaldarius mutated SEQ ID NO 1667
MDIRRVELHDFRNYAKAEIELSPGVNVLVGENGQGKTNALEAMLLIAVGKSHRAHRDRDLIRWEQDRARILLEASTRYGDRRLTLELGPEGRRAFANGVQVGRMTEFVGQVQVVLFAPEDLDLVKGSPRVRRRFLDTELGQMEPLYLHHLSLYNRALLQRNRWLKTAPLSPDDDVLATFDRQIAFHGAHVIHRRLRFLARLRAYAARIYSDIASGREEFALAYRSSVSGVEEGMSVEEMADTVQRALEKNRAQDLRFGTTSAGPHRDDILLFLDGREVHTAASQGQQRTIALSLRLAEIDFMHEELGEYPVLLLDDVLSELDDLRQRNLVLGMSRKVQTVITTTSLNRLGQELEDFRLFRVCSGIIAEERV

SEQ ID NO: 1675 - protein, 371 aa, Artificial
  Alicyclobacillus acidocaldarius mutated SEQ ID NO 1667
MDIRRVELHDFRNYAKAEIELSPGVNVLVGENGQGKTNALEAMLLIAVGKSHRAHRDRDLIRWEQDRARILLEASTRYGDRRLTLELGPEGRRAFANGVQVGRMTEFVGQVQVVLFAPEDLDLVKGSPRVRRRFLDTELGQMEPLYLHHLSLYNRALLQRNRWLKTAPLSPDDDVLATFDRQIAFHGAHVIHRRLRFIARLRAYAARIYSDIASGREEFALAYRSSVSGVEEGMSVEEMADTVQRALEKNRAQDLRFGTTSAGPHRDDILLFLDGREVHTAASQGQQRTIALSLRLAEIDFMHEELGEYPVLLLDDVLSELDDLRQRNLVLGMSRKVQTVITTTSLNRLGQELDDFRLFRVCSGIIAEERV

SEQ ID NO: 1676 - protein, 371 aa, Artificial
  Alicyclobacillus acidocaldarius mutated SEQ ID NO 1667
MDIRRVELHDFRNYAKAEIELSPGVNVLVGENGQGKTNALEAMLLIAVGKSHRAHRDRDLIRWEQDRARILLEASTRYGDRRLTLELGPEGRRAFANGVQVGRMTEFVGQVQVVLFAPEDLDLVKGSPRVRRRFLDTELGQMEPLYLHHLSLYNRALLQRNRWLKTAPLSPDDDVLATFDRQIAFHGAHVIHRRLRFLARLRAYAAKIYSDIASGREEFALAYRSSVSGVEEGMSVEEMADTVQRALEKNRAQDLRFGTTSAGPHRDDILLFLDGREVHTAASQGQQRTIALSLRLAEIDFMHEELGEYPVLLLDDVLSELDDLRQRNLVLGMSRKVQTVITTTSLNRLGQELDDFRLFRVCSGIIAEERV

SEQ ID NO: 1677 - protein, 371 aa, Artificial
  Alicyclobacillus acidocaldarius mutated SEQ ID NO 1667
MDIRRVELHDFRNYAKAEIELSPGVNVLVGENGQGKTNALEAMLLIAVGKSHRAHRDRDLIRWENDRARILLEASTRYGDRRLTLELGPEGRRAFANGVQVGRMTEFVGQVQVVLFAPEDLDLVKGSPRVRRRFLDTELGQMEPLYLHHLSLYNRALLQRNRWLKTAPLSPDDDVLATFDRQIAFHGAHVIHRRLRFLARLRAYAARIYSDIASGREEFALAYRSSVSGVEEGMSVEEMADTVQRALEKNRAQDLRFGTTSAGPHRDDILLFLDGREVHTAASQGQQRTIALSLRLAEIDFMHEELGEYPVLLLDDVLSELDDLRQRNLVLGMSRKVQTVITTTSLNRLGQELDDFRLFRVCSGIIAEERV

SEQ ID NO: 1678 - protein, 371 aa, Artificial
  Alicyclobacillus acidocaldarius mutated SEQ ID NO 1667
MDIRRVDLHDFRNYAKAEIELSPGVNVLVGENGQGKTNALEAMLLIAVGKSHRAHRDRDLIRWEQDRARILLEASTRYGDRRLTLELGPEGRRAFANGVQVGRMTEFVGQVQVVLFAPEDLDLVKGSPRVRRRFLDTELGQMEPLYLHHLSLYNRALLQRNRWLKTAPLSPDDDVLATFDRQIAFHGAHVIHRRLRFLARLRAYAARIYSDIASGREEFALAYRSSVSGVEEGMSVEEMADTVQRALEKNRAQDLRFGTTSAGPHRDDILLFLDGREVHTAASQGQQRTIALSLRLAEIDFMHEELGEYPVLLLDDVLSELDDLRQRNLVLGMSRKVQTVITTTSLNRLGQELDDFRLFRVCSGIIAEERV

SEQ ID NO: 1679 - DNA, 1116 bp, Artificial
  Alicyclobacillus acidocaldarius mutated SEQ ID NO 1668
atggacatccgccgcgttgaactccacgactttcgcaactatgcgaaggccgagatcgagttgtcgccaggagtgaacgtgctcgtcggcgagaacggccagggaaagacgaacgccctggaagcgatgctgctcatcgccgtgggcaagtcgcacagggctcatcgggatcgcgatctcatccgctgggaacaggaccgcgcgcgcatcctgttggaggcctcgacgcggtacggagaccggcgcctgacgttggaactggggccagaggggcgcagggcgttcgccaacggcgttcaggtgggccggatgaccgagtttgtcggccaggtgcaggtggtgctctttgcgccggaggacctcgatctcgtcaagggcagtccccgcgttcggcgcaggtttctcgacacggaactgggacagatggagcccttgtatctccaccacctgagcctttacaatcgcgcgctcttgcagcgaaaccgctggctgaagaccgcaccgctgtctccggacgacgacgtgctcgccacgtttgaccgacagattgcctttcacggggcgcacgtgattcaccggcgcctccggtttctcgcgcggttgcgcgcatacgccgctcgcatctacagcgacatcgcgagcggccgggaagagtttgcgctcgcgtaccgaagttcggtctccggcgtcgaggaaggcatgagcgtggaggagatggcagacaccgtgcaacgcgcgctcgaaaaaaaccgggcgcaggatctgcgctttggcacgacgagcgccggcccccaccgggacgacatcctgctctttctcgacggccgggaggtgcacacggccgccagccagggacagcagcggaccattgcgctgtcgcttcggctcgccgagatcgatttcatgcacgaggagctcggcgagtatcccgtgctgctgctcgacgacgtcctgtccgaactcgacgatctccgccagcgcaacctcgtgcttgggatgagccgcaaggtgcagacggtcatcaccacgaccagcctcaatcggctcggccaggagctggaagatttccggctgttccgagtttgttctggtataatagccgaagaacgtgtctga

SEQ ID NO: 1680 - DNA, 1116 bp, Artificial
  Alicyclobacillus acidocaldarius mutated SEQ ID NO 1668
atggacatccgccgcgttgaactccacgactttcgcaactatgcgaaggccgagatcgagttgtcgccaggagtgaacgtgctcgtcggcgagaacggccagggaaagacgaacgccctggaagcgatgctgctcatcgccgtgggcaagtcgcacagggctcatcgggatcgcgatctcatccgctgggaacaggaccgcgcgcgcatcctgttggaggcctcgacgcggtacggagaccggcgcctgacgttggaactggggccagaggggcgcagggcgttcgccaacggcgttcaggtgggccggatgaccgagtttgtcggccaggtgcaggtggtgctctttgcgccggaggacctcgatctcgtcaagggcagtccccgcgttcggcgcaggtttctcgacacggaactgggacagatggagcccttgtatctccaccacctgagcctttacaatcgcgcgctcttgcagcgaaaccgctggctgaagaccgcaccgctgtctccggacgacgacgtgctcgccacgtttgaccgacagattgcctttcacggggcgcacgtgattcaccggcgcctccggtttattgcgcggttgcgcgcatacgccgctcgcatctacagcgacatcgcgagcggccgggaagagtttgcgctcgcgtaccgaagttcggtctccggcgtcgaggaaggcatgagcgtggaggagatggcagacaccgtgcaacgcgcgctcgaaaaaaaccgggcgcaggatctgcgctttggcacgacgagcgccggcccccaccgggacgacatcctgctctttctcgacggccgggaggtgcacacggccgccagccagggacagcagcggaccattgcgctgtcgcttcggctcgccgagatcgatttcatgcacgaggagctcggcgagtatcccgtgctgctgctcgacgacgtcctgtccgaactcgacgatctccgccagcgcaacctcgtgcttgggatgagccgcaaggtgcagacggtcatcaccacgaccagcctcaatcggctcggccaggagctggacgatttccggctgttccgagtttgttctggtataatagccgaagaacgtgtctga

SEQ ID NO: 1681 - DNA, 1116 bp, Artificial
  Alicyclobacillus acidocaldarius mutated SEQ ID NO 1668
atggacatccgccgcgttgaactccacgactttcgcaactatgcgaaggccgagatcgagttgtcgccaggagtgaacgtgctcgtcggcgagaacggccagggaaagacgaacgccctggaagcgatgctgctcatcgccgtgggcaagtcgcacagggctcatcgggatcgcgatctcatccgctgggaacaggaccgcgcgcgcatcctgttggaggcctcgacgcggtacggagaccggcgcctgacgttggaactggggccagaggggcgcagggcgttcgccaacggcgttcaggtgggccggatgaccgagtttgtcggccaggtgcaggtggtgctctttgcgccggaggacctcgatctcgtcaagggcagtccccgcgttcggcgcaggtttctcgacacggaactgggacagatggagcccttgtatctccaccacctgagcctttacaatcgcgcgctcttgcagcgaaaccgctggctgaagaccgcaccgctgtctccggacgacgacgtgctcgccacgtttgaccgacagattgcctttcacggggcgcacgtgattcaccggcgcctccggtttctcgcgcggttgcgcgcatacgccgctaaaatctacagcgacatcgcgagcggccgggaagagtttgcgctcgcgtaccgaagttcggtctccggcgtcgaggaaggcatgagcgtggaggagatggcagacaccgtgcaacgcgcgctcgaaaaaaaccgggcgcaggatctgcgctttggcacgacgagcgccggcccccaccgggacgacatcctgctctttctcgacggccgggaggtgcacacggccgccagccagggacagcagcggaccattgcgctgtcgcttcggctcgccgagatcgatttcatgcacgaggagctcggcgagtatcccgtgctgctgctcgacgacgtcctgtccgaactcgacgatctccgccagcgcaacctcgtgcttgggatgagccgcaaggtgcagacggtcatcaccacgaccagcctcaatcggctcggccaggagctggacgatttccggctgttccgagtttgttctggtataatagccgaagaacgtgtctga

SEQ ID NO: 1682 - DNA, 1116 bp, Artificial
  Alicyclobacillus acidocaldarius mutated SEQ ID NO 1668
atggacatccgccgcgttgaactccacgactttcgcaactatgcgaaggccgagatcgagttgtcgccaggagtgaacgtgctcgtcggcgagaacggccagggaaagacgaacgccctggaagcgatgctgctcatcgccgtgggcaagtcgcacagggctcatcgggatcgcgatctcatccgctgggaaaatgaccgcgcgcgcatcctgttggaggcctcgacgcggtacggagaccggcgcctgacgttggaactggggccagaggggcgcagggcgttcgccaacggcgttcaggtgggccggatgaccgagtttgtcggccaggtgcaggtggtgctctttgcgccggaggacctcgatctcgtcaagggcagtccccgcgttcggcgcaggtttctcgacacggaactgggacagatggagcccttgtatctccaccacctgagcctttacaatcgcgcgctcttgcagcgaaaccgctggctgaagaccgcaccgctgtctccggacgacgacgtgctcgccacgtttgaccgacagattgcctttcacggggcgcacgtgattcaccggcgcctccggtttctcgcgcggttgcgcgcatacgccgctcgcatctacagcgacatcgcgagcggccgggaagagtttgcgctcgcgtaccgaagttcggtctccggcgtcgaggaaggcatgagcgtggaggagatggcagacaccgtgcaacgcgcgctcgaaaaaaaccgggcgcaggatctgcgctttggcacgacgagcgccggcccccaccgggacgacatcctgctctttctcgacggccgggaggtgcacacggccgccagccagggacagcagcggaccattgcgctgtcgcttcggctcgccgagatcgatttcatgcacgaggagctcggcgagtatcccgtgctgctgctcgacgacgtcctgtccgaactcgacgatctccgccagcgcaacctcgtgcttgggatgagccgcaaggtgcagacggtcatcaccacgaccagcctcaatcggctcggccaggagctggacgatttccggctgttccgagtttgttctggtataatagccgaagaacgtgtctga

SEQ ID NO: 1683 - DNA, 1116 bp, Artificial
  Alicyclobacillus acidocaldarius mutated SEQ ID NO 1668
atggacatccgccgcgttgatctccacgactttcgcaactatgcgaaggccgagatcgagttgtcgccaggagtgaacgtgctcgtcggcgagaacggccagggaaagacgaacgccctggaagcgatgctgctcatcgccgtgggcaagtcgcacagggctcatcgggatcgcgatctcatccgctgggaacaggaccgcgcgcgcatcctgttggaggcctcgacgcggtacggagaccggcgcctgacgttggaactggggccagaggggcgcagggcgttcgccaacggcgttcaggtgggccggatgaccgagtttgtcggccaggtgcaggtggtgctctttgcgccggaggacctcgatctcgtcaagggcagtccccgcgttcggcgcaggtttctcgacacggaactgggacagatggagcccttgtatctccaccacctgagcctttacaatcgcgcgctcttgcagcgaaaccgctggctgaagaccgcaccgctgtctccggacgacgacgtgctcgccacgtttgaccgacagattgcctttcacggggcgcacgtgattcaccggcgcctccggtttctcgcgcggttgcgcgcatacgccgctcgcatctacagcgacatcgcgagcggccgggaagagtttgcgctcgcgtaccgaagttcggtctccggcgtcgaggaaggcatgagcgtggaggagatggcagacaccgtgcaacgcgcgctcgaaaaaaaccgggcgcaggatctgcgctttggcacgacgagcgccggcccccaccgggacgacatcctgctctttctcgacggccgggaggtgcacacggccgccagccagggacagcagcggaccattgcgctgtcgcttcggctcgccgagatcgatttcatgcacgaggagctcggcgagtatcccgtgctgctgctcgacgacgtcctgtccgaactcgacgatctccgccagcgcaacctcgtgcttgggatgagccgcaaggtgcagacggtcatcaccacgaccagcctcaatcggctcggccaggagctggacgatttccggctgttccgagtttgttctggtataatagccgaagaacgtgtctga

SEQ ID NO: 1684 - protein, 180 aa, Alicyclobacillus acidocaldarius
MRIPQDHRPTFLKIIGMNSPPPCRIVAPVIRSWEVPVMREDERMEIRQLYEAGVSISELARRFGYDRKTIRNALNSSVEEKQGERASRGERKRGSKLEPYKDYVKQRMQLGVLNAERILREIREQGYTGGITVLREFMKPLRPVVSAKATERYESDPGEQAQIDLGAFPYYDSHGQRRTI

SEQ ID NO: 1685 - DNA, 543 bp, Alicyclobacillus acidocaldarius
atgagaattccccaagatcatcggcctacattcctcaaaatcatcgggatgaattccccacccccgtgtcgaatcgtggcacctgtcatccgttcatgggaggtgcccgtcatgagggaggacgagaggatggaaatcaggcaactctacgaggcaggcgtcagcatctcggaactggccagaagattcggctatgaccgaaagaccattcgcaacgcactgaattcatcggtggaggagaagcagggcgaaagagcgtcgcgtggggagcgaaagaggggttccaagctggagccctacaaggactatgtgaagcaacgcatgcaactcggtgttctcaacgctgaacgaattctgcgagagattcgggagcagggctataccggcggtatcaccgtcctacgtgagttcatgaagccacttcgcccggtggtctctgccaaggccacggaacgctatgagtcggaccctggtgaacaagcccagatcgatttgggggccttcccctactacgattcgcacggtcagcgacgaacgatttag

SEQ ID NO: 1686 - protein, 135 aa, Symbiobacterium thermophilum
MLRSGETLEIRQMYAGGLSISEIARRTGRDRKTIRKWLRTNTMPKPAKRKRSSMLDQHEAFTLEQMQKGVTSASKMLYLLQQRGFKGKIRIVRAFMAPYRPMAKAAATVRFETPPGKQAQVDWADFGYIEVDGRR

SEQ ID NO: 1687 - protein, 115 aa, Geobacillus stearothermophilus
IKEMYERGMSISDIARELGIDRKTVRKYIHSPNPPSKSKRKQRKSKLDPFKPYLQKRMLEDGVFNSEKLFFEIRQQGYTGGKTILKDYMKPFRETAKKKYTVRYETLPGEQMQVD

SEQ ID NO: 1688 - protein, 115 aa, Geobacillus stearothermophilus; identical to SEQ ID NO: 1687

SEQ ID NO: 1689 - protein, 123 aa, Symbiobacterium thermophilum
MYAAGLSISEIARRTGRDRKTIRKWLRTNAMPKPAKRKRSSMLDQHKAFILEQMQKGVTNASKMLYLLQQRGFKGKIRIVRAFMAPYRPMAKAAATVRFETPPGKQAQVDWADFGYIEVDGRR

SEQ ID NO: 1690 - protein, 122 aa, Carboxydothermus hydrogenoformans
LHELQARGKSIRAIARETGHSRNTVRKYLRAEGIPERKPRPKRGSKLDPYKDTIQELMNLGIFNCEVIYERIKEEGYTGGRTILRDYVRQFRPPKQVPAVCRYETKPGQQAQVDWGEYTYID

SEQ ID NO: 1691 - protein, 180 aa, Artificial
  Alicyclobacillus acidocaldarius mutated SEQ ID NO 1684
MRIPQDHRPTFLKIIGMNSPPPCRIVAPVIRSWEVPVMREDERMEIRQLYEAGVSISELARRFGYDRKTIRNALNSSVEEKQGERASRGERKRGSKLEPYKDYVKQRMQLGVLNAERILREIREQGYTGGITVLREFMKPLRPVVSARATERYESDPGEQAQIDLGAFPYYDSHGQRRTI

SEQ ID NO: 1692 - protein, 180 aa, Artificial
  Alicyclobacillus acidocaldarius mutated SEQ ID NO 1684
MRIPQDHRPTFLKIIGMNSPPPCRIVAPVIKSWEVPVMREDERMEIRQLYEAGVSISELARRFGYDRKTIRNALNSSVEEKQGERASRGERKRGSKLEPYKDYVKQRMQLGVLNAERILREIREQGYTGGITVLREFMKPLRPVVSAKATERYESDPGEQAQIDLGAFPYYDSHGQRRTI

SEQ ID NO: 1693 - protein, 180 aa, Artificial
  Alicyclobacillus acidocaldarius mutated SEQ ID NO 1684
MRIPQDHRPTFLKIIGMNSPPPCRIVAPVIRSWEVPVMREDERMEIRQLYEAGVSISELARRFGYDRKTIRNALNSSVEEKQGERASRGERKRGSKLEPYKDYVKQRMQLGVLNAERILREIREQGYTGGITVLREFMKPLRPIVSAKATERYESDPGEQAQIDLGAFPYYDSHGQRRTI

SEQ ID NO: 1694 - protein, 180 aa, Artificial
  Alicyclobacillus acidocaldarius mutated SEQ ID NO 1684
MRIPQDHRPTFLKIIGMNSPPPCRIVAPVIRSWEVPVMREDERMEIRQLYEAGVSISELARRFGYDRKTIRNALNSSVEEKQGERASRGERKRGSKLEPYKDYVKQRMQLGVLNAERILREIREQGYTGGITVLREFMKPLRPVVSAKATERYESDPGEQAQIDLGAFPYYDSHGQRRTL

SEQ ID NO: 1695 - protein, 180 aa, Artificial
  Alicyclobacillus acidocaldarius mutated SEQ ID NO 1684
MRIPQDHRPTFLKIIGMNSPPPCRIVAPVIRSWEVPVMREDERMEIRQLYEAGVSISELARRFGYDRKTIRNALNSSVEEKQGDRASRGERKRGSKLEPYKDYVKQRMQLGVLNAERILREIREQGYTGGITVLREFMKPLRPVVSAKATERYESDPGEQAQIDLGAFPYYDSHGQRRTI

SEQ ID NO: 1696 - DNA, 543 bp, Artificial
  Alicyclobacillus acidocaldarius mutated SEQ ID NO 1685
atgagaattccccaagatcatcggcctacattcctcaaaatcatcgggatgaattccccacccccgtgtcgaatcgtggcacctgtcatccgttcatgggaggtgcccgtcatgagggaggacgagaggatggaaatcaggcaactctacgaggcaggcgtcagcatctcggaactggccagaagattcggctatgaccgaaagaccattcgcaacgcactgaattcatcggtggaggagaagcagggcgaaagagcgtcgcgtggggagcgaaagaggggttccaagctggagccctacaaggactatgtgaagcaacgcatgcaactcggtgttctcaacgctgaacgaattctgcgagagattcgggagcagggctataccggcggtatcaccgtcctacgtgagttcatgaagccacttcgcccggtggtctctgcccgtgccacggaacgctatgagtcggaccctggtgaacaagcccagatcgatttgggggccttcccctactacgattcgcacggtcagcgacgaacgatttag

SEQ ID NO: 1697 - DNA, 543 bp, Artificial
  Alicyclobacillus acidocaldarius mutated SEQ ID NO 1685
atgagaattccccaagatcatcggcctacattcctcaaaatcatcgggatgaattccccacccccgtgtcgaatcgtggcacctgtcatcaaatcatgggaggtgcccgtcatgagggaggacgagaggatggaaatcaggcaactctacgaggcaggcgtcagcatctcggaactggccagaagattcggctatgaccgaaagaccattcgcaacgcactgaattcatcggtggaggagaagcagggcgaaagagcgtcgcgtggggagcgaaagaggggttccaagctggagccctacaaggactatgtgaagcaacgcatgcaactcggtgttctcaacgctgaacgaattctgcgagagattcgggagcagggctataccggcggtatcaccgtcctacgtgagttcatgaagccacttcgcccggtggtctctgccaaggccacggaacgctatgagtcggaccctggtgaacaagcccagatcgatttgggggccttcccctactacgattcgcacggtcagcgacgaacgatttag

SEQ ID NO: 1698 - DNA, 543 bp, Artificial
  Alicyclobacillus acidocaldarius mutated SEQ ID NO 1685
atgagaattccccaagatcatcggcctacattcctcaaaatcatcgggatgaattccccacccccgtgtcgaatcgtggcacctgtcatccgttcatgggaggtgcccgtcatgagggaggacgagaggatggaaatcaggcaactctacgaggcaggcgtcagcatctcggaactggccagaagattcggctatgaccgaaagaccattcgcaacgcactgaattcatcggtggaggagaagcagggcgaaagagcgtcgcgtggggagcgaaagaggggttccaagctggagccctacaaggactatgtgaagcaacgcatgcaactcggtgttctcaacgctgaacgaattctgcgagagattcgggagcagggctataccggcggtatcaccgtcctacgtgagttcatgaagccacttcgcccgattgtctctgccaaggccacggaacgctatgagtcggaccctggtgaacaagcccagatcgatttgggggccttcccctactacgattcgcacggtcagcgacgaacgatttag

SEQ ID NO: 1699 - DNA, 543 bp, Artificial
  Alicyclobacillus acidocaldarius mutated SEQ ID NO 1685
atgagaattccccaagatcatcggcctacattcctcaaaatcatcgggatgaattccccacccccgtgtcgaatcgtggcacctgtcatccgttcatgggaggtgcccgtcatgagggaggacgagaggatggaaatcaggcaactctacgaggcaggcgtcagcatctcggaactggccagaagattcggctatgaccgaaagaccattcgcaacgcactgaattcatcggtggaggagaagcagggcgaaagagcgtcgcgtggggagcgaaagaggggttccaagctggagccctacaaggactatgtgaagcaacgcatgcaactcggtgttctcaacgctgaacgaattctgcgagagattcgggagcagggctataccggcggtatcaccgtcctacgtgagttcatgaagccacttcgcccggtggtctctgccaaggccacggaacgctatgagtcggaccctggtgaacaagcccagatcgatttgggggccttcccctactacgattcgcacggtcagcgacgaacgttatag

SEQ ID NO: 1700 - DNA, 543 bp, Artificial
  Alicyclobacillus acidocaldarius mutated SEQ ID NO 1685
atgagaattccccaagatcatcggcctacattcctcaaaatcatcgggatgaattccccacccccgtgtcgaatcgtggcacctgtcatccgttcatgggaggtgcccgtcatgagggaggacgagaggatggaaatcaggcaactctacgaggcaggcgtcagcatctcggaactggccagaagattcggctatgaccgaaagaccattcgcaacgcactgaattcatcggtggaggagaagcagggcgatagagcgtcgcgtggggagcgaaagaggggttccaagctggagccctacaaggactatgtgaagcaacgcatgcaactcggtgttctcaacgctgaacgaattctgcgagagattcgggagcagggctataccggcggtatcaccgtcctacgtgagttcatgaagccacttcgcccggtggtctctgccaaggccacggaacgctatgagtcggaccctggtgaacaagcccagatcgatttgggggccttcccctactacgattcgcacggtcagcgacgaacgatttag

SEQ ID NO: 1701 - protein, 88 aa, Alicyclobacillus acidocaldarius
MVLAYSRMLYVEFIKAADQLHILQALRNALEFFGGVPRVMLSDNCSPLVVANDGQGHVDCNRLISILPSSTDSCPRHVGLAGAAPRAR

SEQ ID NO: 1702 - DNA, 267 bp, Alicyclobacillus acidocaldarius
atggtactcgcctactcccgcatgctctacgttgagtttatcaaagcggcagaccagctgcacatccttcaggcccttcgcaacgccctggagttctttggcggtgtgccgcgcgtcatgctcagcgacaactgttcacctttggtggtcgccaatgacggtcaaggccatgtcgactgcaaccggcttatctcgattttgccaagttctacggattcgtgcccaaggcatgtcggcctcgccggagccgcaccaagggcaaggtag

SEQ ID NO: 1703 - protein, 53 aa, Symbiobacterium thermophilum
MVLAYSRAMYLEFVTATDMKTFMRCHINAFKFFGGVPHEILYDNVKTVVKDRD

SEQ ID NO: 1704 - protein, 56 aa, Deinococcus geothermalis
MVLGWSRALYVEFIRKADTASFIRCHLNAFAYFGGMTQSILYDNTKQVVLERDETG

SEQ ID NO: 1705 - protein, 52 aa, Salmonella enterica
VLGYSRMLYIEFTDNMRYDTLETCHRNAFRFFGGVPREVLYDNMKTVVLQRD

SEQ ID NO: 1706 - protein, 52 aa, Escherichia c1li; identical to SEQ ID NO: 1705

SEQ ID NO: 1707 - protein, 52 aa, Yersinia pestis; identical to SEQ ID NO: 1705

SEQ ID NO: 1708 - protein, 88 aa, Artificial
  Alicyclobacillus acidocaldarius mutated SEQ ID NO 1701
MVLAYSRMLYVEFIKAADQLHILQALRNALEFFGGVPRVMLSDNCSPLVVANDGQGHIDCNRLISILPSSTDSCPRHVGLAGAAPRAR

SEQ ID NO: 1709 - protein, 88 aa, Artificial
  Alicyclobacillus acidocaldarius mutated SEQ ID NO 1701
MVLAYSRMLYVEFIKAADQLHILQALRNALEFFGGVPRVMLSDNCSPLVVANDGQGHVECNRLISILPSSTDSCPRHVGLAGAAPRAR

SEQ ID NO: 1710 - protein, 88 aa, Artificial
  Alicyclobacillus acidocaldarius mutated SEQ ID NO 1701
MVLAYSRMLYVEFIKAADQLHILNALRNALEFFGGVPRVMLSDNCSPLVVANDGQGHVDCNRLISILPSSTDSCPRHVGLAGAAPRAR

SEQ ID NO: 1711 - protein, 88 aa, Artificial
  Alicyclobacillus acidocaldarius mutated SEQ ID NO 1701
MVLAYSRMLYVEFIKAADQLHILQALRNALEFFGGVPRVMLSDNCSPLVVANDGQGHVDCNRIISILPSSTDSCPRHVGLAGAAPRAR

SEQ ID NO: 1712 - protein, 88 aa, Artificial
  Alicyclobacillus acidocaldarius mutated SEQ ID NO 1701
MVLAYSRMLYVEFIKAADQLHILQALRNALEFFGGVPRVMLSDNCSPLVVANDGQGHVDCNRLISLLPSSTDSCPRHVGLAGAAPRAR

SEQ ID NO: 1713 - DNA, 267 bp, Artificial
  Alicyclobacillus acidocaldarius mutated SEQ ID NO 1702
atggtactcgcctactcccgcatgctctacgttgagtttatcaaagcggcagaccagctgcacatccttcaggcccttcgcaacgccctggagttctttggcggtgtgccgcgcgtcatgctcagcgacaactgttcacctttggtggtcgccaatgacggtcaaggccatattgactgcaaccggcttatctcgattttgccaagttctacggattcgtgcccaaggcatgtcggcctcgccggagccgcaccaagggcaaggtag

SEQ ID NO: 1714 - DNA, 267 bp, Artificial
  Alicyclobacillus acidocaldarius mutated SEQ ID NO 1702
atggtactcgcctactcccgcatgctctacgttgagtttatcaaagcggcagaccagctgcacatccttcaggcccttcgcaacgccctggagttctttggcggtgtgccgcgcgtcatgctcagcgacaactgttcacctttggtggtcgccaatgacggtcaaggccatgtcgaatgcaaccggcttatctcgattttgccaagttctacggattcgtgcccaaggcatgtcggcctcgccggagccgcaccaagggcaaggtag

SEQ ID NO: 1715 - DNA, 267 bp, Artificial
  Alicyclobacillus acidocaldarius mutated SEQ ID NO 1702
atggtactcgcctactcccgcatgctctacgttgagtttatcaaagcggcagaccagctgcacatccttaatgcccttcgcaacgccctggagttctttggcggtgtgccgcgcgtcatgctcagcgacaactgttcacctttggtggtcgccaatgacggtcaaggccatgtcgactgcaaccggcttatctcgattttgccaagttctacggattcgtgcccaaggcatgtcggcctcgccggagccgcaccaagggcaaggtag

SEQ ID NO: 1716 - DNA, 267 bp, Artificial
  Alicyclobacillus acidocaldarius mutated SEQ ID NO 1702
atggtactcgcctactcccgcatgctctacgttgagtttatcaaagcggcagaccagctgcacatccttcaggcccttcgcaacgccctggagttctttggcggtgtgccgcgcgtcatgctcagcgacaactgttcacctttggtggtcgccaatgacggtcaaggccatgtcgactgcaaccggattatctcgattttgccaagttctacggattcgtgcccaaggcatgtcggcctcgccggagccgcaccaagggcaaggtag

SEQ ID NO: 1717 - DNA, 267 bp, Artificial
  Alicyclobacillus acidocaldarius mutated SEQ ID NO 1702
atggtactcgcctactcccgcatgctctacgttgagtttatcaaagcggcagaccagctgcacatccttcaggcccttcgcaacgccctggagttctttggcggtgtgccgcgcgtcatgctcagcgacaactgttcacctttggtggtcgccaatgacggtcaaggccatgtcgactgcaaccggcttatctcgttattgccaagttctacggattcgtgcccaaggcatgtcggcctcgccggagccgcaccaagggcaaggtag

SEQ ID NO: 1718 - protein, 107 aa, Alicyclobacillus acidocaldarius
MTNTKSRRHATMASLNSFAVLEWIRKMQDVDQIDFLRELMQLVTQFLIDAEAAEKIGAERYERTESRVTQRNGYRSRAWDTRLGTVDLKIPKLRQGSFFPSILEPRR

SEQ ID NO: 1719 - DNA, 324 bp, Alicyclobacillus acidocaldarius
gtgaccaacaccaaaagtaggaggcacgcaacgatggcttcgctcaatagcttcgcagttctcgaatggattcgcaagatgcaagacgtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgttga

SEQ ID NO: 1720 - protein, 101 aa, Symbiobacterium thermophilum
SRRRIPQVTTFRIALEELLRKTGVDDFDFLREGLRVLAQGLMELEVSQRIGADRYERSAERSTYRNGYRERQWDTRVGTIDLQIPKLRKGSYMPSFLEPRR

SEQ ID NO: 1721 - protein, 87 aa, Symbiobacterium thermophilum
LEELLRKTGVDDFDFLREGLRVLAQGLMELEVSQRIGADRYERSAERSTYRNGYRERQWDTRVGTIDLQIPKLRKGSYMPSFLEPRR

SEQ ID NO: 1722 - protein, 104 aa, Symbiobacterium thermophilum
SNTSQRGNPQVTNFRIALEELLRKSGVDDVDFLREGVRVLAQGLMELEVSQQIGAERYERSSERSNYRNGYRERQWDTRVGTIDLQIPKLRKGSYMPSWLEPRR

SEQ ID NO: 1723 - protein, 96 aa, Clostridium thermocellum
MATNNRMALLEQLSKYVVEKDKDFLKEALTLLINALMDAEVTSIIGAEKYERNNNRNNYRNGYRLREWDTRVGTLQLSIPKLRHGSYFPSLLEPRK

SEQ ID NO: 1724 - protein, 96 aa, Clostridium thermocellum; identical to SEQ ID NO: 1723

SEQ ID NO: 1725 - protein, 107 aa, Artificial
  Alicyclobacillus acidocaldarius mutated SEQ ID NO 1718
MTNTKSRRHATMASLNSFAVLEWIRKMQEVDQIDFLRELMQLVTQFLIDAEAAEKIGAERYERTESRVTQRNGYRSRAWDTRLGTVDLKIPKLRQGSFFPSILEPRR

SEQ ID NO: 1726 - protein, 107 aa, Artificial
  Alicyclobacillus acidocaldarius mutated SEQ ID NO 1718
MTNTKSRRHATMASLNSFAVLEWIRKMQDVDQIDFLREIMQLVTQFLIDAEAAEKIGAERYERTESRVTQRNGYRSRAWDTRLGTVDLKIPKLRQGSFFPSILEPRR

SEQ ID NO: 1727 - protein, 107 aa, Artificial
  Alicyclobacillus acidocaldarius mutated SEQ ID NO 1718
MTNTKSRKHATMASLNSFAVLEWIRKMQDVDQIDFLRELMQLVTQFLIDAEAAEKIGAERYERTESRVTQRNGYRSRAWDTRLGTVDLKIPKLRQGSFFPSILEPRR

SEQ ID NO: 1728 - protein, 107 aa, Artificial
  Alicyclobacillus acidocaldarius mutated SEQ ID NO 1718
MTNTKSRRHATMASLNSFAVLEWIRKMQDVDQIDFLRELMNLVTQFLIDAEAAEKIGAERYERTESRVTQRNGYRSRAWDTRLGTVDLKIPKLRQGSFFPSILEPRR

SEQ ID NO: 1729 - protein, 107 aa, Artificial
  Alicyclobacillus acidocaldarius mutated SEQ ID NO 1718
MTNTKSRRHATMASLNSFAVLEWIRKMQDVDQLDFLRELMQLVTQFLIDAEAAEKIGAERYERTESRVTQRNGYRSRAWDTRLGTVDLKIPKLRQGSFFPSILEPRR

SEQ ID NO: 1730 - DNA, 324 bp, Artificial
  Alicyclobacillus acidocaldarius mutated SEQ ID NO 1719
gtgaccaacaccaaaagtaggaggcacgcaacgatggcttcgctcaatagcttcgcagttctcgaatggattcgcaagatgcaagaagtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgttga

SEQ ID NO: 1731 - DNA, 324 bp, Artificial
  Alicyclobacillus acidocaldarius mutated SEQ ID NO 1719
gtgaccaacaccaaaagtaggaggcacgcaacgatggcttcgctcaatagcttcgcagttctcgaatggattcgcaagatgcaagacgtggatcagatcgattttttacgggaaattatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgttga

SEQ ID NO: 1732 - DNA, 324 bp, Artificial
  Alicyclobacillus acidocaldarius mutated SEQ ID NO 1719
gtgaccaacaccaaaagtaggaaacacgcaacgatggcttcgctcaatagcttcgcagttctcgaatggattcgcaagatgcaagacgtggatcagatcgattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgttga

SEQ ID NO: 1733 - DNA, 324 bp, Artificial
  Alicyclobacillus acidocaldarius mutated SEQ ID NO 1719
gtgaccaacaccaaaagtaggaggcacgcaacgatggcttcgctcaatagcttcgcagttctcgaatggattcgcaagatgcaagacgtggatcagatcgattttttacgggaattgatgaatctcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgttga

SEQ ID NO: 1734 - DNA, 324 bp, Artificial
  Alicyclobacillus acidocaldarius mutated SEQ ID NO 1719
gtgaccaacaccaaaagtaggaggcacgcaacgatggcttcgctcaatagcttcgcagttctcgaatggattcgcaagatgcaagacgtggatcagttagattttttacgggaattgatgcaactcgtgacgcagttcctcatcgatgcggaagccgcagagaaaatcggtgccgagcgctatgagcggacggagagccgtgtcacacaacgaaacggctatcgttcaagggcctgggacacgcgcctcgggacggtcgatttgaagattccaaagctccgtcagggcagcttcttcccttccattctggagcccaggcgttga

SEQ ID NO: 1735 - protein, 338 aa, Alicyclobacillus acidocaldarius
MLEMGSKGRKNGIQVSSLIATGSSAHARREVKRMKRHESPPTLTHGDKIYFPAAGLCKRDYMTYLAQIGEHLVRHLRHRPVTLVRCPDGVAGRRFYQRHLPPHAPPSLPRREVQGERPLIAIPDVETLLYYGNLGAIEFHAGLHLVQGPQAGCPTALTFDLDPSDPRDFERVRELALCLREVLRGLGLDGVAKTTGASGLQVLVPLEEPLPYAVTRPVVNFVAAYCASRWPDLATTERRVRHRGRRVYVDAPQHGPTRTLIAAYSVRAVEKALVSAPITWAELEYGVSPDAFDLHVVPDRLERVGDWLELAARHPASRVRAIHDALPPPWRQTRVRSV

SEQ ID NO: 1736 - DNA, 1017 bp, Alicyclobacillus acidocaldarius
gtgcttgaaatgggttcgaaaggccgaaagaacggcatccaggtttcctccctgatagcgacgggttcgtctgcgcacgctaggcgagaggtgaagcgcatgaagcgccatgaaagtccgccgacgctcacccatggggacaagatctacttccctgccgcggggctctgcaagcgcgactatatgacctatcttgcccaaatcggcgagcacttggtccgacatctgcgccatcggcccgtcacgttggttcggtgcccggacggcgtggccggccgccgattttatcagcggcatcttccgccacacgcacctccgagcctgccgcgcagagaggtccaaggcgaacgcccgttgattgccatcccggacgtcgagacgctcttatactacggaaacttgggcgccatcgagttccacgcgggtctgcatctcgtccaaggtcctcaagcgggatgcccgacggcgctcacgttcgatctcgacccttccgatccgcgcgacttcgagcgcgtgcgagagctcgcgctgtgcctgcgcgaggtgcttcgcggcctcggcctcgacggcgtggcgaagaccacgggggcgtccggcctgcaggtgttggtcccgcttgaggagccgctcccgtacgccgtcacgcggccggtggtcaacttcgtcgcggcgtactgtgcgtcgcgctggccggatctggccaccaccgagaggcgcgtgcgccatcggggccgccgggtgtacgtggacgcgccgcagcacgggccgacgcgcacgctgatcgcggcgtacagcgtgcgcgcggtggagaaagcgctggtgtcggcgcccatcacatgggcagaactggaatacggggtgtcgcccgacgcgtttgatctccacgtggtgcctgacagattggagcgggtgggcgattggctggagctcgcggcgcgtcaccccgcctctcgcgtacgggccatccacgacgcgctccccccgccttggcgacaaacgcgcgtccgttcagtataa

SEQ ID NO: 1737 - protein, 281 aa, Anaeromyxobacter  K
DKVFYPEAGFTKGEVVDYYRRVAPVLLPHLRDRPLTLKRYPEGVDGPHFYEKRCPRHRPDWFRTEAIWSEGNQDYIDYCVVDDLSSLVWLASIADLELHPSLSLVDDVERPTALVFDLDPGPPADLLACCEVALLLRRLLAALGLEAFPKGSGSKGMQLYVPLSGATYADTKPFAHAVARLLERRHPQLVVERMAKALRGGKVLVDWSQNDPHKTTVCVYSLRARPRPTVSTPLRWAEVEKAVRTRDAGGLVFEAAAVLRRVERVGDLFAPVLTLRQRLPA

SEQ ID NO: 1738 - protein, 281 aa, Anaeromyxobacter dehalogenans
DKVFYPEAGFTKGEVVDYYRRVAPVLLPHLRDRPLTLKRYPEGVEGPHFYEKRCPRHRPDWFRTEAIWSEGNQEYIDYCVVDDLSSLVWLASIADLELHPSLSLVDDVERPTALVFDLDPGPPADLLACCEVALLLRRLLAALGLEAFPKSSGSKGMQLYVPLSGATYADTKPFAHAVARLLERRHPQLVVERMAKALRGGKVLVDWSQNDPHKTTVCVYSLRARPRPTVSTPLRWAEVEKAARTRDAGGLVFEAAAVLRRVERVGDLFAPVLTLRQRLPA

SEQ ID NO: 1739 - protein, 273 aa, Syntrophomonas wolfei
AMAGREIKLTNLDRVLWPEDGYCKRDLVEYYTAIFPYMLPHLSERPLVFTRYPRGIGEKSFYQKNAPEGLPQWIKTFTWAGSDGDSKNYVLVQQTVDLMWLANLACIEIHPWLSQINSIEYPDFIVFDLDPSEQSTFEQVISVARLLHELMDSLSLRVYPKTSGAKGLHLYLPIAEGFTYSQIRRVAQAMAEMVCQVIPDIATTERALKHRGPRVYLDYLQNGLGKTVCAAYSVRPHKGAPCSTPIEWQELESIRPDQFTIKTLPERLQQVGD

SEQ ID NO: 1740 - protein, 281 aa, Anaeromyxobacter dehalogenans
DKVFYPEAGFTKGEVVDYYRRVAPVLLPHLRDRPLTLKRYPEGVDGPHFYEKRCPRHRPDWFRTEAIWSEGNQDYIDYCVVDDLSSLVWLASIADLELHPSLSRVDDVERPTALVFDLDPGPPAELLACCEVALLLRRLLAALGLEAFPKSSGSKGMQLYVPLSGATYADTKPFAHAVARVLERRHPQLVVERMAKALRGGKVLVDWSQNDPHKTTVCVYSLRARPRPTVSTPLRWAEVEKAVRTRDAGGLVFEAGAVLRRVERVGDLFAPVLTLRQRLPA

SEQ ID NO: 1741 - protein, 259 aa, Clostridium cellulolyticum
DKLFWPEAGITKLEYVKTMTKLAPFLIKYSKHRMLTSIRYPHGINDKSFFQKEKPQGTPEWVETVEFNQKNYINLNSAATLVWLCTQAALELHTSFNVHEKPNHPSSLVFDLDPDDDLHFEDVAELAGRIHETLEALGIMDFIKTSGATGLQIFVPVAAKFDYDTARSLNEFFAQYFAEKLRSTVTIERMKKKREGKIYFDWQQMWTGKSMITAYSARAVKSAAVSAPIEWSELNDVRPEMFTLKNIINRLEQKGDIFE

SEQ ID NO: 1742 - protein, 338 aa, Artificial
  Alicyclobacillus acidocaldarius mutated SEQ ID NO 1735
MLEMGSKGRKQGIQVSSLIATGSSAHARREVKRMKRHESPPTLTHGDKIYFPAAGLCKRDYMTYLAQIGEHLVRHLRHRPVTLVRCPDGVAGRRFYQRHLPPHAPPSLPRREVQGERPLIAIPDVETLLYYGNLGAIEFHAGLHLVQGPQAGCPTALTFDLDPSDPRDFERVRELALCLREVLRGLGLDGVAKTTGASGLQVLVPLEEPLPYAVTRPVVNFVAAYCASRWPDLATTERRVRHRGRRVYVDAPQHGPTRTLIAAYSVRAVEKALVSAPITWAELEYGVSPDAFDLHVVPDRLERVGDWLELAARHPASRVRAIHDALPPPWRQTRVRSV

SEQ ID NO: 1743 - protein, 338 aa, Artificial
  Alicyclobacillus acidocaldarius mutated SEQ ID NO 1735
MLEMGSKGRKNGIQVSSLLATGSSAHARREVKRMKRHESPPTLTHGDKIYFPAAGLCKRDYMTYLAQIGEHLVRHLRHRPVTLVRCPDGVAGRRFYQRHLPPHAPPSLPRREVQGERPLIAIPDVETLLYYGNLGAIEFHAGLHLVQGPQAGCPTALTFDLDPSDPRDFERVRELALCLREVLRGLGLDGVAKTTGASGLQVLVPLEEPLPYAVTRPVVNFVAAYCASRWPDLATTERRVRHRGRRVYVDAPQHGPTRTLIAAYSVRAVEKALVSAPITWAELEYGVSPDAFDLHVVPDRLERVGDWLELAARHPASRVRAIHDALPPPWRQTRVRSV

SEQ ID NO: 1744 - protein, 338 aa, Artificial
  Alicyclobacillus acidocaldarius mutated SEQ ID NO 1735
MLEMGSKGRKNGIQVSSLIATGSSAHARREVKRMKRHESPPTLTHGDKIYFPAAGLCKRDYMTYLAQIGEHLVRHLRHRPVTLVRCPDGVAGRRFYQRHLPPHAPPSLPRREVQGERPLIAIPDVETLLYYGNLGAIEFHAGLHLVQGPQAGCPTALTFDLDPSDPRDFERVRELALCLREVLRGLGLDGVAKTTGASGLQVLVPLEEPLPYAVTRPVVNFVAAYCASRWPDLATTERRVRHRGRRVYVDAPQHGPTRTLIAAYSVRAVEKALVSAPITWAELEYGVSPDAFDLHVVPDRLERVGDWLELAARHPASRVRAIHDALPPPWRQTKVRSV

SEQ ID NO: 1745 - protein, 338 aa, Artificial
  Alicyclobacillus acidocaldarius mutated SEQ ID NO 1735
MLEMGSKGRKNGIQVSSLIATGSSAHARREVKRMKRHESPPTLTHGDKIYFPAAGLCKRDYMTYLAQIGEHLVRHLRHRPVTLVRCPDGVAGRRFYQRHLPPHAPPSLPRREVQGERPLIAIPDVETLLYYGNLGAIEFHAGLHLVQGPQAGCPTALTFDLDPSDPRDFERVRELALCLREVLRGLGLDGVAKTTGASGLQVLVPLEEPLPYAVTRPVVNFVAAYCASRWPDLATTERKVRHRGRRVYVDAPQHGPTRTLIAAYSVRAVEKALVSAPITWAELEYGVSPDAFDLHVVPDRLERVGDWLELAARHPASRVRAIHDALPPPWRQTRVRSV

SEQ ID NO: 1746 - protein, 338 aa, Artificial
  Alicyclobacillus acidocaldarius mutated SEQ ID NO 1735
MLEMGSKGRKNGIQVSSLIATGSSAHARREVKRMKRHESPPTLTHGDKIYFPAAGLCKRDYMTYLAQIGEHLVRHLRHRPVTLVRCPDGVAGRRFYQRHLPPHAPPSLPKREVQGERPLIAIPDVETLLYYGNLGAIEFHAGLHLVQGPQAGCPTALTFDLDPSDPRDFERVRELALCLREVLRGLGLDGVAKTTGASGLQVLVPLEEPLPYAVTRPVVNFVAAYCASRWPDLATTERRVRHRGRRVYVDAPQHGPTRTLIAAYSVRAVEKALVSAPITWAELEYGVSPDAFDLHVVPDRLERVGDWLELAARHPASRVRAIHDALPPPWRQTRVRSV

SEQ ID NO: 1747 - DNA, 1017 bp, Artificial
  Alicyclobacillus acidocaldarius mutated SEQ ID NO 1736
gtgcttgaaatgggttcgaaaggccgaaagcaaggcatccaggtttcctccctgatagcgacgggttcgtctgcgcacgctaggcgagaggtgaagcgcatgaagcgccatgaaagtccgccgacgctcacccatggggacaagatctacttccctgccgcggggctctgcaagcgcgactatatgacctatcttgcccaaatcggcgagcacttggtccgacatctgcgccatcggcccgtcacgttggttcggtgcccggacggcgtggccggccgccgattttatcagcggcatcttccgccacacgcacctccgagcctgccgcgcagagaggtccaaggcgaacgcccgttgattgccatcccggacgtcgagacgctcttatactacggaaacttgggcgccatcgagttccacgcgggtctgcatctcgtccaaggtcctcaagcgggatgcccgacggcgctcacgttcgatctcgacccttccgatccgcgcgacttcgagcgcgtgcgagagctcgcgctgtgcctgcgcgaggtgcttcgcggcctcggcctcgacggcgtggcgaagaccacgggggcgtccggcctgcaggtgttggtcccgcttgaggagccgctcccgtacgccgtcacgcggccggtggtcaacttcgtcgcggcgtactgtgcgtcgcgctggccggatctggccaccaccgagaggcgcgtgcgccatcggggccgccgggtgtacgtggacgcgccgcagcacgggccgacgcgcacgctgatcgcggcgtacagcgtgcgcgcggtggagaaagcgctggtgtcggcgcccatcacatgggcagaactggaatacggggtgtcgcccgacgcgtttgatctccacgtggtgcctgacagattggagcgggtgggcgattggctggagctcgcggcgcgtcaccccgcctctcgcgtacgggccatccacgacgcgctccccccgccttggcgacaaacgcgcgtccgttcagtataa

SEQ ID NO: 1748 - DNA, 1017 bp, Artificial
  Alicyclobacillus acidocaldarius mutated SEQ ID NO 1736
gtgcttgaaatgggttcgaaaggccgaaagaacggcatccaggtttcctccctgttagcgacgggttcgtctgcgcacgctaggcgagaggtgaagcgcatgaagcgccatgaaagtccgccgacgctcacccatggggacaagatctacttccctgccgcggggctctgcaagcgcgactatatgacctatcttgcccaaatcggcgagcacttggtccgacatctgcgccatcggcccgtcacgttggttcggtgcccggacggcgtggccggccgccgattttatcagcggcatcttccgccacacgcacctccgagcctgccgcgcagagaggtccaaggcgaacgcccgttgattgccatcccggacgtcgagacgctcttatactacggaaacttgggcgccatcgagttccacgcgggtctgcatctcgtccaaggtcctcaagcgggatgcccgacggcgctcacgttcgatctcgacccttccgatccgcgcgacttcgagcgcgtgcgagagctcgcgctgtgcctgcgcgaggtgcttcgcggcctcggcctcgacggcgtggcgaagaccacgggggcgtccggcctgcaggtgttggtcccgcttgaggagccgctcccgtacgccgtcacgcggccggtggtcaacttcgtcgcggcgtactgtgcgtcgcgctggccggatctggccaccaccgagaggcgcgtgcgccatcggggccgccgggtgtacgtggacgcgccgcagcacgggccgacgcgcacgctgatcgcggcgtacagcgtgcgcgcggtggagaaagcgctggtgtcggcgcccatcacatgggcagaactggaatacggggtgtcgcccgacgcgtttgatctccacgtggtgcctgacagattggagcgggtgggcgattggctggagctcgcggcgcgtcaccccgcctctcgcgtacgggccatccacgacgcgctccccccgccttggcgacaaacgcgcgtccgttcagtataa

SEQ ID NO: 1749 - DNA, 1017 bp, Artificial
  Alicyclobacillus acidocaldarius mutated SEQ ID NO 1736
gtgcttgaaatgggttcgaaaggccgaaagaacggcatccaggtttcctccctgatagcgacgggttcgtctgcgcacgctaggcgagaggtgaagcgcatgaagcgccatgaaagtccgccgacgctcacccatggggacaagatctacttccctgccgcggggctctgcaagcgcgactatatgacctatcttgcccaaatcggcgagcacttggtccgacatctgcgccatcggcccgtcacgttggttcggtgcccggacggcgtggccggccgccgattttatcagcggcatcttccgccacacgcacctccgagcctgccgcgcagagaggtccaaggcgaacgcccgttgattgccatcccggacgtcgagacgctcttatactacggaaacttgggcgccatcgagttccacgcgggtctgcatctcgtccaaggtcctcaagcgggatgcccgacggcgctcacgttcgatctcgacccttccgatccgcgcgacttcgagcgcgtgcgagagctcgcgctgtgcctgcgcgaggtgcttcgcggcctcggcctcgacggcgtggcgaagaccacgggggcgtccggcctgcaggtgttggtcccgcttgaggagccgctcccgtacgccgtcacgcggccggtggtcaacttcgtcgcggcgtactgtgcgtcgcgctggccggatctggccaccaccgagaggcgcgtgcgccatcggggccgccgggtgtacgtggacgcgccgcagcacgggccgacgcgcacgctgatcgcggcgtacagcgtgcgcgcggtggagaaagcgctggtgtcggcgcccatcacatgggcagaactggaatacggggtgtcgcccgacgcgtttgatctccacgtggtgcctgacagattggagcgggtgggcgattggctggagctcgcggcgcgtcaccccgcctctcgcgtacgggccatccacgacgcgctccccccgccttggcgacaaacgaaagtccgttcagtataa

SEQ ID NO: 1750 - DNA, 1017 bp, Artificial
  Alicyclobacillus acidocaldarius mutated SEQ ID NO 1736
gtgcttgaaatgggttcgaaaggccgaaagaacggcatccaggtttcctccctgatagcgacgggttcgtctgcgcacgctaggcgagaggtgaagcgcatgaagcgccatgaaagtccgccgacgctcacccatggggacaagatctacttccctgccgcggggctctgcaagcgcgactatatgacctatcttgcccaaatcggcgagcacttggtccgacatctgcgccatcggcccgtcacgttggttcggtgcccggacggcgtggccggccgccgattttatcagcggcatcttccgccacacgcacctccgagcctgccgcgcagagaggtccaaggcgaacgcccgttgattgccatcccggacgtcgagacgctcttatactacggaaacttgggcgccatcgagttccacgcgggtctgcatctcgtccaaggtcctcaagcgggatgcccgacggcgctcacgttcgatctcgacccttccgatccgcgcgacttcgagcgcgtgcgagagctcgcgctgtgcctgcgcgaggtgcttcgcggcctcggcctcgacggcgtggcgaagaccacgggggcgtccggcctgcaggtgttggtcccgcttgaggagccgctcccgtacgccgtcacgcggccggtggtcaacttcgtcgcggcgtactgtgcgtcgcgctggccggatctggccaccaccgagaggaaagtgcgccatcggggccgccgggtgtacgtggacgcgccgcagcacgggccgacgcgcacgctgatcgcggcgtacagcgtgcgcgcggtggagaaagcgctggtgtcggcgcccatcacatgggcagaactggaatacggggtgtcgcccgacgcgtttgatctccacgtggtgcctgacagattggagcgggtgggcgattggctggagctcgcggcgcgtcaccccgcctctcgcgtacgggccatccacgacgcgctccccccgccttggcgacaaacgcgcgtccgttcagtataa

SEQ ID NO: 1751 - DNA, 1017 bp, Artificial
  Alicyclobacillus acidocaldarius mutated SEQ ID NO 1736
gtgcttgaaatgggttcgaaaggccgaaagaacggcatccaggtttcctccctgatagcgacgggttcgtctgcgcacgctaggcgagaggtgaagcgcatgaagcgccatgaaagtccgccgacgctcacccatggggacaagatctacttccctgccgcggggctctgcaagcgcgactatatgacctatcttgcccaaatcggcgagcacttggtccgacatctgcgccatcggcccgtcacgttggttcggtgcccggacggcgtggccggccgccgattttatcagcggcatcttccgccacacgcacctccgagcctgccgaaaagagaggtccaaggcgaacgcccgttgattgccatcccggacgtcgagacgctcttatactacggaaacttgggcgccatcgagttccacgcgggtctgcatctcgtccaaggtcctcaagcgggatgcccgacggcgctcacgttcgatctcgacccttccgatccgcgcgacttcgagcgcgtgcgagagctcgcgctgtgcctgcgcgaggtgcttcgcggcctcggcctcgacggcgtggcgaagaccacgggggcgtccggcctgcaggtgttggtcccgcttgaggagccgctcccgtacgccgtcacgcggccggtggtcaacttcgtcgcggcgtactgtgcgtcgcgctggccggatctggccaccaccgagaggcgcgtgcgccatcggggccgccgggtgtacgtggacgcgccgcagcacgggccgacgcgcacgctgatcgcggcgtacagcgtgcgcgcggtggagaaagcgctggtgtcggcgcccatcacatgggcagaactggaatacggggtgtcgcccgacgcgtttgatctccacgtggtgcctgacagattggagcgggtgggcgattggctggagctcgcggcgcgtcaccccgcctctcgcgtacgggccatccacgacgcgctccccccgccttggcgacaaacgcgcgtccgttcagtataa

SEQ ID NO: 1752 - protein, 314 aa, Alicyclobacillus acidocaldarius
MPFFRPFEPISSTEVPVGDAWIAQVKWDGVRAVAEVSGDGVQIWNRHGRLRTDRYPEIASALRPFRGCAFDGEVVALTQGRPDFYRVLRRDRAVASHEIEQLVREIPVWYAVFDVVRMGGEWVGDWPLAKRLDWMLEHLSGVEHVLTSEGEVDTEALFAATKQLGLEGIVCKRVDSTYAPGGKDGRWVKVKHERNAIAAVGGVVYRDGAPNALMLGLFDDKARLFHVGNAGAGRLPRRAWRQLVERVLSHETSLQPFARAPKAVRTCRFAHPVVAVKVRFAEWTPKGTMRHPVLLAELDIPATPAACSFAQADP

SEQ ID NO: 1753 - DNA, 945 bp, Alicyclobacillus acidocaldarius
atgccgttctttcggcctttcgaacccatttcaagcaccgaggtgccggtgggagacgcgtggatcgcgcaggtcaaatgggacggggtgcgcgccgtggccgaggtgtcgggcgacggcgtgcaaatctggaaccgccacggacggcttcgaacggaccggtatccggagatcgcatcggcgctgcggccctttcgggggtgtgcgttcgacggcgaagtggtggcgctcacacagggaaggcccgacttttaccgggttcttcgcagggaccgggccgtcgcgtcgcacgagatcgagcaactcgtgcgcgagatccccgtatggtacgccgtgttcgatgtcgtgcggatgggcggggaatgggttggggattggccattggccaagcgactcgactggatgctcgagcatctctcgggcgtggaacatgtgctgacgagcgaaggcgaggtggacaccgaggcgctcttcgccgccacaaagcaactgggactcgagggaattgtgtgcaaacgcgtggactccacctacgcgcctggcggcaaagacgggcgctgggtcaaagtcaaacacgagcgaaacgccatcgcggccgttggcggcgtcgtgtaccgagacggcgccccgaatgcgctgatgctcggcctgtttgacgacaaggcacggctgtttcacgtcggcaacgcgggggccggtcgcctccctcgtcgagcatggcgccagctcgtcgagcgagtcctctcccacgagacatcgttgcaaccgttcgcccgcgcgcccaaggccgtgagaacgtgccgattcgcgcaccccgtcgtcgccgtgaaggttcgcttcgccgaatggacgccaaaagggaccatgcgccaccctgtcctcctcgccgagttggatatcccggcgacgcccgcggcgtgcagttttgcccaggccgacccgtga

SEQ ID NO: 1754 - protein, 322 aa, Natranaerobius thermophilus
MEFFQIQAMEPIPRQSVPTGDDWFYQIKWDGIRILTFFDGNSIKLRTKKGFKRTTEYPELNELTKEFGNTTWLLDGEIIVANQTDKSDHPKFITTNESCEEVGANFFHVLKRDRTKNPTQKLLKTFPVRYKVFDLLMIDNQWLVNEPFIKRRELLNKHFNNNKFLQIIRSYSDGLSLFNITSQQNHEGIVAKKSNSIYHPGKKHSEWFKIKHLKYLQAYLGGVIVKENQIKSLLLGQKSDLADYKLNYIGRASTGLTQKELNMLKDFAFKNRVSNSPFGNLSKVDLELADSKESVVFLSPQLKLQVKYTNWTPGGNLRHPVI

SEQ ID NO: 1755 - protein, 296 aa, Symbiobacterium thermophilum
PFPPMLLERAEAPFADDDWVYQVKWDGVRNLTLVEGGRVRHWSRRLRERTALFPEFDGLAAALPGRRAVLDGEIIVLQDGRPSFSAVLERDLAGSTAGAARRRPATLMLFDLLEWDGRELYDVPLAERLALLEAVVPPDEAWQVVSSFPGSDGPALYAAAVARGLEGVVAKRRASRYVPGARSRDWLKVKRRSEMLAVVVGYTNPTGRPGGLLLGAYRDGRLRYIGRVGSGLSGADLAAIRHHLPSGPCPLAEIPRLRERFGGDPGPVVWVEPLLTVRVSFTEWTEEGRLRDPVVV

SEQ ID NO: 1756 - protein, 288 aa, Syntrophomonas wolfei
RSMDPINCEQAFDSDDFLYQVKWDGVRMLVAVAGEQVSLLNKRGNLRSRQYPELQNLPNLIRASTAVLDGEIVVLREGKPSFPAVMQRDNCRNPMKIQHLSKTLAISYMVFDLLYLNGRDLRSASLVDRLSQLAELFDNQGCLYLVESFSQGTILFDSVQRAGLEGIVAKKKNSFYRPGKQHDDWFKIKCRCSQACLVGGYTLRGKQVNALLLGVMRDGSLSFAGKASNGLDAEQLQILSETLPRLEVKDSPFLEPTPAGSHYITPQLAVEVEYLEWTDSLHLRFPVI

SEQ ID NO: 1757 - protein, 285 aa, Thermosinus carboxydivorans
EIKWDGIRAVIYLASDNLRILSRNLKDVTRQYPELMPLTQALAGHSVILDGEIVAFDINGRPSFARLQNRMGLASDRTIARKTTEIPATYIIFDLLYIDGQSTLSLPYIERRRLLEELDLNGPNWQTPAYKTGQGRELLLASRRLGLEGIVAKKLDSIYLPGKRPGTWLKIKNVRRQEFVIGGWLPGQGTRTGMIGALLLGYYDRTPKEAAKAGQPQRLLFAGAVGTGFTHTTLKKLQHLLKPLEQAEPPFAESPPLKGAVFVKPALVGEVEFTEWTPGGTLRHP

SEQ ID NO: 1758 - protein, 303 aa, Arthrobacter aurescens
MPNYSPMLATSGTTADLRGDDWLYELKWDGIRAIITGTESRIRLMSRNGNDLTAAYPELTDRACWPDGDFVADGEIVALGKGSRPDFGRLQLRMNLVKAADIERARATVPVQLMLFDLLYDDGTDLSGLPFHERRERLSGFAERWRVGCPLHLSAVLDHDVEDLMTSAAELGLEGVMAKKADSRYVIGRRSRSWIKLKLEQSQEVVVGGWRPGAGARAGTFGALLLGIPDGDKLHYVGRVGSGFKDWQLRDIMEKLEPLAIVESPFADIPREDAAGATWVSPELVAEVTFGEWTGPGRLRHPV

SEQ ID NO: 1759 - protein, 314 aa, Artificial
  Alicyclobacillus acidocaldarius mutated SEQ ID NO 1752
MPFFRPFEPISSTEVPVGDAWIAQVKWDGVRAVAEVSGDGVQIWNRHGRLRTDRYPEIASALRPFRGCAFDGEVVALTQGRPDFYRVLRRDRAVASHEIEQLVREIPVWYAVFDVVRMGGEWVGDWPLAKRLDWMLEHLSGVEHVLTSEGEVDTEALFAATKQLGLEGIVCKRVDSTYAPGGKDGRWVKVKHERNAIAAVGGVVYRDGAPNALMLGLFDDKARLFHVGNAGAGRLPRRAWRQLVERVLSHETSLQPFARAPKAVRTCRFAHPVVAVKVRFAEWTPKGTMRHPILLAELDIPATPAACSFAQADP

SEQ ID NO: 1760 - protein, 314 aa, Artificial
  Alicyclobacillus acidocaldarius mutated SEQ ID NO 1752
MPFFRPFEPISSTEVPVGDAWIAQVKWDGVRAVAEVSGDGVQIWNRHGRLRTDRYPEIASALRPFRGCAFDGEVVALTQGRPDFYRVLRRDRAVASHEIDQLVREIPVWYAVFDVVRMGGEWVGDWPLAKRLDWMLEHLSGVEHVLTSEGEVDTEALFAATKQLGLEGIVCKRVDSTYAPGGKDGRWVKVKHERNAIAAVGGVVYRDGAPNALMLGLFDDKARLFHVGNAGAGRLPRRAWRQLVERVLSHETSLQPFARAPKAVRTCRFAHPVVAVKVRFAEWTPKGTMRHPVLLAELDIPATPAACSFAQADP

SEQ ID NO: 1761 - protein, 314 aa, Artificial
  Alicyclobacillus acidocaldarius mutated SEQ ID NO 1752
MPFFRPFEPISSTEVPVGDAWIAQVKWDGVRAVAEVSGDGVQIWNRHGRLRTDRYPEIASALRPFRGCAFDGEVVALTQGRPDFYRVIRRDRAVASHEIEQLVREIPVWYAVFDVVRMGGEWVGDWPLAKRLDWMLEHLSGVEHVLTSEGEVDTEALFAATKQLGLEGIVCKRVDSTYAPGGKDGRWVKVKHERNAIAAVGGVVYRDGAPNALMLGLFDDKARLFHVGNAGAGRLPRRAWRQLVERVLSHETSLQPFARAPKAVRTCRFAHPVVAVKVRFAEWTPKGTMRHPVLLAELDIPATPAACSFAQADP

SEQ ID NO: 1762 - protein, 314 aa, Artificial
  Alicyclobacillus acidocaldarius mutated SEQ ID NO 1752
MPFFRPFEPISSTEVPVGDAWIAQVKWDGVRAVAEVSGDGVQIWNRHGRLRTDRYPEIASALRPFRGCAFDGEVVALTQGRPDFYRVLRRDRAVASHEIEQLVREIPVWYAVFDVVRMGGEWVGDWPLAKRLDWMLEHLSGVEHVLTSEGEIDTEALFAATKQLGLEGIVCKRVDSTYAPGGKDGRWVKVKHERNAIAAVGGVVYRDGAPNALMLGLFDDKARLFHVGNAGAGRLPRRAWRQLVERVLSHETSLQPFARAPKAVRTCRFAHPVVAVKVRFAEWTPKGTMRHPVLLAELDIPATPAACSFAQADP

SEQ ID NO: 1763 - protein, 314 aa, Artificial
  Alicyclobacillus acidocaldarius mutated SEQ ID NO 1752
MPFFRPFEPISSTEVPVGDAWIAQVKWDGVRAVAEVSGDGVQIWNRHGRLRTDRYPEIASALRPFRGCAFDGEVVALTQGRPDFYRVLRRDRAVASHEIEQLVREIPVWYAVFDVVRMGGEWVGDWPLAKRLDWMLEHLSGVEHVLTSEGEVDTEALFAATKQLGLEGIVCKRVDSTYAPGGKDGRWVKVKHERNAIAAVGGVVYRDGAPNALMLGLFDDKARLFHVGNAGAGRLPRRAWRQLVERVLSHETSLQPFARAPKAVRTCRFAHPVVAVKVRFAEWTPKGTMRHPVLLAELEIPATPAACSFAQADP

SEQ ID NO: 1764 - DNA, 945 bp, Artificial
  Alicyclobacillus acidocaldarius mutated SEQ ID NO 1753
atgccgttctttcggcctttcgaacccatttcaagcaccgaggtgccggtgggagacgcgtggatcgcgcaggtcaaatgggacggggtgcgcgccgtggccgaggtgtcgggcgacggcgtgcaaatctggaaccgccacggacggcttcgaacggaccggtatccggagatcgcatcggcgctgcggccctttcgggggtgtgcgttcgacggcgaagtggtggcgctcacacagggaaggcccgacttttaccgggttcttcgcagggaccgggccgtcgcgtcgcacgagatcgagcaactcgtgcgcgagatccccgtatggtacgccgtgttcgatgtcgtgcggatgggcggggaatgggttggggattggccattggccaagcgactcgactggatgctcgagcatctctcgggcgtggaacatgtgctgacgagcgaaggcgaggtggacaccgaggcgctcttcgccgccacaaagcaactgggactcgagggaattgtgtgcaaacgcgtggactccacctacgcgcctggcggcaaagacgggcgctgggtcaaagtcaaacacgagcgaaacgccatcgcggccgttggcggcgtcgtgtaccgagacggcgccccgaatgcgctgatgctcggcctgtttgacgacaaggcacggctgtttcacgtcggcaacgcgggggccggtcgcctccctcgtcgagcatggcgccagctcgtcgagcgagtcctctcccacgagacatcgttgcaaccgttcgcccgcgcgcccaaggccgtgagaacgtgccgattcgcgcaccccgtcgtcgccgtgaaggttcgcttcgccgaatggacgccaaaagggaccatgcgccaccctattctcctcgccgagttggatatcccggcgacgcccgcggcgtgcagttttgcccaggccgacccgtga

SEQ ID NO: 1765 - DNA, 945 bp, Artificial
  Alicyclobacillus acidocaldarius mutated SEQ ID NO 1753
atgccgttctttcggcctttcgaacccatttcaagcaccgaggtgccggtgggagacgcgtggatcgcgcaggtcaaatgggacggggtgcgcgccgtggccgaggtgtcgggcgacggcgtgcaaatctggaaccgccacggacggcttcgaacggaccggtatccggagatcgcatcggcgctgcggccctttcgggggtgtgcgttcgacggcgaagtggtggcgctcacacagggaaggcccgacttttaccgggttcttcgcagggaccgggccgtcgcgtcgcacgagatcgatcaactcgtgcgcgagatccccgtatggtacgccgtgttcgatgtcgtgcggatgggcggggaatgggttggggattggccattggccaagcgactcgactggatgctcgagcatctctcgggcgtggaacatgtgctgacgagcgaaggcgaggtggacaccgaggcgctcttcgccgccacaaagcaactgggactcgagggaattgtgtgcaaacgcgtggactccacctacgcgcctggcggcaaagacgggcgctgggtcaaagtcaaacacgagcgaaacgccatcgcggccgttggcggcgtcgtgtaccgagacggcgccccgaatgcgctgatgctcggcctgtttgacgacaaggcacggctgtttcacgtcggcaacgcgggggccggtcgcctccctcgtcgagcatggcgccagctcgtcgagcgagtcctctcccacgagacatcgttgcaaccgttcgcccgcgcgcccaaggccgtgagaacgtgccgattcgcgcaccccgtcgtcgccgtgaaggttcgcttcgccgaatggacgccaaaagggaccatgcgccaccctgtcctcctcgccgagttggatatcccggcgacgcccgcggcgtgcagttttgcccaggccgacccgtga

SEQ ID NO: 1766 - DNA, 945 bp, Artificial
  Alicyclobacillus acidocaldarius mutated SEQ ID NO 1753
atgccgttctttcggcctttcgaacccatttcaagcaccgaggtgccggtgggagacgcgtggatcgcgcaggtcaaatgggacggggtgcgcgccgtggccgaggtgtcgggcgacggcgtgcaaatctggaaccgccacggacggcttcgaacggaccggtatccggagatcgcatcggcgctgcggccctttcgggggtgtgcgttcgacggcgaagtggtggcgctcacacagggaaggcccgacttttaccgggttattcgcagggaccgggccgtcgcgtcgcacgagatcgagcaactcgtgcgcgagatccccgtatggtacgccgtgttcgatgtcgtgcggatgggcggggaatgggttggggattggccattggccaagcgactcgactggatgctcgagcatctctcgggcgtggaacatgtgctgacgagcgaaggcgaggtggacaccgaggcgctcttcgccgccacaaagcaactgggactcgagggaattgtgtgcaaacgcgtggactccacctacgcgcctggcggcaaagacgggcgctgggtcaaagtcaaacacgagcgaaacgccatcgcggccgttggcggcgtcgtgtaccgagacggcgccccgaatgcgctgatgctcggcctgtttgacgacaaggcacggctgtttcacgtcggcaacgcgggggccggtcgcctccctcgtcgagcatggcgccagctcgtcgagcgagtcctctcccacgagacatcgttgcaaccgttcgcccgcgcgcccaaggccgtgagaacgtgccgattcgcgcaccccgtcgtcgccgtgaaggttcgcttcgccgaatggacgccaaaagggaccatgcgccaccctgtcctcctcgccgagttggatatcccggcgacgcccgcggcgtgcagttttgcccaggccgacccgtga

SEQ ID NO: 1767 - DNA, 945 bp, Artificial
  Alicyclobacillus acidocaldarius mutated SEQ ID NO 1753
atgccgttctttcggcctttcgaacccatttcaagcaccgaggtgccggtgggagacgcgtggatcgcgcaggtcaaatgggacggggtgcgcgccgtggccgaggtgtcgggcgacggcgtgcaaatctggaaccgccacggacggcttcgaacggaccggtatccggagatcgcatcggcgctgcggccctttcgggggtgtgcgttcgacggcgaagtggtggcgctcacacagggaaggcccgacttttaccgggttcttcgcagggaccgggccgtcgcgtcgcacgagatcgagcaactcgtgcgcgagatccccgtatggtacgccgtgttcgatgtcgtgcggatgggcggggaatgggttggggattggccattggccaagcgactcgactggatgctcgagcatctctcgggcgtggaacatgtgctgacgagcgaaggcgagattgacaccgaggcgctcttcgccgccacaaagcaactgggactcgagggaattgtgtgcaaacgcgtggactccacctacgcgcctggcggcaaagacgggcgctgggtcaaagtcaaacacgagcgaaacgccatcgcggccgttggcggcgtcgtgtaccgagacggcgccccgaatgcgctgatgctcggcctgtttgacgacaaggcacggctgtttcacgtcggcaacgcgggggccggtcgcctccctcgtcgagcatggcgccagctcgtcgagcgagtcctctcccacgagacatcgttgcaaccgttcgcccgcgcgcccaaggccgtgagaacgtgccgattcgcgcaccccgtcgtcgccgtgaaggttcgcttcgccgaatggacgccaaaagggaccatgcgccaccctgtcctcctcgccgagttggatatcccggcgacgcccgcggcgtgcagttttgcccaggccgacccgtga

SEQ ID NO: 1768 - DNA, 945 bp, Artificial
  Alicyclobacillus acidocaldarius mutated SEQ ID NO 1753
atgccgttctttcggcctttcgaacccatttcaagcaccgaggtgccggtgggagacgcgtggatcgcgcaggtcaaatgggacggggtgcgcgccgtggccgaggtgtcgggcgacggcgtgcaaatctggaaccgccacggacggcttcgaacggaccggtatccggagatcgcatcggcgctgcggccctttcgggggtgtgcgttcgacggcgaagtggtggcgctcacacagggaaggcccgacttttaccgggttcttcgcagggaccgggccgtcgcgtcgcacgagatcgagcaactcgtgcgcgagatccccgtatggtacgccgtgttcgatgtcgtgcggatgggcggggaatgggttggggattggccattggccaagcgactcgactggatgctcgagcatctctcgggcgtggaacatgtgctgacgagcgaaggcgaggtggacaccgaggcgctcttcgccgccacaaagcaactgggactcgagggaattgtgtgcaaacgcgtggactccacctacgcgcctggcggcaaagacgggcgctgggtcaaagtcaaacacgagcgaaacgccatcgcggccgttggcggcgtcgtgtaccgagacggcgccccgaatgcgctgatgctcggcctgtttgacgacaaggcacggctgtttcacgtcggcaacgcgggggccggtcgcctccctcgtcgagcatggcgccagctcgtcgagcgagtcctctcccacgagacatcgttgcaaccgttcgcccgcgcgcccaaggccgtgagaacgtgccgattcgcgcaccccgtcgtcgccgtgaaggttcgcttcgccgaatggacgccaaaagggaccatgcgccaccctgtcctcctcgccgagttggaaatcccggcgacgcccgcggcgtgcagttttgcccaggccgacccgtga

SEQ ID NO: 1769 - protein, 478 aa, Alicyclobacillus acidocaldarius
MLLMTVALYCRVSTDEQAEHGFSIDNQKERLIAFCKSQGWDQYRLYIDDGYTGTNMDRPALQRLIKHIKEKKIDTVIVYKLDRLSRKQRDVLYLLEDVFDKNNVVFKSATEPFDTSTPLGKAMLGILAVFAQLERDTIIERLSTGQKLRVKSGKFSGGRIPFGYVYNSQTGKFEVSPHEAFLVREVYKKYLQGYSLSDLSDWIESQTSARYWDHARIRDMLTRETYTGVMPYGTLRSTEIAPPIIERELWEQVQQEMVRRREGFTPKGEYLLSGLLRCAECGSSFIHVIRKKGPYVYYLYGCRSQHQRPKKVPRRAPKQACTVGYRNREELESWVIEQVKRIARLDAEEFEHQIANIETNSDETEDTLRDLRKNLSDIEHKLNRWYEAFEEGTIDATQLRDRIKHLEEERRRLQTNIEELQDTLVKDTQPQRVFNAAKLIEEAWDYMTFDEKKNVLRAAISYIEIPRKGQPPVIHWNV

SEQ ID NO: 1770 - DNA, 1437 bp, Alicyclobacillus acidocaldarius
gtgcttttgatgacggtggctttgtactgtagggtatcgacagacgaacaagccgagcatggtttctctatcgacaatcagaaagaacgattgattgccttttgtaaatcacaaggatgggatcaatatcggctgtacatagacgacggatacactggtacgaacatggatcgaccggcgctgcagaggctcatcaaacacatcaaagaaaaaaagatcgatacagtaatcgtgtacaagcttgataggttaagcagaaaacaacgcgacgtgctgtatctactcgaagacgtttttgataagaacaatgtggtgttcaagagcgctacagaaccctttgacactagtacgccgctcggcaaagcaatgttaggtattctcgcggtattcgctcaacttgaacgggacaccatcattgagcgcctatctactggacaaaaacttcgtgttaaatcggggaaattttccggcgggagaattccttttggctacgtctataattcccagactggaaagtttgaagtgtcacctcatgaagcctttcttgtgagggaggtgtataaaaaatatcttcaaggatacagtcttagtgatttgtctgattggatcgaatcacagacatccgctcgttattgggatcacgcaaggattcgagacatgttgaccagagaaacgtatacgggtgttatgccatatggaactctaagaagtacagaaatcgccccacccatcatcgaacgcgaattgtgggaacaagtacaacaggaaatggttcgaagacgcgaaggctttactcctaaaggcgaatacttgttgtccggtcttttgcggtgcgcggaatgcggaagttctttcatacacgtcattcgcaaaaagggaccgtatgtctattacttgtatggatgcagatctcaacaccaacgccctaaaaaggtaccaagaagggctccgaaacaagcttgcaccgtcggttatcgcaatcgtgaagagttggagtcatgggtaatcgaacaggtgaaacgaatagcaaggttggatgcagaagaatttgaacaccaaatcgcaaatatagaaaccaattctgatgaaaccgaagatacacttagggatttaaggaaaaacctatcagatatagagcataagttgaatagatggtacgaggcctttgaagaggggacgatagatgctacgcagttgcgagatcggattaagcatctcgaagaggaaagaaggagattacagaccaatattgaagaattgcaagacacacttgtgaaagatacacaaccgcaacgtgtgttcaacgctgcaaagcttattgaagaggcttgggattacatgacctttgatgaaaagaaaaatgtcttacgtgccgcgatttcgtatattgagatccctcgaaagggacaaccgccggtcatccattggaatgtctag

SEQ ID NO: 1771 - protein, 472 aa, Paenibacillus larvae
MRVAIYIRVSTEEQAQYGYSIDAQKERLIAYCTSQGWTDYKIYIDDGYTGTKMMRPALNRLIRHIEDDKIDLVVVYKLDRLSRKQLDVLYLLEEVFEKHNVGFKSATEPFETTTPFGKAMIGILAVFAQLERDMIVERTTIGRRQRVSKGEWYGGRIPFGYRMNRETKQLEIVPEEAKIIKEIYKMYLQGNSRLSIAEWAAERTKARVIDHSVIRDILSRPVYTGKLSNAGNVVDGKHEAIIDEKTWHAVQKETQERKEGATPLGEYLLTGLLKCGVCGGPIVHVKRITRKYGKEYLYELYACKNQHVRKKDRNNNCSLGYIRREKVEKFVIEQIKSYTTDDVLIKQITNEKNKFKENDESALNNLESQLKKVLTGLENLYDAIESGEIKASSISDRIRKLEEQRDVLENHIDEIKDNTPQNELNIQEFNIFIKEIGEAWDYLTEDEQKALIRKAFRSVTLYKDKEIKVEWN

SEQ ID NO: 1772 - protein, 476 aa, Pelotomaculum thermopropionicum
TVACYIRVSTDEQAEQGISIPAQKSRLLAFCRSQGWNIYGFYIDDGYSGKDLDRPAMRRLIGDTGAKKFDTVLVLKLDRLSRRQKDVLFLLEDVFEPGGVGFKSVTESFDTTTPFGKAALGMMAVFAQLERETIVERVRMAKKESAKQGRFMGGPAPYGYRHNFETKRLEVDEVQAGTVRWIYDRYLSGAPNYRHIAEELEHTGVPGPTNEKWNKAFVRKILTNPVYAGLIRHRENLYPGRHDPIVSPEKWQEVQKLIKSRGAVRAAAAVHTGLLSGIIWCGECGARMRVKNVWQNHPNTNPKKVTRYYVCYSQDRAGGHMVRNPTCRCGYKHGGAVEEQVLRELFCYSYDRRLLRRALEEALAAADNRAFLRELAQARKDLAATEKKLERWYDAFEKGALEGDQLTERVKGLHQRKAYLRGQIAEMESRLKEGKERQTSVEEMMGILQDFPRIWENATAEERREIVVNTVKAVKV

SEQ ID NO: 1773 - protein, 473 aa, Carnobacterium  AT7
VAIYVRVSTQDQAEEGYSIEEQIDKLTKYCDIKDWYVYEIYKDPGFTGSTIDRPGMKKLVNDSKQHKFDTVLVYKLDRLSRSQKDTLYLIEDVFAKYNVDFVSLSENFDTSTAFGKAMIGILSVFAQLEREQITERMQMGKVGRARSGKAMGWTRPPFGYEYTEGKYIVDDFKAIVINKIYKEYLSGISITKLRDKLNDEGHLGKDIPWSYRAIRSILDNPVYAGYMNFKGEVYKGNHDAIITKELFDKTKTELDIRQKQAYAQNNNPRPFQGKYILSGLARCGYCGAPLELMLGNIRKDGTRLKKYKCTNRIVKSRVTFYNDNKKCTSGFYHMNDLEDYVINEVSKLQKNPETIFERTEIKNENHTEIYEHRIVVIDKKIKRLSDLYMNDLINLEDMQFKAKALKDEKDHLLNKLNHSEHKLENVKKDKAILFLKDIENNINDETYENKKKIINVLIKKVDVKANEIKVIWN

SEQ ID NO: 1774 - protein, 449 aa, bacteriophage phi-FC1
ALYIRVSTMEQAKEGYSIPAQTDKLKAFAKAKDMAVAKVYTDPGFSGAKMERPALQEMISDIQNKKIDVVLVYKLDRLSRSQKNTLYLIEDVFLKNNVDFISMQESFDTSTPFGRATIGMLSVFAQLERDTITERMHMGRTERAKQGYYHGSGIVPLGYDYVHGELIINDYEAQIIQEIYDLYVNQGKGQQYITKRMVAKYPDKVKTLTIVKYALTNPLYIGKISWDGKVYDGHHSPIIDKSMYDKAQEIIARMAQKGGEQHGNQLGLLLGITYCGKCGAEVFRYVSGGKKYRYNYYMCRSVKKMLPSLVKDWNCKQPSLRQEVVEKKVIDSLKSLDFKKIERELKQVENKTKSKITTINNQISKKHNEKQKILDLYQYGTFDVTMLNERMKKIDNEINALTANIANLEGTKSESLINKLETLKTFNWETETTENKILIIKEFVERIEL

SEQ ID NO: 1775 - protein, 455 aa, Streptococcus pneumoniae
SKKDKLSSYCDIKDWNVYKVYTDGGFSGSNTDRPALESLIKDAKKRKFDTVLVYKLDRLSRSQKDTLHLIEDVFIKNGIEFLSLQENFDTSTPFGKAMIGLLSVFAQLEREQIKERMQLGKIGRAKAGKSMMWAKTSYGYDYHRDTGTITINPAQALAIKFIFESYLRGRSITKLRDDLNEKYPKHVPWSYRAVRTILDNPVYCGFNQYKGEIYPGNHEPIISKEEYDKTQSELKIRQRTAAENVNPRPFQAKYILSGIAQCGYCGAPLKIMLGVKRKDGSRLKKYECHQRHPRTLRGVTTYNDNKKCDSGFYYKDKLEAYVLKEISKLQDDADYLDKIFSGDNAETIDRESYKKQIEELSKKLSRLNDLYIDDRITLEELQSKSAEFISMRGTLETELENDPALRKNKRKADMRKLLNAEKVFSMDYENQKVLVRRLINKVKVTAEDIVINWKI

SEQ ID NO: 1776 - protein, 478 aa, Artificial
  Alicyclobacillus acidocaldarius mutated SEQ ID NO 1769
MLLMTVALYCRVSTDEQAEHGFSIDNQRERLIAFCKSQGWDQYRLYIDDGYTGTNMDRPALQRLIKHIKEKKIDTVIVYKLDRLSRKQRDVLYLLEDVFDKNNVVFKSATEPFDTSTPLGKAMLGILAVFAQLERDTIIERLSTGQKLRVKSGKFSGGRIPFGYVYNSQTGKFEVSPHEAFLVREVYKKYLQGYSLSDLSDWIESQTSARYWDHARIRDMLTRETYTGVMPYGTLRSTEIAPPIIERELWEQVQQEMVRRREGFTPKGEYLLSGLLRCAECGSSFIHVIRKKGPYVYYLYGCRSQHQRPKKVPRRAPKQACTVGYRNREELESWVIEQVKRIARLDAEEFEHQIANIETNSDETEDTLRDLRKNLSDIEHKLNRWYEAFEEGTIDATQLRDRIKHLEEERRRLQTNIEELQDTLVKDTQPQRVFNAAKLIEEAWDYMTFDEKKNVLRAAISYIEIPRKGQPPVIHWNV

SEQ ID NO: 1777 - protein, 478 aa, Artificial
  Alicyclobacillus acidocaldarius mutated SEQ ID NO 1769
MLLMTVALYCRVSTDEQAEHGFSIDNQKERLIAFCKSQGWDQYRLYIDDGYTGTNMDRPALQRLIKHIKEKKIDTVIVYKLDRLSRKQRDVLYLLEDVFDKNNVVFKSATEPFDTSTPLGKAMLGILAVFAQLERDTIIERLSTGQKLKVKSGKFSGGRIPFGYVYNSQTGKFEVSPHEAFLVREVYKKYLQGYSLSDLSDWIESQTSARYWDHARIRDMLTRETYTGVMPYGTLRSTEIAPPIIERELWEQVQQEMVRRREGFTPKGEYLLSGLLRCAECGSSFIHVIRKKGPYVYYLYGCRSQHQRPKKVPRRAPKQACTVGYRNREELESWVIEQVKRIARLDAEEFEHQIANIETNSDETEDTLRDLRKNLSDIEHKLNRWYEAFEEGTIDATQLRDRIKHLEEERRRLQTNIEELQDTLVKDTQPQRVFNAAKLIEEAWDYMTFDEKKNVLRAAISYIEIPRKGQPPVIHWNV

SEQ ID NO: 1778 - protein, 478 aa, Artificial
  Alicyclobacillus acidocaldarius mutated SEQ ID NO 1769
MLLMTVALYCRVSTDEQADHGFSIDNQKERLIAFCKSQGWDQYRLYIDDGYTGTNMDRPALQRLIKHIKEKKIDTVIVYKLDRLSRKQRDVLYLLEDVFDKNNVVFKSATEPFDTSTPLGKAMLGILAVFAQLERDTIIERLSTGQKLRVKSGKFSGGRIPFGYVYNSQTGKFEVSPHEAFLVREVYKKYLQGYSLSDLSDWIESQTSARYWDHARIRDMLTRETYTGVMPYGTLRSTEIAPPIIERELWEQVQQEMVRRREGFTPKGEYLLSGLLRCAECGSSFIHVIRKKGPYVYYLYGCRSQHQRPKKVPRRAPKQACTVGYRNREELESWVIEQVKRIARLDAEEFEHQIANIETNSDETEDTLRDLRKNLSDIEHKLNRWYEAFEEGTIDATQLRDRIKHLEEERRRLQTNIEELQDTLVKDTQPQRVFNAAKLIEEAWDYMTFDEKKNVLRAAISYIEIPRKGQPPVIHWNV

SEQ ID NO: 1779 - protein, 478 aa, Artificial
  Alicyclobacillus acidocaldarius mutated SEQ ID NO 1769
MLLMTVALYCRVSTDEQAEHGFSIDNQKERLIAFCKSQGWDQYRLYIDDGYTGTNMDRPALQRLIKHIKEKKIDTVIVYKLDRLSRKQRDVLYLLEDVFDKNNVVFKSATEPFDTSTPLGKAMLGILAVFAQLERDTIIERLSTGQKLRVKSGKFSGGRIPFGYVYNSQTGKFEVSPHEAFLVREVYKKYLQGYSLSDLSDWIESQTSARYWDHARIRDMLTRETYTGVMPYGTLRSTEIAPPIIERELWEQVQQEMVRRREGFTPKGEYLLSGLLRCAECGSSFIHVIRKKGPYVYYLYGCRSQHQRPKKVPRRAPKQACTVGYRNREELESWVIEQVKRIARLDAEEFEHQIANIETNSDETEDTLRDLRRNLSDIEHKLNRWYEAFEEGTIDATQLRDRIKHLEEERRRLQTNIEELQDTLVKDTQPQRVFNAAKLIEEAWDYMTFDEKKNVLRAAISYIEIPRKGQPPVIHWNV

SEQ ID NO: 1780 - protein, 478 aa, Artificial
  Alicyclobacillus acidocaldarius mutated SEQ ID NO 1769
MLLMTVALYCRVSTDEQAEHGFSIDNQKERLIAFCKSQGWDQYRLYIDDGYTGTNMDRPALQRLIKHIKEKKIDTVIVYKLDRLSRKQRDVLYLLEDVFDKNNVVFKSATEPFDTSTPLGKAMLGILAVFAQLERDTIIERLSTGQKLRVKSGKFSGGRIPFGYVYNSQTGKFEVSPHEAFLVREVYKKYLQGYSLSDLSDWIESQTSARYWDHARIRDMLTRETYTGVMPYGTLRSTEIAPPIIERELWEQVQQEMVRRREGFTPKGEYLLSGLLRCAECGSSFIHVIRKKGPYVYYLYGCRSQHQRPKKVPRRAPKQACTVGYRNREDLESWVIEQVKRIARLDAEEFEHQIANIETNSDETEDTLRDLRKNLSDIEHKLNRWYEAFEEGTIDATQLRDRIKHLEEERRRLQTNIEELQDTLVKDTQPQRVFNAAKLIEEAWDYMTFDEKKNVLRAAISYIEIPRKGQPPVIHWNV

SEQ ID NO: 1781 - DNA, 1437 bp, Artificial
  Alicyclobacillus acidocaldarius mutated SEQ ID NO 1770
gtgcttttgatgacggtggctttgtactgtagggtatcgacagacgaacaagccgagcatggtttctctatcgacaatcagcgtgaacgattgattgccttttgtaaatcacaaggatgggatcaatatcggctgtacatagacgacggatacactggtacgaacatggatcgaccggcgctgcagaggctcatcaaacacatcaaagaaaaaaagatcgatacagtaatcgtgtacaagcttgataggttaagcagaaaacaacgcgacgtgctgtatctactcgaagacgtttttgataagaacaatgtggtgttcaagagcgctacagaaccctttgacactagtacgccgctcggcaaagcaatgttaggtattctcgcggtattcgctcaacttgaacgggacaccatcattgagcgcctatctactggacaaaaacttcgtgttaaatcggggaaattttccggcgggagaattccttttggctacgtctataattcccagactggaaagtttgaagtgtcacctcatgaagcctttcttgtgagggaggtgtataaaaaatatcttcaaggatacagtcttagtgatttgtctgattggatcgaatcacagacatccgctcgttattgggatcacgcaaggattcgagacatgttgaccagagaaacgtatacgggtgttatgccatatggaactctaagaagtacagaaatcgccccacccatcatcgaacgcgaattgtgggaacaagtacaacaggaaatggttcgaagacgcgaaggctttactcctaaaggcgaatacttgttgtccggtcttttgcggtgcgcggaatgcggaagttctttcatacacgtcattcgcaaaaagggaccgtatgtctattacttgtatggatgcagatctcaacaccaacgccctaaaaaggtaccaagaagggctccgaaacaagcttgcaccgtcggttatcgcaatcgtgaagagttggagtcatgggtaatcgaacaggtgaaacgaatagcaaggttggatgcagaagaatttgaacaccaaatcgcaaatatagaaaccaattctgatgaaaccgaagatacacttagggatttaaggaaaaacctatcagatatagagcataagttgaatagatggtacgaggcctttgaagaggggacgatagatgctacgcagttgcgagatcggattaagcatctcgaagaggaaagaaggagattacagaccaatattgaagaattgcaagacacacttgtgaaagatacacaaccgcaacgtgtgttcaacgctgcaaagcttattgaagaggcttgggattacatgacctttgatgaaaagaaaaatgtcttacgtgccgcgatttcgtatattgagatccctcgaaagggacaaccgccggtcatccattggaatgtctag

SEQ ID NO: 1782 - DNA, 1437 bp, Artificial
  Alicyclobacillus acidocaldarius mutated SEQ ID NO 1770
gtgcttttgatgacggtggctttgtactgtagggtatcgacagacgaacaagccgagcatggtttctctatcgacaatcagaaagaacgattgattgccttttgtaaatcacaaggatgggatcaatatcggctgtacatagacgacggatacactggtacgaacatggatcgaccggcgctgcagaggctcatcaaacacatcaaagaaaaaaagatcgatacagtaatcgtgtacaagcttgataggttaagcagaaaacaacgcgacgtgctgtatctactcgaagacgtttttgataagaacaatgtggtgttcaagagcgctacagaaccctttgacactagtacgccgctcggcaaagcaatgttaggtattctcgcggtattcgctcaacttgaacgggacaccatcattgagcgcctatctactggacaaaaacttaaagttaaatcggggaaattttccggcgggagaattccttttggctacgtctataattcccagactggaaagtttgaagtgtcacctcatgaagcctttcttgtgagggaggtgtataaaaaatatcttcaaggatacagtcttagtgatttgtctgattggatcgaatcacagacatccgctcgttattgggatcacgcaaggattcgagacatgttgaccagagaaacgtatacgggtgttatgccatatggaactctaagaagtacagaaatcgccccacccatcatcgaacgcgaattgtgggaacaagtacaacaggaaatggttcgaagacgcgaaggctttactcctaaaggcgaatacttgttgtccggtcttttgcggtgcgcggaatgcggaagttctttcatacacgtcattcgcaaaaagggaccgtatgtctattacttgtatggatgcagatctcaacaccaacgccctaaaaaggtaccaagaagggctccgaaacaagcttgcaccgtcggttatcgcaatcgtgaagagttggagtcatgggtaatcgaacaggtgaaacgaatagcaaggttggatgcagaagaatttgaacaccaaatcgcaaatatagaaaccaattctgatgaaaccgaagatacacttagggatttaaggaaaaacctatcagatatagagcataagttgaatagatggtacgaggcctttgaagaggggacgatagatgctacgcagttgcgagatcggattaagcatctcgaagaggaaagaaggagattacagaccaatattgaagaattgcaagacacacttgtgaaagatacacaaccgcaacgtgtgttcaacgctgcaaagcttattgaagaggcttgggattacatgacctttgatgaaaagaaaaatgtcttacgtgccgcgatttcgtatattgagatccctcgaaagggacaaccgccggtcatccattggaatgtctag

SEQ ID NO: 1783 - DNA, 1437 bp, Artificial
  Alicyclobacillus acidocaldarius mutated SEQ ID NO 1770
gtgcttttgatgacggtggctttgtactgtagggtatcgacagacgaacaagccgatcatggtttctctatcgacaatcagaaagaacgattgattgccttttgtaaatcacaaggatgggatcaatatcggctgtacatagacgacggatacactggtacgaacatggatcgaccggcgctgcagaggctcatcaaacacatcaaagaaaaaaagatcgatacagtaatcgtgtacaagcttgataggttaagcagaaaacaacgcgacgtgctgtatctactcgaagacgtttttgataagaacaatgtggtgttcaagagcgctacagaaccctttgacactagtacgccgctcggcaaagcaatgttaggtattctcgcggtattcgctcaacttgaacgggacaccatcattgagcgcctatctactggacaaaaacttcgtgttaaatcggggaaattttccggcgggagaattccttttggctacgtctataattcccagactggaaagtttgaagtgtcacctcatgaagcctttcttgtgagggaggtgtataaaaaatatcttcaaggatacagtcttagtgatttgtctgattggatcgaatcacagacatccgctcgttattgggatcacgcaaggattcgagacatgttgaccagagaaacgtatacgggtgttatgccatatggaactctaagaagtacagaaatcgccccacccatcatcgaacgcgaattgtgggaacaagtacaacaggaaatggttcgaagacgcgaaggctttactcctaaaggcgaatacttgttgtccggtcttttgcggtgcgcggaatgcggaagttctttcatacacgtcattcgcaaaaagggaccgtatgtctattacttgtatggatgcagatctcaacaccaacgccctaaaaaggtaccaagaagggctccgaaacaagcttgcaccgtcggttatcgcaatcgtgaagagttggagtcatgggtaatcgaacaggtgaaacgaatagcaaggttggatgcagaagaatttgaacaccaaatcgcaaatatagaaaccaattctgatgaaaccgaagatacacttagggatttaaggaaaaacctatcagatatagagcataagttgaatagatggtacgaggcctttgaagaggggacgatagatgctacgcagttgcgagatcggattaagcatctcgaagaggaaagaaggagattacagaccaatattgaagaattgcaagacacacttgtgaaagatacacaaccgcaacgtgtgttcaacgctgcaaagcttattgaagaggcttgggattacatgacctttgatgaaaagaaaaatgtcttacgtgccgcgatttcgtatattgagatccctcgaaagggacaaccgccggtcatccattggaatgtctag

SEQ ID NO: 1784 - DNA, 1437 bp, Artificial
  Alicyclobacillus acidocaldarius mutated SEQ ID NO 1770
gtgcttttgatgacggtggctttgtactgtagggtatcgacagacgaacaagccgagcatggtttctctatcgacaatcagaaagaacgattgattgccttttgtaaatcacaaggatgggatcaatatcggctgtacatagacgacggatacactggtacgaacatggatcgaccggcgctgcagaggctcatcaaacacatcaaagaaaaaaagatcgatacagtaatcgtgtacaagcttgataggttaagcagaaaacaacgcgacgtgctgtatctactcgaagacgtttttgataagaacaatgtggtgttcaagagcgctacagaaccctttgacactagtacgccgctcggcaaagcaatgttaggtattctcgcggtattcgctcaacttgaacgggacaccatcattgagcgcctatctactggacaaaaacttcgtgttaaatcggggaaattttccggcgggagaattccttttggctacgtctataattcccagactggaaagtttgaagtgtcacctcatgaagcctttcttgtgagggaggtgtataaaaaatatcttcaaggatacagtcttagtgatttgtctgattggatcgaatcacagacatccgctcgttattgggatcacgcaaggattcgagacatgttgaccagagaaacgtatacgggtgttatgccatatggaactctaagaagtacagaaatcgccccacccatcatcgaacgcgaattgtgggaacaagtacaacaggaaatggttcgaagacgcgaaggctttactcctaaaggcgaatacttgttgtccggtcttttgcggtgcgcggaatgcggaagttctttcatacacgtcattcgcaaaaagggaccgtatgtctattacttgtatggatgcagatctcaacaccaacgccctaaaaaggtaccaagaagggctccgaaacaagcttgcaccgtcggttatcgcaatcgtgaagagttggagtcatgggtaatcgaacaggtgaaacgaatagcaaggttggatgcagaagaatttgaacaccaaatcgcaaatatagaaaccaattctgatgaaaccgaagatacacttagggatttaaggcgtaacctatcagatatagagcataagttgaatagatggtacgaggcctttgaagaggggacgatagatgctacgcagttgcgagatcggattaagcatctcgaagaggaaagaaggagattacagaccaatattgaagaattgcaagacacacttgtgaaagatacacaaccgcaacgtgtgttcaacgctgcaaagcttattgaagaggcttgggattacatgacctttgatgaaaagaaaaatgtcttacgtgccgcgatttcgtatattgagatccctcgaaagggacaaccgccggtcatccattggaatgtctag

SEQ ID NO: 1785 - DNA, 1437 bp, Artificial
  Alicyclobacillus acidocaldarius mutated SEQ ID NO 1770
gtgcttttgatgacggtggctttgtactgtagggtatcgacagacgaacaagccgagcatggtttctctatcgacaatcagaaagaacgattgattgccttttgtaaatcacaaggatgggatcaatatcggctgtacatagacgacggatacactggtacgaacatggatcgaccggcgctgcagaggctcatcaaacacatcaaagaaaaaaagatcgatacagtaatcgtgtacaagcttgataggttaagcagaaaacaacgcgacgtgctgtatctactcgaagacgtttttgataagaacaatgtggtgttcaagagcgctacagaaccctttgacactagtacgccgctcggcaaagcaatgttaggtattctcgcggtattcgctcaacttgaacgggacaccatcattgagcgcctatctactggacaaaaacttcgtgttaaatcggggaaattttccggcgggagaattccttttggctacgtctataattcccagactggaaagtttgaagtgtcacctcatgaagcctttcttgtgagggaggtgtataaaaaatatcttcaaggatacagtcttagtgatttgtctgattggatcgaatcacagacatccgctcgttattgggatcacgcaaggattcgagacatgttgaccagagaaacgtatacgggtgttatgccatatggaactctaagaagtacagaaatcgccccacccatcatcgaacgcgaattgtgggaacaagtacaacaggaaatggttcgaagacgcgaaggctttactcctaaaggcgaatacttgttgtccggtcttttgcggtgcgcggaatgcggaagttctttcatacacgtcattcgcaaaaagggaccgtatgtctattacttgtatggatgcagatctcaacaccaacgccctaaaaaggtaccaagaagggctccgaaacaagcttgcaccgtcggttatcgcaatcgtgaagatttggagtcatgggtaatcgaacaggtgaaacgaatagcaaggttggatgcagaagaatttgaacaccaaatcgcaaatatagaaaccaattctgatgaaaccgaagatacacttagggatttaaggaaaaacctatcagatatagagcataagttgaatagatggtacgaggcctttgaagaggggacgatagatgctacgcagttgcgagatcggattaagcatctcgaagaggaaagaaggagattacagaccaatattgaagaattgcaagacacacttgtgaaagatacacaaccgcaacgtgtgttcaacgctgcaaagcttattgaagaggcttgggattacatgacctttgatgaaaagaaaaatgtcttacgtgccgcgatttcgtatattgagatccctcgaaagggacaaccgccggtcatccattggaatgtctag

SEQ ID NO: 1786 - protein, 713 aa, Alicyclobacillus acidocaldarius
MNQGQGLPRLRRMEDRGVSDYLVIVESPAKAKTIGKYLGSKYTVKASMGHVRDLPKSQLGVDVEHGFEPKYITIRGKGDVIKALREASKKAKKVYLAADPDREGEAIAWHLQHLLDLNPDDDCRVVFHEITKDAVKQAFQHPRKINLDLVNAQQTRRILDRLVGYKLSPLLWRKVKKGLSAGRVQSVALRLIVDRENEIRTFQPEEYWTVDAHGQVHGKKLVARFYGYGEEKTPLPNEAAVRELLSRVEGHSLVVRRVKKSERKRNPAAPFTTSSLQQEAARKLGFRAYKTMQIAQQLYEGLDVPGEGTVGLITYMRTDSTRIAQSAQEEARAYIRQSFGEDYVPDRPRQYAKNEDAQDAHEAIRPTSVMRHPDRLKDHLSRDQYRLYKLIWERFVASQMESAVLDTTSVDLEANGAWFRATGSVVRFPGFMALYTEGRDDDADEEEGKLLPPLQEGDVVQVKTWKPEQHFTQPPPRYTESTLVKAMEELGIGRPSTYAPTIDILLKRGYVTLDQKRFVPTELGEIVVNILKEHFPQLIDVSFTADMESRLDKVEEGNANWIELLDQFYHDFEKDLKKAESALGHVELKDEVSDVRCEKCGRLMVYKTGRYGKFLACPGFPECRNTKPILKEIPVSCPKCGKPLVERKGKSRKVFYGCSGYPECDYVLWQRPTGQTCPVCGHPMIEKGGKGKTVVVCSNEKAHPMVATEAQAK

SEQ ID NO: 1787 - DNA, 2142 bp, Alicyclobacillus acidocaldarius
ttgaaccaaggacagggtttgccaaggctgcgacgaatggaggatcgtggcgtgtcagactatctggtcatcgtcgagtcgcccgccaaggcgaagacgattgggaagtatctggggagcaagtacacggtgaaagcctccatgggccacgtgcgagacctgcccaagagccaactcggcgtcgacgtggaacatggttttgaaccgaaatatatcacgatccgcgggaagggcgacgtcatcaaggcgctccgcgaggcgagcaagaaggcgaagaaggtctacctcgcggcagaccctgaccgcgaaggcgaagccatcgcctggcacctgcagcatctgctcgatctcaatcctgacgatgactgtcgcgtcgtgtttcacgagatcacgaaggatgcggtcaaacaggcgtttcaacatccgaggaaaatcaatctggatctcgtgaacgcgcagcagacgcggcgcatcttggaccgcctcgtgggctacaagctgagtcccttgctgtggcgaaaggtaaaaaagggcttgtcggctggccgcgtgcagtcggtcgcactgaggctcatcgtcgatcgcgaaaacgaaatccgaacgtttcaacctgaggagtactggaccgtcgacgcccatggccaggtgcacgggaagaagctcgtggctcgcttttatggctacggcgaggaaaagacaccgcttccaaacgaggctgccgtgcgcgaacttctgtcccgtgtggaaggccactcgttggtcgtgcgccgggtcaagaaatccgagcggaagcgaaaccccgctgcgccgttcacgacgagcagtcttcaacaggaggcggcccgaaaactcgggtttcgggcgtacaaaaccatgcaaattgcgcagcagttgtacgaaggtctcgacgtgccgggtgaaggcacggtcggtctcatcacctacatgcgaacggattcgacacgcatcgcgcaatccgcgcaggaggaagcgagggcctacattcggcaatcgtttggcgaggactacgtgccggatcggccgcggcaatacgcgaaaaacgaggatgcccaagacgcgcacgaggcgattcggcccacgtcggtgatgcgacatccggatcgactgaaggatcacttgtcgcgcgatcagtatcgcctctacaagctgatctgggagcgattcgtcgcgagccagatggagtcggccgtcctcgacaccacatcggtcgacctcgaggcgaatggcgcgtggtttcgcgcgacgggatcagtcgtccggttccccggattcatggcgctctacacggagggccgcgacgacgacgccgatgaagaggaagggaagctgcttccccccctgcaagagggcgatgtggtccaggtgaagacctggaaaccggagcagcattttacccagccgccgccgcgctacaccgagtcgacgctcgtgaaggcgatggaagaactcgggattggtcggccgagcacgtacgcgcctaccatcgacatcctgttgaagcgcggatacgtgacgctcgatcagaagcggtttgtccccaccgaactcggggaaatcgtggtgaacattctcaaggaacatttcccccagctcatcgacgtgtccttcaccgccgacatggagagccgattggacaaagtcgaggagggcaacgcgaactggatcgagctgctcgatcagttttatcatgactttgagaaggatttaaagaaggcggaaagcgccctggggcacgtcgaattgaaggacgaggtgtccgacgtccgctgtgaaaagtgcggccgcctcatggtgtacaagacgggcaggtacgggaagtttctcgcgtgtccggggttcccggagtgccgaaacacgaaacccatcttgaaggagatcccggtctcgtgcccgaagtgcggcaaaccgcttgtggaacgaaaagggaaatcgaggaaagtgttttacgggtgcagcgggtatcccgagtgtgactacgtgctttggcagcgcccgacgggtcagacgtgcccggtctgcggacacccgatgattgaaaaaggcggaaaaggaaagacggttgtggtgtgcagcaacgaaaaagctcacccgatggtggcaaccgaggcacaggcgaaatga

SEQ ID NO: 1788 - protein, 681 aa, Geobacillus thermodenitrificans
MSDYLVIVESPTKAKTIERYLGKKYTVKASMGHVRDLPKSQMGVDINDGYTPKYITIRGKGQVIKELKTAAKKAKKVFLAADPDREGEAIAWHLANMLDLDIHSDCRVVFHEITKDAIKQSFQQPRSINMNLVDAQQARRVLDRLVGYNISPLLWKKVKKGLSAGRVQSVALRLIIDREKEIRQFQPEEYWTIQAKFQKGKEAFAASFYGVDGEKLELKTEADVKEVLARLNGRAFTVKTVTKRERRRSPVPPFTTSSLQQEAARKLNFRTKKTMMVAQQLYEGIDLGGEGTVGLITYMRTDSTRIAETAQQEAAAYIEATFGAQYVHQEKRKEKKSTNAQDAHEAIRPTSAFRDPDKVKPYLTRDQFRLYKLIWERFIASQMAAAVLDTMSVELENNGVLFRASGSKVKFPGFMKVYIEGTDDQTEEQDRLLPDLEEGEAVESEMIEPKQHFTQPPPRYTEARLVKTLEELGIGRPSTYAPTLDTIQKRNYVVLENKRFVPTELGEIVVELILEFFPEIIDVEFTAKMEKELDEIEEGKVEWIKVVDEFYREFEKRLKVAEKEMREVEIKDEPAGIDCDVCGSPMVYKMGRFGKFIACSNFPECRHTKPIVKEIGVKCPKCHEGNIVERNSKRKRVFYGCDRFPECDFVSWDKPLARPCPKCGGLLVEKKLKKGVQVQCT

SEQ ID NO: 1789 - protein, 681 aa, Geobacillus kaustophilus
MSDYLVIVESPTKAKTIERYLGKKYTVKASMGHVRDLPKSQMGVDIDHGYEPKYITIRGKGQVIKELKTAAKKAKKVFLAADPDREGEAIAWHLAHMLDLDIHSDCRVVFHEITKDAIQQSFQQPRAINMNLVDAQQARRVLDRLVGYNISPLLWKKVKKGLSAGRVQSVALRLIIDREREIREFQPEEYWTIQATFQKEGETFAASFYSIDGQKRDLKTEADVKAVLDRLNGTAFAVKTVTKRERKRSPVPPFTTSSLQQEAARKLNFRTKKTMMIAQQLYEGIDLGSEGTVGLITYMRTDSTRVAETAQQEAAAYIEATFGAMYVNQEKRKEKKSTNAQDAHEAIRPTSAFRDPDKVKPYLTRDQFRLYKLIWERFIASQMAAAVLDTMSVELENNGVVFRASGSKVKFPGFMKVYIEGTDDQTEEQDRILPDLEEEETVESETIESKQHFTQPPPRYTEARLVKTLEELGIGRPSTYAPTLDTIQKRNYVVLENKRFVPTELGEIVVELMLEFFPEIIDVEFTAKMEKELDEIEEGKVEWIKVVDEFYREFEKRLKVAEKEMRAVEIKDEPAGIDCEVCGSPMVYKMGRFGKFIACSNFPECRHTKPIVKEIGVKCPKCREGNIVERSTKRKRVFYGCDRFPDCDFVSWDKPLARPCPKCAGLLVEKVLKKGVQVQCT

SEQ ID NO: 1790 - protein, 682 aa, Bacillus pumilus
MADYLVIVESPAKAKTIERYLGKKYKVKASMGHIRDLPKSQLGVDTEHDFEPRYITIRGKGPVLKELKTAAKKAKKVYLAADPDREGEAIAWHLAHSLDLDLSSDCRVVFNEITKDAIKDSFKHPRMINMDLVDAQQARRILDRLVGYKISPILWKKVKKGLSAGRVQSVALRLIIDRENEINEFKPEEYWTIDGTFLKGKESFEASFFGVNGKKHPLKTKEDVKEILSKLKGSKFSVEKVTKKERKRNPAVPFTTSTLQQEAARKLNFRAKKTMMIAQQLYEGIDLGKEGTVGLITYMRTDSTRISNTAIEEVSAFIDQTYGKNFLNTTKRTVKKNENAQDAHEAIRPTSTLRKPADVKHVLSRDQLRLYKLIWERFVASQMAPAVLDTMSVDLDNNGLTFRANGSKVKFPGFMKVYVEGKDDQLEEKDKMLPDLKEGDTVLSKDIEPEQHFTQPPPRYTEARLVKTLEELGIGRPSTYAPTLDTIQKRGYVALDNKRFIPTELGEIVLNLIIEFFPEIINVEFTAKMEKELDSVEEGTIEWVRIIDSFYQDFAKRVEKAEAEMQEVEIEPEYAGVDCEECGHPMVYKMGRYGKFMACSNFPDCRNTKPIVKDIGVKCPTCHEGNIVERKSKKRRIFYGCDRFPECEFVSWDKPIERKCPKCENMLVEKKLKKGMQVQCVN

SEQ ID NO: 1791 - protein, 680 aa, Bacillus subtilis
MSDYLVIVESPAKAKTIERYLGKKYKVKASMGHVRDLPKSQMGVDIEQNFEPKYITIRGKGPVLKELKTAAKKAKKVYLAADPDREGEAIAWHLAHSLDLDLNSDCRVVFNEITKDAIKESFKHPRMINMDLVDAQQARRILDRLVGYKISPILWKKVKKGLSAGRVQSVALRLIIDREKEINDFKPEEYWTIDGTFLKGQETFEASFFGKNGKKLPLNSEADVKEILSQLKGNQYTVEKVTKKERKRNPALPFTTSTLQQEAARKLNFRAKKTMMIAQQLYEGIDLGREGTVGLITYMRTDSTRISNTAVDEAAAFIDQTYGKEFLGGKRKPAKKNENAQDAHEAIRPTSVLRKPSELKAVLGRDQMRLYKLIWERFVASQMAPAVLDTMSVDLTNNGLTFRANGSKVKFSGFMKVYVEGKDDQMEEKDRMLPDLQEGDTVLSKDIEPEQHFTQPPPRYTEARLVKTLEERGIGRPSTYAPTLDTIQRRGYVALDNKRFVPTELGQIVLDLIMEFFPEIINVEFTAKMERDLDHVEEGNTEWVKIIDNFYTDFEKRVKKAESEMKEVEIEPEYAGEDCELCSSPMVYKMGRYGKFLACSNFPDCRNTKPIVKQIGVKCPSCGEGNIVERKSKKKRVFYGCDRYPDCEFVSWDKPIERKCPKCGKMLVEKKLKKGIQVQC

SEQ ID NO: 1792 - protein, 682 aa, Bacillus licheniformis
MSEYLVIVESPAKAKTIERYLGKKYKVKASMGHVRDLPKSQMGVDIEQNFEPKYITIRGKGPVLKELKTAAKKAKKVYLAADPDREGEAIAWHLAHSLDLDLNSDCRVVFNEITKDAIKESFKHPRMINMDLVDAQQARRILDRLVGYKISPILWKKVKKGLSAGRVQSVALRLIIDREKEINDFIPEEYWTIEGSFLKGKETFEASFFGINGEKHQLKSEDDVKQILSRIKGNKFEVKKVTKKERKRNPALPFTTSTLQQEAARKLNFRAKKTMMIAQQLYEGIDLGKEGTVGLITYMRTDSTRISNTAQEEAASFIGEQYGKEFLGSKRKPAKKNENAQDAHEAIRPTSVLRKPSDLKAVLGRDQLRLYKLIWERFVASQMAPATLDTMSVDLENNGLTFRANGSKVKFSGFMKVYVEGKDDQMEEKNKMLPDLAEGDTVLSKDIEPEQHFTQPPPRYTEARLVKTLEELGIGRPSTYAPTLDTIQKRGYVALDNKRFIPTELGEIVLDLIMEFFPEIINVEFTAKMEKELDDVEDGNIQWVQIIDSFYKDFEKRVEKAEAEMQEVEIEPEYAGVDCEACGHPMVYKMGRYGKFMACSNFPDCRNTKPIVKEIGVKCPSCKTGNIVERKSKKRRIFYGCDRYPECEFVSWDKPLERKCPKCEDMLVEKKLKKGVQVQCVN

SEQ ID NO: 1793 - protein, 713 aa, Artificial
  Alicyclobacillus acidocaldarius mutated SEQ ID NO 1786
MNQGQGLPRLRRMEDRGVSDYLVIVESPAKAKTIGKYLGSKYTVKASMGHVRDLPKSQLGVDVEHGFEPKYITIRGKGDVIKALREASKKAKKVYLAADPDREGEAIAWHLQHLLDLNPDDDCRVVFHEITKDAVKQAFQHPRKINLDLVNAQQTRRILDRLVGYKLSPLLWRKVKKGLSAGRVQSVALRLIVDRENEIRTFQPEEYWTVDAHGQVHGKKLVARFYGYGEEKTPLPNEAAVRELLSRVEGHSLVVRRVKKSERKRNPAAPFTTSSLQQEAARKLGFRAYKTMQIAQQLYEGLDVPGEGTVGLITYMRTDSTRIAQSAQEEARAYIRQSFGEDYVPDRPRQYAKNEDAQDAHEAIRPTSVMRHPERLKDHLSRDQYRLYKLIWERFVASQMESAVLDTTSVDLEANGAWFRATGSVVRFPGFMALYTEGRDDDADEEEGKLLPPLQEGDVVQVKTWKPEQHFTQPPPRYTESTLVKAMEELGIGRPSTYAPTIDILLKRGYVTLDQKRFVPTELGEIVVNILKEHFPQLIDVSFTADMESRLDKVEEGNANWIELLDQFYHDFEKDLKKAESALGHVELKDEVSDVRCEKCGRLMVYKTGRYGKFLACPGFPECRNTKPILKEIPVSCPKCGKPLVERKGKSRKVFYGCSGYPECDYVLWQRPTGQTCPVCGHPMIEKGGKGKTVVVCSNEKAHPMVATEAQAK

SEQ ID NO: 1794 - protein, 713 aa, Artificial
  Alicyclobacillus acidocaldarius mutated SEQ ID NO 1786
MNQGQGLPRLRRMEDRGVSDYLVIVESPAKAKTIGKYLGSKYTVKASMGHVRDLPKSQLGVDVEHGFEPKYITIRGKGDVIKALREASKKAKKVYLAADPDREGEAIAWHLQHLLDLNPDDDCRVVFHEITKDAVKQAFQHPRKINLDLVNAQQTRRILDRLVGYKLSPLLWRKVKKGLSAGRVQSVALRLIVDRENEIRTFQPEEYWTVDAHGQVHGKKLVARFYGYGEEKTPLPNEAAVRELLSRVEGHSLVVRRVKKSERKRNPAAPFTTSSLQQEAARKLGFRAYKTMQIAQQLYEGLDVPGEGTVGLITYMRTDSTRIAQSAQEEARAYIRQSFGEDYVPDRPRQYAKNEDAQDAHEAIRPTSVMRHPDKLKDHLSRDQYRLYKLIWERFVASQMESAVLDTTSVDLEANGAWFRATGSVVRFPGFMALYTEGRDDDADEEEGKLLPPLQEGDVVQVKTWKPEQHFTQPPPRYTESTLVKAMEELGIGRPSTYAPTIDILLKRGYVTLDQKRFVPTELGEIVVNILKEHFPQLIDVSFTADMESRLDKVEEGNANWIELLDQFYHDFEKDLKKAESALGHVELKDEVSDVRCEKCGRLMVYKTGRYGKFLACPGFPECRNTKPILKEIPVSCPKCGKPLVERKGKSRKVFYGCSGYPECDYVLWQRPTGQTCPVCGHPMIEKGGKGKTVVVCSNEKAHPMVATEAQAK

SEQ ID NO: 1795 - protein, 713 aa, Artificial
  Alicyclobacillus acidocaldarius mutated SEQ ID NO 1786
MNQGQGLPRLRRMEDRGVSDYLVIVESPAKAKTIGKYLGSKYTVKASMGHVRDLPKSQLGVDVEHGFEPKYITIRGKGDVIKALREASKKAKKVYLAADPDREGEAIAWHLQHLLDLNPDDDCRVVFHEITKDAVKQAFQHPRKINLDLVNAQQTRRILDRLVGYKLSPLLWRKVKKGLSAGRVQSVALRLIVDRENEIRTFQPEEYWTVDAHGQVHGKKLVARFYGYGEEKTPLPNEAAVRELLSRVEGHSLVVRRVKKSERKRNPAAPFTTSSLQQEAARKLGFRAYKTMQIAQQLYEGLDVPGEGTVGLITYMRTDSTRIAQSAQEEARAYIRQSFGEDYVPDRPRQYAKNEDAQDAHEAIRPTSVMRHPDRLKDHLSRDQYRLYKLIWERFVASQMESAVLDTTSVDLEANGAWFRATGSVVRFPGFMALYTEGRDDDADEEEGKLLPPLQEGDVVQVKTWKPEQHFTQPPPRYTESTLVKAMEELGIGRPSTYAPTIDLLLKRGYVTLDQKRFVPTELGEIVVNILKEHFPQLIDVSFTADMESRLDKVEEGNANWIELLDQFYHDFEKDLKKAESALGHVELKDEVSDVRCEKCGRLMVYKTGRYGKFLACPGFPECRNTKPILKEIPVSCPKCGKPLVERKGKSRKVFYGCSGYPECDYVLWQRPTGQTCPVCGHPMIEKGGKGKTVVVCSNEKAHPMVATEAQAK

SEQ ID NO: 1796 - protein, 713 aa, Artificial
  Alicyclobacillus acidocaldarius mutated SEQ ID NO 1786
MNQGQGLPRIRRMEDRGVSDYLVIVESPAKAKTIGKYLGSKYTVKASMGHVRDLPKSQLGVDVEHGFEPKYITIRGKGDVIKALREASKKAKKVYLAADPDREGEAIAWHLQHLLDLNPDDDCRVVFHEITKDAVKQAFQHPRKINLDLVNAQQTRRILDRLVGYKLSPLLWRKVKKGLSAGRVQSVALRLIVDRENEIRTFQPEEYWTVDAHGQVHGKKLVARFYGYGEEKTPLPNEAAVRELLSRVEGHSLVVRRVKKSERKRNPAAPFTTSSLQQEAARKLGFRAYKTMQIAQQLYEGLDVPGEGTVGLITYMRTDSTRIAQSAQEEARAYIRQSFGEDYVPDRPRQYAKNEDAQDAHEAIRPTSVMRHPDRLKDHLSRDQYRLYKLIWERFVASQMESAVLDTTSVDLEANGAWFRATGSVVRFPGFMALYTEGRDDDADEEEGKLLPPLQEGDVVQVKTWKPEQHFTQPPPRYTESTLVKAMEELGIGRPSTYAPTIDILLKRGYVTLDQKRFVPTELGEIVVNILKEHFPQLIDVSFTADMESRLDKVEEGNANWIELLDQFYHDFEKDLKKAESALGHVELKDEVSDVRCEKCGRLMVYKTGRYGKFLACPGFPECRNTKPILKEIPVSCPKCGKPLVERKGKSRKVFYGCSGYPECDYVLWQRPTGQTCPVCGHPMIEKGGKGKTVVVCSNEKAHPMVATEAQAK

SEQ ID NO: 1797 - protein, 713 aa, Artificial
  Alicyclobacillus acidocaldarius mutated SEQ ID NO 1786
MNQGQGLPRLRRMEDRGVSDYLVIVESPAKAKTIGKYLGSKYTVKASMGHVRDLPKSQLGVDVEHGFEPKYITIRGKGDVIKALREASKKAKKVYLAADPDREGEAIAWHLQHLLDLNPDDDCRVVFHEITKDAVKQAFQHPRKINLDLVNAQQTRRILDRLVGYKLSPLLWRKVKKGLSAGRVQSVALRLIVDRENEIRTFQPEEYWTVDAHGQVHGKKLVARFYGYGEEKTPLPNEAAVRELLSRVEGHSLVVRRVKKSERKRNPAAPFTTSSLQQEAARKLGFRAYKTMQIAQQLYEGLDVPGEGTVGLITYMRTDSTRIAQSAQEEARAYIRQSFGEDYVPDRPRQYAKNEDAQDAHEAIRPTSVMRHPDRLKDHLSRDQYRLYKLIWERFVASQMESAVLDTTSVDLEANGAWFRATGSVVRFPGFMALYTEGRDDDADEEEGKLLPPLQEGDVVQVKTWKPEQHFTQPPPRYTESTLVKAMEELGIGRPSTYAPTIDILLKRGYVTLDQKRFVPTELGEIVVNILKEHFPQLIDVSFTADMESRLDKVEEGNANWIELLDQFYHDFEKDLKKAESALGHVELKDEVSDVRCEKCGRLMVYKTGRYGKFLACPGFPECRNTKPILKEIPVSCPKCGKPLVERKGKSRKVFYGCSGYPECDYVLWQRPTGQTCPVCGHPMIEKGGKGKTIVVCSNEKAHPMVATEAQAK

SEQ ID NO: 1798 - DNA, 2142 bp, Artificial
  Alicyclobacillus acidocaldarius mutated SEQ ID NO 1787
ttgaaccaaggacagggtttgccaaggctgcgacgaatggaggatcgtggcgtgtcagactatctggtcatcgtcgagtcgcccgccaaggcgaagacgattgggaagtatctggggagcaagtacacggtgaaagcctccatgggccacgtgcgagacctgcccaagagccaactcggcgtcgacgtggaacatggttttgaaccgaaatatatcacgatccgcgggaagggcgacgtcatcaaggcgctccgcgaggcgagcaagaaggcgaagaaggtctacctcgcggcagaccctgaccgcgaaggcgaagccatcgcctggcacctgcagcatctgctcgatctcaatcctgacgatgactgtcgcgtcgtgtttcacgagatcacgaaggatgcggtcaaacaggcgtttcaacatccgaggaaaatcaatctggatctcgtgaacgcgcagcagacgcggcgcatcttggaccgcctcgtgggctacaagctgagtcccttgctgtggcgaaaggtaaaaaagggcttgtcggctggccgcgtgcagtcggtcgcactgaggctcatcgtcgatcgcgaaaacgaaatccgaacgtttcaacctgaggagtactggaccgtcgacgcccatggccaggtgcacgggaagaagctcgtggctcgcttttatggctacggcgaggaaaagacaccgcttccaaacgaggctgccgtgcgcgaacttctgtcccgtgtggaaggccactcgttggtcgtgcgccgggtcaagaaatccgagcggaagcgaaaccccgctgcgccgttcacgacgagcagtcttcaacaggaggcggcccgaaaactcgggtttcgggcgtacaaaaccatgcaaattgcgcagcagttgtacgaaggtctcgacgtgccgggtgaaggcacggtcggtctcatcacctacatgcgaacggattcgacacgcatcgcgcaatccgcgcaggaggaagcgagggcctacattcggcaatcgtttggcgaggactacgtgccggatcggccgcggcaatacgcgaaaaacgaggatgcccaagacgcgcacgaggcgattcggcccacgtcggtgatgcgacatccggaacgactgaaggatcacttgtcgcgcgatcagtatcgcctctacaagctgatctgggagcgattcgtcgcgagccagatggagtcggccgtcctcgacaccacatcggtcgacctcgaggcgaatggcgcgtggtttcgcgcgacgggatcagtcgtccggttccccggattcatggcgctctacacggagggccgcgacgacgacgccgatgaagaggaagggaagctgcttccccccctgcaagagggcgatgtggtccaggtgaagacctggaaaccggagcagcattttacccagccgccgccgcgctacaccgagtcgacgctcgtgaaggcgatggaagaactcgggattggtcggccgagcacgtacgcgcctaccatcgacatcctgttgaagcgcggatacgtgacgctcgatcagaagcggtttgtccccaccgaactcggggaaatcgtggtgaacattctcaaggaacatttcccccagctcatcgacgtgtccttcaccgccgacatggagagccgattggacaaagtcgaggagggcaacgcgaactggatcgagctgctcgatcagttttatcatgactttgagaaggatttaaagaaggcggaaagcgccctggggcacgtcgaattgaaggacgaggtgtccgacgtccgctgtgaaaagtgcggccgcctcatggtgtacaagacgggcaggtacgggaagtttctcgcgtgtccggggttcccggagtgccgaaacacgaaacccatcttgaaggagatcccggtctcgtgcccgaagtgcggcaaaccgcttgtggaacgaaaagggaaatcgaggaaagtgttttacgggtgcagcgggtatcccgagtgtgactacgtgctttggcagcgcccgacgggtcagacgtgcccggtctgcggacacccgatgattgaaaaaggcggaaaaggaaagacggttgtggtgtgcagcaacgaaaaagctcacccgatggtggcaaccgaggcacaggcgaaatga

SEQ ID NO: 1799 - DNA, 2142 bp, Artificial
  Alicyclobacillus acidocaldarius mutated SEQ ID NO 1787
ttgaaccaaggacagggtttgccaaggctgcgacgaatggaggatcgtggcgtgtcagactatctggtcatcgtcgagtcgcccgccaaggcgaagacgattgggaagtatctggggagcaagtacacggtgaaagcctccatgggccacgtgcgagacctgcccaagagccaactcggcgtcgacgtggaacatggttttgaaccgaaatatatcacgatccgcgggaagggcgacgtcatcaaggcgctccgcgaggcgagcaagaaggcgaagaaggtctacctcgcggcagaccctgaccgcgaaggcgaagccatcgcctggcacctgcagcatctgctcgatctcaatcctgacgatgactgtcgcgtcgtgtttcacgagatcacgaaggatgcggtcaaacaggcgtttcaacatccgaggaaaatcaatctggatctcgtgaacgcgcagcagacgcggcgcatcttggaccgcctcgtgggctacaagctgagtcccttgctgtggcgaaaggtaaaaaagggcttgtcggctggccgcgtgcagtcggtcgcactgaggctcatcgtcgatcgcgaaaacgaaatccgaacgtttcaacctgaggagtactggaccgtcgacgcccatggccaggtgcacgggaagaagctcgtggctcgcttttatggctacggcgaggaaaagacaccgcttccaaacgaggctgccgtgcgcgaacttctgtcccgtgtggaaggccactcgttggtcgtgcgccgggtcaagaaatccgagcggaagcgaaaccccgctgcgccgttcacgacgagcagtcttcaacaggaggcggcccgaaaactcgggtttcgggcgtacaaaaccatgcaaattgcgcagcagttgtacgaaggtctcgacgtgccgggtgaaggcacggtcggtctcatcacctacatgcgaacggattcgacacgcatcgcgcaatccgcgcaggaggaagcgagggcctacattcggcaatcgtttggcgaggactacgtgccggatcggccgcggcaatacgcgaaaaacgaggatgcccaagacgcgcacgaggcgattcggcccacgtcggtgatgcgacatccggataaactgaaggatcacttgtcgcgcgatcagtatcgcctctacaagctgatctgggagcgattcgtcgcgagccagatggagtcggccgtcctcgacaccacatcggtcgacctcgaggcgaatggcgcgtggtttcgcgcgacgggatcagtcgtccggttccccggattcatggcgctctacacggagggccgcgacgacgacgccgatgaagaggaagggaagctgcttccccccctgcaagagggcgatgtggtccaggtgaagacctggaaaccggagcagcattttacccagccgccgccgcgctacaccgagtcgacgctcgtgaaggcgatggaagaactcgggattggtcggccgagcacgtacgcgcctaccatcgacatcctgttgaagcgcggatacgtgacgctcgatcagaagcggtttgtccccaccgaactcggggaaatcgtggtgaacattctcaaggaacatttcccccagctcatcgacgtgtccttcaccgccgacatggagagccgattggacaaagtcgaggagggcaacgcgaactggatcgagctgctcgatcagttttatcatgactttgagaaggatttaaagaaggcggaaagcgccctggggcacgtcgaattgaaggacgaggtgtccgacgtccgctgtgaaaagtgcggccgcctcatggtgtacaagacgggcaggtacgggaagtttctcgcgtgtccggggttcccggagtgccgaaacacgaaacccatcttgaaggagatcccggtctcgtgcccgaagtgcggcaaaccgcttgtggaacgaaaagggaaatcgaggaaagtgttttacgggtgcagcgggtatcccgagtgtgactacgtgctttggcagcgcccgacgggtcagacgtgcccggtctgcggacacccgatgattgaaaaaggcggaaaaggaaagacggttgtggtgtgcagcaacgaaaaagctcacccgatggtggcaaccgaggcacaggcgaaatga

SEQ ID NO: 1800 - DNA, 2142 bp, Artificial
  Alicyclobacillus acidocaldarius mutated SEQ ID NO 1787
ttgaaccaaggacagggtttgccaaggctgcgacgaatggaggatcgtggcgtgtcagactatctggtcatcgtcgagtcgcccgccaaggcgaagacgattgggaagtatctggggagcaagtacacggtgaaagcctccatgggccacgtgcgagacctgcccaagagccaactcggcgtcgacgtggaacatggttttgaaccgaaatatatcacgatccgcgggaagggcgacgtcatcaaggcgctccgcgaggcgagcaagaaggcgaagaaggtctacctcgcggcagaccctgaccgcgaaggcgaagccatcgcctggcacctgcagcatctgctcgatctcaatcctgacgatgactgtcgcgtcgtgtttcacgagatcacgaaggatgcggtcaaacaggcgtttcaacatccgaggaaaatcaatctggatctcgtgaacgcgcagcagacgcggcgcatcttggaccgcctcgtgggctacaagctgagtcccttgctgtggcgaaaggtaaaaaagggcttgtcggctggccgcgtgcagtcggtcgcactgaggctcatcgtcgatcgcgaaaacgaaatccgaacgtttcaacctgaggagtactggaccgtcgacgcccatggccaggtgcacgggaagaagctcgtggctcgcttttatggctacggcgaggaaaagacaccgcttccaaacgaggctgccgtgcgcgaacttctgtcccgtgtggaaggccactcgttggtcgtgcgccgggtcaagaaatccgagcggaagcgaaaccccgctgcgccgttcacgacgagcagtcttcaacaggaggcggcccgaaaactcgggtttcgggcgtacaaaaccatgcaaattgcgcagcagttgtacgaaggtctcgacgtgccgggtgaaggcacggtcggtctcatcacctacatgcgaacggattcgacacgcatcgcgcaatccgcgcaggaggaagcgagggcctacattcggcaatcgtttggcgaggactacgtgccggatcggccgcggcaatacgcgaaaaacgaggatgcccaagacgcgcacgaggcgattcggcccacgtcggtgatgcgacatccggatcgactgaaggatcacttgtcgcgcgatcagtatcgcctctacaagctgatctgggagcgattcgtcgcgagccagatggagtcggccgtcctcgacaccacatcggtcgacctcgaggcgaatggcgcgtggtttcgcgcgacgggatcagtcgtccggttccccggattcatggcgctctacacggagggccgcgacgacgacgccgatgaagaggaagggaagctgcttccccccctgcaagagggcgatgtggtccaggtgaagacctggaaaccggagcagcattttacccagccgccgccgcgctacaccgagtcgacgctcgtgaaggcgatggaagaactcgggattggtcggccgagcacgtacgcgcctaccatcgacttactgttgaagcgcggatacgtgacgctcgatcagaagcggtttgtccccaccgaactcggggaaatcgtggtgaacattctcaaggaacatttcccccagctcatcgacgtgtccttcaccgccgacatggagagccgattggacaaagtcgaggagggcaacgcgaactggatcgagctgctcgatcagttttatcatgactttgagaaggatttaaagaaggcggaaagcgccctggggcacgtcgaattgaaggacgaggtgtccgacgtccgctgtgaaaagtgcggccgcctcatggtgtacaagacgggcaggtacgggaagtttctcgcgtgtccggggttcccggagtgccgaaacacgaaacccatcttgaaggagatcccggtctcgtgcccgaagtgcggcaaaccgcttgtggaacgaaaagggaaatcgaggaaagtgttttacgggtgcagcgggtatcccgagtgtgactacgtgctttggcagcgcccgacgggtcagacgtgcccggtctgcggacacccgatgattgaaaaaggcggaaaaggaaagacggttgtggtgtgcagcaacgaaaaagctcacccgatggtggcaaccgaggcacaggcgaaatga

SEQ ID NO: 1801 - DNA, 2142 bp, Artificial
  Alicyclobacillus acidocaldarius mutated SEQ ID NO 1787
ttgaaccaaggacagggtttgccaaggattcgacgaatggaggatcgtggcgtgtcagactatctggtcatcgtcgagtcgcccgccaaggcgaagacgattgggaagtatctggggagcaagtacacggtgaaagcctccatgggccacgtgcgagacctgcccaagagccaactcggcgtcgacgtggaacatggttttgaaccgaaatatatcacgatccgcgggaagggcgacgtcatcaaggcgctccgcgaggcgagcaagaaggcgaagaaggtctacctcgcggcagaccctgaccgcgaaggcgaagccatcgcctggcacctgcagcatctgctcgatctcaatcctgacgatgactgtcgcgtcgtgtttcacgagatcacgaaggatgcggtcaaacaggcgtttcaacatccgaggaaaatcaatctggatctcgtgaacgcgcagcagacgcggcgcatcttggaccgcctcgtgggctacaagctgagtcccttgctgtggcgaaaggtaaaaaagggcttgtcggctggccgcgtgcagtcggtcgcactgaggctcatcgtcgatcgcgaaaacgaaatccgaacgtttcaacctgaggagtactggaccgtcgacgcccatggccaggtgcacgggaagaagctcgtggctcgcttttatggctacggcgaggaaaagacaccgcttccaaacgaggctgccgtgcgcgaacttctgtcccgtgtggaaggccactcgttggtcgtgcgccgggtcaagaaatccgagcggaagcgaaaccccgctgcgccgttcacgacgagcagtcttcaacaggaggcggcccgaaaactcgggtttcgggcgtacaaaaccatgcaaattgcgcagcagttgtacgaaggtctcgacgtgccgggtgaaggcacggtcggtctcatcacctacatgcgaacggattcgacacgcatcgcgcaatccgcgcaggaggaagcgagggcctacattcggcaatcgtttggcgaggactacgtgccggatcggccgcggcaatacgcgaaaaacgaggatgcccaagacgcgcacgaggcgattcggcccacgtcggtgatgcgacatccggatcgactgaaggatcacttgtcgcgcgatcagtatcgcctctacaagctgatctgggagcgattcgtcgcgagccagatggagtcggccgtcctcgacaccacatcggtcgacctcgaggcgaatggcgcgtggtttcgcgcgacgggatcagtcgtccggttccccggattcatggcgctctacacggagggccgcgacgacgacgccgatgaagaggaagggaagctgcttccccccctgcaagagggcgatgtggtccaggtgaagacctggaaaccggagcagcattttacccagccgccgccgcgctacaccgagtcgacgctcgtgaaggcgatggaagaactcgggattggtcggccgagcacgtacgcgcctaccatcgacatcctgttgaagcgcggatacgtgacgctcgatcagaagcggtttgtccccaccgaactcggggaaatcgtggtgaacattctcaaggaacatttcccccagctcatcgacgtgtccttcaccgccgacatggagagccgattggacaaagtcgaggagggcaacgcgaactggatcgagctgctcgatcagttttatcatgactttgagaaggatttaaagaaggcggaaagcgccctggggcacgtcgaattgaaggacgaggtgtccgacgtccgctgtgaaaagtgcggccgcctcatggtgtacaagacgggcaggtacgggaagtttctcgcgtgtccggggttcccggagtgccgaaacacgaaacccatcttgaaggagatcccggtctcgtgcccgaagtgcggcaaaccgcttgtggaacgaaaagggaaatcgaggaaagtgttttacgggtgcagcgggtatcccgagtgtgactacgtgctttggcagcgcccgacgggtcagacgtgcccggtctgcggacacccgatgattgaaaaaggcggaaaaggaaagacggttgtggtgtgcagcaacgaaaaagctcacccgatggtggcaaccgaggcacaggcgaaatga

SEQ ID NO: 1802 - DNA, 2142 bp, Artificial
  Alicyclobacillus acidocaldarius mutated SEQ ID NO 1787
ttgaaccaaggacagggtttgccaaggctgcgacgaatggaggatcgtggcgtgtcagactatctggtcatcgtcgagtcgcccgccaaggcgaagacgattgggaagtatctggggagcaagtacacggtgaaagcctccatgggccacgtgcgagacctgcccaagagccaactcggcgtcgacgtggaacatggttttgaaccgaaatatatcacgatccgcgggaagggcgacgtcatcaaggcgctccgcgaggcgagcaagaaggcgaagaaggtctacctcgcggcagaccctgaccgcgaaggcgaagccatcgcctggcacctgcagcatctgctcgatctcaatcctgacgatgactgtcgcgtcgtgtttcacgagatcacgaaggatgcggtcaaacaggcgtttcaacatccgaggaaaatcaatctggatctcgtgaacgcgcagcagacgcggcgcatcttggaccgcctcgtgggctacaagctgagtcccttgctgtggcgaaaggtaaaaaagggcttgtcggctggccgcgtgcagtcggtcgcactgaggctcatcgtcgatcgcgaaaacgaaatccgaacgtttcaacctgaggagtactggaccgtcgacgcccatggccaggtgcacgggaagaagctcgtggctcgcttttatggctacggcgaggaaaagacaccgcttccaaacgaggctgccgtgcgcgaacttctgtcccgtgtggaaggccactcgttggtcgtgcgccgggtcaagaaatccgagcggaagcgaaaccccgctgcgccgttcacgacgagcagtcttcaacaggaggcggcccgaaaactcgggtttcgggcgtacaaaaccatgcaaattgcgcagcagttgtacgaaggtctcgacgtgccgggtgaaggcacggtcggtctcatcacctacatgcgaacggattcgacacgcatcgcgcaatccgcgcaggaggaagcgagggcctacattcggcaatcgtttggcgaggactacgtgccggatcggccgcggcaatacgcgaaaaacgaggatgcccaagacgcgcacgaggcgattcggcccacgtcggtgatgcgacatccggatcgactgaaggatcacttgtcgcgcgatcagtatcgcctctacaagctgatctgggagcgattcgtcgcgagccagatggagtcggccgtcctcgacaccacatcggtcgacctcgaggcgaatggcgcgtggtttcgcgcgacgggatcagtcgtccggttccccggattcatggcgctctacacggagggccgcgacgacgacgccgatgaagaggaagggaagctgcttccccccctgcaagagggcgatgtggtccaggtgaagacctggaaaccggagcagcattttacccagccgccgccgcgctacaccgagtcgacgctcgtgaaggcgatggaagaactcgggattggtcggccgagcacgtacgcgcctaccatcgacatcctgttgaagcgcggatacgtgacgctcgatcagaagcggtttgtccccaccgaactcggggaaatcgtggtgaacattctcaaggaacatttcccccagctcatcgacgtgtccttcaccgccgacatggagagccgattggacaaagtcgaggagggcaacgcgaactggatcgagctgctcgatcagttttatcatgactttgagaaggatttaaagaaggcggaaagcgccctggggcacgtcgaattgaaggacgaggtgtccgacgtccgctgtgaaaagtgcggccgcctcatggtgtacaagacgggcaggtacgggaagtttctcgcgtgtccggggttcccggagtgccgaaacacgaaacccatcttgaaggagatcccggtctcgtgcccgaagtgcggcaaaccgcttgtggaacgaaaagggaaatcgaggaaagtgttttacgggtgcagcgggtatcccgagtgtgactacgtgctttggcagcgcccgacgggtcagacgtgcccggtctgcggacacccgatgattgaaaaaggcggaaaaggaaagacgattgtggtgtgcagcaacgaaaaagctcacccgatggtggcaaccgaggcacaggcgaaatga

SEQ ID NO: 1803 - protein, 307 aa, Alicyclobacillus acidocaldarius
MTQSVGDAVKVFLDDAALRFSPRTVRSYGQDLEAFRQWLDDRGVYDLDALSTRDVRMHASDLLAKGAAKSSVARRLSCLRTFLRFCAERGWVRQVMAKNVRLPKRDRRLPRYLHEEEVAALIDHVGGDDFVALRDRALLEFLYATGVRVSECVHLDIGDLDLSAGFARVLGKGGRERYVMVGRRAVDALRRYLPLRDRMARCSAVFINRRGGRLTDRSVRRVLERRIQEVPGLRSIHVHGLRHSFATHMLNGGADLRSVQELLGHASLSSTQIYTHTSREQLARAYYAAHPRARRGTQGRESSEDGV

SEQ ID NO: 1804 - DNA, 924 bp, Alicyclobacillus acidocaldarius
gtgacgcaatccgtcggagatgcggtcaaagtttttttggacgatgctgcacttcgcttcagcccgcggaccgtgcgcagttacgggcaggatctcgaggctttccgccagtggctcgacgatcgcggcgtctatgatctagacgcgctctcgacgcgcgatgtgcggatgcacgcgagcgacttgctggcgaaaggggccgcgaagtccagcgtagcgaggcggctctcgtgtctccggacgttcttgcggttctgcgcggagcggggctgggtccggcaggtgatggctaaaaacgttcgtcttccgaagcgagaccggcgacttccgcgctatctgcacgaggaagaggtggcggcgctcatcgatcacgtcgggggcgacgattttgtggccctgcgagatcgggcgctgttggaatttctctatgcaacgggcgtgcgcgtgagcgaatgtgtgcacttggacataggcgatctcgacctttcggcggggtttgcgcgcgttctgggcaaaggcgggcgcgagcggtacgtgatggtaggacggcgggccgtcgatgcacttcggcgctatcttccgctccgcgatcggatggcacgttgctcggcggtgttcatcaatcgccgcggcggccgcctgaccgaccgaagcgtgcggcgcgtgttggagcgtcggattcaggaagtccccggacttcgctccatccacgtgcatggccttcggcattcgttcgcgacgcacatgctgaacggaggggcggacctccgaagcgtccaggagctgttggggcacgcgagcctgtcgagcacacagatttacacgcacacgagccgcgagcaattggctcgggcgtactacgcggcgcatccccgcgcacgtcgaggcacacagggacgggagtcgagcgaagatggggtatga

SEQ ID NO: 1805 - protein, 283 aa, Geobacillus thermodenitrificans
ALQLFLEYLQIEKNYSQYTIVCYRRDIEQFLQFMNEEGIDELNEVAYSDVRLYLTKLYGQQLASRSVARKISSLRSFYKFLLREGWTAENPFALAALPKKEQKIPNFLYREELEALFRVNDGNTAVGQRNAALLELLYATGARVSECCHIRLSDLDFAASTVLIHGKGNKQRYVPFGRPAREALERYIGGGRRELVGKLPADHRYLFVNARGNPLTPRGVRYILDRIVETAALTQNISPHVLRHTFATHLLNEGADLRSVQELLGHAHLSSTQVYTHVTKDRL

SEQ ID NO: 1806 - protein, 262 aa, Geobacter bemidjiensis
SPHTLAAYRSDLEQFLSFLAREREAPRAEEVDHLAIRRYLAQLHKGCAKSSIGRKLSAIRALFRYLMREGKLEKNPAELVSTPKKEKRLPFHLNIDQVSALVTAPAGSSGLPLRDRAVLETLYSCGIRVSELTGMNVGDMDLAAGLARVMGKGGKERLVPVGSCARSALAAYLAERADPGPAEPLILNARGGRLTRRSVARIVDAHMLLIAAMRKVSPHTLRHTFATHLLEGGADLRAIQELLGHASLSTTQKYTHVSIDKL

SEQ ID NO: 1807 - protein, 264 aa, Bacillus clausii
TIDHYRKDVQQFAAFMSAAGIAEIKDVKHQDVRLFISELVDKKYARKSIARKLSALRSFGKFLMEEGHISENPFLHTHLPKQKTRLPTFLYEEEMEHWLLALPANKPLEKRDKAIIELLYATGMRVSECSMLALDQWDRVSETVRVFGKGRKERYVPVGKMAVSAVESYIHEARPKLLRANDPTSHLFLNYRGGALSDRSIRKIVEKRLDEAAMQKKISPHAIRHSFATHLLNAGADLRAVQELLGHQSLKTTQVYTHVSKERL

SEQ ID NO: 1808 - protein, 270 aa, Bacillus halodurans
SPHTIVNYELDLRHFRDFMEQQSIPSFAAVSYAFVRHYLTVLYEQEYARSTVSRKLSTLRSFYQFLVREKWVMENPFLLAHTPKGVKKLPSFLYEEEMEQLLDALNGDSPLQLRNRALFETIYASGLRVSECCGLKLQDVDLSIGTVFVFGKGRKERYVPIGSFACDAIQEYIENGREKLLKKSKSVDLPGDLFLNYRGGPLTERGVRKILHQALDQAALSTRVSPHSLRHSFATHLLNNGADLRVVQDLLGHENLSTTQVYTHVTKDRL

SEQ ID NO: 1809 - protein, 264 aa, Alkalilimnicola ehrlichei
SPHTLQAYQRDLTRFHHWCAENGLADRDAVSAHDIRRFAAARHRQGLAPGSVQRTLSSLRSLFRYLVREGRLTGNPAEGVAAPRRPRRLPGVLSPDEAARLLEGSPEDDPLALRDRALYELIYSSGLRLAEAVGLDLGRLDLTEGLVEVVGKGAKTRRVPVGGKAREALQAWLAVRPALAGADEPAVFVSQRGGRLSARSVQARLARLATLSGVGRPVHPHMLRHSFASHLLESSGDLRAVQELLGHADIATTQVYTHLDFQHL

SEQ ID NO: 1810 - protein, 307 aa, Artificial
  Alicyclobacillus acidocaldarius mutated SEQ ID NO 1803
MTQSVGDAVKVFLDDAALRFSPRTVRSYGQDLEAFRQWLDDRGVYDLDALSTRDVRMHASDLLAKGAAKSSVARRLSCLRTFLRFCAERGWVRQVMAKNVRLPKRDRRLPRYLHEEEVAALIDHVGGDDFVALRDRALLEFLYATGVRVSECVHLDIGELDLSAGFARVLGKGGRERYVMVGRRAVDALRRYLPLRDRMARCSAVFINRRGGRLTDRSVRRVLERRIQEVPGLRSIHVHGLRHSFATHMLNGGADLRSVQELLGHASLSSTQIYTHTSREQLARAYYAAHPRARRGTQGRESSEDGV

SEQ ID NO: 1811 - protein, 307 aa, Artificial
  Alicyclobacillus acidocaldarius mutated SEQ ID NO 1803
MTQSVGDAVKVFLDDAALRFSPRTVRSYGQDLEAFRQWLDDRGVYDLDALSTRDVRMHASDLLAKGAAKSSVARRLSCLRTFLRFCAERGWVRQVMAKNVRLPKRDRRLPRYLHEEEVAALIDHVGGDDFVALRDRALLEFLYATGVRVSECVHLDIGDLDLSAGFARVLGKGGRERYVMVGRRAVDALRRYLPLRDRMARCSAVFINRRGGRLTDRSVRRVLERRIQEVPGLRSIHVHGLRHSFATHMLNGGADLRSVQELLGHASLSSTQIYTHTSREQLARAYYAAHPRARRGTQGRESSDDGV

SEQ ID NO: 1812 - protein, 307 aa, Artificial
  Alicyclobacillus acidocaldarius mutated SEQ ID NO 1803
MTQSVGDAVKVFLDDAALRFSPRTVRSYGQDLEAFRQWLDDRGVYDLDALSTRDVRMHASDLLAKGAAKSSVARRLSCLRTFLRFCAERGWVRQVMAKNVRLPKRDRRLPRYLHEEEVAALIDHVGGDDFVALRDRALLEFLYATGVRVSECVHLDIGDLDLSAGFARVLGKGGRERYVMVGKRAVDALRRYLPLRDRMARCSAVFINRRGGRLTDRSVRRVLERRIQEVPGLRSIHVHGLRHSFATHMLNGGADLRSVQELLGHASLSSTQIYTHTSREQLARAYYAAHPRARRGTQGRESSEDGV

SEQ ID NO: 1813 - protein, 307 aa, Artificial
  Alicyclobacillus acidocaldarius mutated SEQ ID NO 1803
MTQSVGDAVKVFLDDAALRFSPRTVRSYGQDLEAFRQWLDDRGVYDLDALSTRDVRMHASDLLAKGAAKSSVARRLSCLRTFLRFCAERGWVRQVMAKNVRLPKRDRRLPRYLHEEEVAALIDHVGGDDFVALRDRALLEFLYATGVRVSECVHLDIGDLDLSAGFARVLGKGGRERYVMVGRRAVDALRRYLPLRDKMARCSAVFINRRGGRLTDRSVRRVLERRIQEVPGLRSIHVHGLRHSFATHMLNGGADLRSVQELLGHASLSSTQIYTHTSREQLARAYYAAHPRARRGTQGRESSEDGV

SEQ ID NO: 1814 - protein, 307 aa, Artificial
  Alicyclobacillus acidocaldarius mutated SEQ ID NO 1803
MTQSVGDAVKVFLDDAALRFSPRTVRSYGQDLEAFRQWLDDRGVYDLDALSTRDVRMHASDLLAKGAAKSSVARRLSCLRTFLRFCAERGWVRQVMAKNVRLPKRDRRLPRYLHDEEVAALIDHVGGDDFVALRDRALLEFLYATGVRVSECVHLDIGDLDLSAGFARVLGKGGRERYVMVGRRAVDALRRYLPLRDRMARCSAVFINRRGGRLTDRSVRRVLERRIQEVPGLRSIHVHGLRHSFATHMLNGGADLRSVQELLGHASLSSTQIYTHTSREQLARAYYAAHPRARRGTQGRESSEDGV

SEQ ID NO: 1815 - DNA, 924 bp, Artificial
  Alicyclobacillus acidocaldarius mutated SEQ ID NO 1804
gtgacgcaatccgtcggagatgcggtcaaagtttttttggacgatgctgcacttcgcttcagcccgcggaccgtgcgcagttacgggcaggatctcgaggctttccgccagtggctcgacgatcgcggcgtctatgatctagacgcgctctcgacgcgcgatgtgcggatgcacgcgagcgacttgctggcgaaaggggccgcgaagtccagcgtagcgaggcggctctcgtgtctccggacgttcttgcggttctgcgcggagcggggctgggtccggcaggtgatggctaaaaacgttcgtcttccgaagcgagaccggcgacttccgcgctatctgcacgaggaagaggtggcggcgctcatcgatcacgtcgggggcgacgattttgtggccctgcgagatcgggcgctgttggaatttctctatgcaacgggcgtgcgcgtgagcgaatgtgtgcacttggacataggcgaactcgacctttcggcggggtttgcgcgcgttctgggcaaaggcgggcgcgagcggtacgtgatggtaggacggcgggccgtcgatgcacttcggcgctatcttccgctccgcgatcggatggcacgttgctcggcggtgttcatcaatcgccgcggcggccgcctgaccgaccgaagcgtgcggcgcgtgttggagcgtcggattcaggaagtccccggacttcgctccatccacgtgcatggccttcggcattcgttcgcgacgcacatgctgaacggaggggcggacctccgaagcgtccaggagctgttggggcacgcgagcctgtcgagcacacagatttacacgcacacgagccgcgagcaattggctcgggcgtactacgcggcgcatccccgcgcacgtcgaggcacacagggacgggagtcgagcgaagatggggtatga

SEQ ID NO: 1816 - DNA, 924 bp, Artificial
  Alicyclobacillus acidocaldarius mutated SEQ ID NO 1804
gtgacgcaatccgtcggagatgcggtcaaagtttttttggacgatgctgcacttcgcttcagcccgcggaccgtgcgcagttacgggcaggatctcgaggctttccgccagtggctcgacgatcgcggcgtctatgatctagacgcgctctcgacgcgcgatgtgcggatgcacgcgagcgacttgctggcgaaaggggccgcgaagtccagcgtagcgaggcggctctcgtgtctccggacgttcttgcggttctgcgcggagcggggctgggtccggcaggtgatggctaaaaacgttcgtcttccgaagcgagaccggcgacttccgcgctatctgcacgaggaagaggtggcggcgctcatcgatcacgtcgggggcgacgattttgtggccctgcgagatcgggcgctgttggaatttctctatgcaacgggcgtgcgcgtgagcgaatgtgtgcacttggacataggcgatctcgacctttcggcggggtttgcgcgcgttctgggcaaaggcgggcgcgagcggtacgtgatggtaggacggcgggccgtcgatgcacttcggcgctatcttccgctccgcgatcggatggcacgttgctcggcggtgttcatcaatcgccgcggcggccgcctgaccgaccgaagcgtgcggcgcgtgttggagcgtcggattcaggaagtccccggacttcgctccatccacgtgcatggccttcggcattcgttcgcgacgcacatgctgaacggaggggcggacctccgaagcgtccaggagctgttggggcacgcgagcctgtcgagcacacagatttacacgcacacgagccgcgagcaattggctcgggcgtactacgcggcgcatccccgcgcacgtcgaggcacacagggacgggagtcgagcgatgatggggtatga

SEQ ID NO: 1817 - DNA, 924 bp, Artificial
  Alicyclobacillus acidocaldarius mutated SEQ ID NO 1804
gtgacgcaatccgtcggagatgcggtcaaagtttttttggacgatgctgcacttcgcttcagcccgcggaccgtgcgcagttacgggcaggatctcgaggctttccgccagtggctcgacgatcgcggcgtctatgatctagacgcgctctcgacgcgcgatgtgcggatgcacgcgagcgacttgctggcgaaaggggccgcgaagtccagcgtagcgaggcggctctcgtgtctccggacgttcttgcggttctgcgcggagcggggctgggtccggcaggtgatggctaaaaacgttcgtcttccgaagcgagaccggcgacttccgcgctatctgcacgaggaagaggtggcggcgctcatcgatcacgtcgggggcgacgattttgtggccctgcgagatcgggcgctgttggaatttctctatgcaacgggcgtgcgcgtgagcgaatgtgtgcacttggacataggcgatctcgacctttcggcggggtttgcgcgcgttctgggcaaaggcgggcgcgagcggtacgtgatggtaggaaaacgggccgtcgatgcacttcggcgctatcttccgctccgcgatcggatggcacgttgctcggcggtgttcatcaatcgccgcggcggccgcctgaccgaccgaagcgtgcggcgcgtgttggagcgtcggattcaggaagtccccggacttcgctccatccacgtgcatggccttcggcattcgttcgcgacgcacatgctgaacggaggggcggacctccgaagcgtccaggagctgttggggcacgcgagcctgtcgagcacacagatttacacgcacacgagccgcgagcaattggctcgggcgtactacgcggcgcatccccgcgcacgtcgaggcacacagggacgggagtcgagcgaagatggggtatga

SEQ ID NO: 1818 - DNA, 924 bp, Artificial
  Alicyclobacillus acidocaldarius mutated SEQ ID NO 1804
gtgacgcaatccgtcggagatgcggtcaaagtttttttggacgatgctgcacttcgcttcagcccgcggaccgtgcgcagttacgggcaggatctcgaggctttccgccagtggctcgacgatcgcggcgtctatgatctagacgcgctctcgacgcgcgatgtgcggatgcacgcgagcgacttgctggcgaaaggggccgcgaagtccagcgtagcgaggcggctctcgtgtctccggacgttcttgcggttctgcgcggagcggggctgggtccggcaggtgatggctaaaaacgttcgtcttccgaagcgagaccggcgacttccgcgctatctgcacgaggaagaggtggcggcgctcatcgatcacgtcgggggcgacgattttgtggccctgcgagatcgggcgctgttggaatttctctatgcaacgggcgtgcgcgtgagcgaatgtgtgcacttggacataggcgatctcgacctttcggcggggtttgcgcgcgttctgggcaaaggcgggcgcgagcggtacgtgatggtaggacggcgggccgtcgatgcacttcggcgctatcttccgctccgcgataaaatggcacgttgctcggcggtgttcatcaatcgccgcggcggccgcctgaccgaccgaagcgtgcggcgcgtgttggagcgtcggattcaggaagtccccggacttcgctccatccacgtgcatggccttcggcattcgttcgcgacgcacatgctgaacggaggggcggacctccgaagcgtccaggagctgttggggcacgcgagcctgtcgagcacacagatttacacgcacacgagccgcgagcaattggctcgggcgtactacgcggcgcatccccgcgcacgtcgaggcacacagggacgggagtcgagcgaagatggggtatga

SEQ ID NO: 1819 - DNA, 924 bp, Artificial
  Alicyclobacillus acidocaldarius mutated SEQ ID NO 1804
gtgacgcaatccgtcggagatgcggtcaaagtttttttggacgatgctgcacttcgcttcagcccgcggaccgtgcgcagttacgggcaggatctcgaggctttccgccagtggctcgacgatcgcggcgtctatgatctagacgcgctctcgacgcgcgatgtgcggatgcacgcgagcgacttgctggcgaaaggggccgcgaagtccagcgtagcgaggcggctctcgtgtctccggacgttcttgcggttctgcgcggagcggggctgggtccggcaggtgatggctaaaaacgttcgtcttccgaagcgagaccggcgacttccgcgctatctgcacgatgaagaggtggcggcgctcatcgatcacgtcgggggcgacgattttgtggccctgcgagatcgggcgctgttggaatttctctatgcaacgggcgtgcgcgtgagcgaatgtgtgcacttggacataggcgatctcgacctttcggcggggtttgcgcgcgttctgggcaaaggcgggcgcgagcggtacgtgatggtaggacggcgggccgtcgatgcacttcggcgctatcttccgctccgcgatcggatggcacgttgctcggcggtgttcatcaatcgccgcggcggccgcctgaccgaccgaagcgtgcggcgcgtgttggagcgtcggattcaggaagtccccggacttcgctccatccacgtgcatggccttcggcattcgttcgcgacgcacatgctgaacggaggggcggacctccgaagcgtccaggagctgttggggcacgcgagcctgtcgagcacacagatttacacgcacacgagccgcgagcaattggctcgggcgtactacgcggcgcatccccgcgcacgtcgaggcacacagggacgggagtcgagcgaagatggggtatga

SEQ ID NO: 1820 - protein, 424 aa, Alicyclobacillus acidocaldarius
MVECETEKKPLHQEGYRMAQYQITVDDEILEGLFQRDGGVAKLVESVVNQILQAQVQEQLKAAPYERTKERQGYRNGTVTRTLTTRVGRLVLRVPRVRNGQFSTELFARYQRSEQAFIIALMEMVVNGVSTRDVAKITEQLCGTTFSKSTVSELCKRLDPIGQGWNHRSLAEHRYPFLLVDALVLRIREEGRDRSRAAMIAVGINEEGYRGILGLMLGDSESEASWREFFAWLKNRGLRGVDVVVSDSHGGLVKALHTEFQGCTWQRCQTHFMRNLLDATPKALQEEVYQQVRAVLDAPDLKTARLLKDAFVEAYAEKAPKAVQVLEDGFDDVTAVLVLPERYRRRLRTTNGVERLNEEIRRRERVIRIFPNRESAIRLLGALLMEIDEEWTTGRKYLNMDEYEAWKKAQEASRGSTQACAATA

SEQ ID NO: 1821 - DNA, 1275 bp, Alicyclobacillus acidocaldarius
ttggtagaatgtgagacggagaagaaaccattacaccaggagggataccggatggctcagtaccagattaccgtggacgacgagattttggaaggcctctttcagcgggatggaggcgtggcaaagctggtggagagtgtggtcaaccagatcctccaagcgcaagtgcaggagcagctgaaagcggcgccatacgagcgcacgaaagaacgccaaggctatcgcaacggaacagtcacccgcacccttacaacccgtgtggggcggctggtgttgcgggttccgagggtccggaatggccagttctccacagagctgtttgctcggtaccagcgcagcgaacaagcgttcatcatcgccctaatggagatggttgtgaatggcgtgtccacccgggacgtggcgaaaatcaccgagcagttgtgcggcacgacgttctcgaagtccacggtctccgagctgtgcaagcgccttgatcccatcggtcagggatggaatcatcgcagccttgctgagcaccgttatccgttcctgctggtggacgctttggtactccggattcgggaggaagggcgtgatcgctctcgagcggccatgatcgcagttggcatcaacgaagaagggtatcgtgggattctcggcttgatgctgggcgacagcgaatcggaggccagttggcgggagttctttgcctggctgaagaaccggggtctccgcggcgttgacgttgtggtgtctgacagtcatggcgggctggtgaaggcactgcacacggagtttcagggatgcacctggcaacggtgccagacacactttatgcgcaacctcttagacgccacaccgaaggcattgcaggaggaggtctaccaacaggtccgcgcggtcctggatgcgcctgacctgaagactgcacggttgctcaaagatgcgtttgtcgaggcttacgcagagaaggcaccgaaggcggtgcaggtgttggaggatgggtttgatgatgtaaccgctgttttggtcttacctgagcgatatcggcggcgcttacgcaccaccaacggtgtcgaacggctcaacgaagaaattcggcgccgcgagcgcgtcattcgcatcttccccaaccgggaatcggcgatccgtctgctgggggcgttactcatggaaatcgacgaagaatggacgacggggcggaaatatctcaacatggacgagtatgaggcatggaagaaggcacaggaggcttcgagagggtcaacgcaggcttgtgcagcaacggcctaa

SEQ ID NO: 1822 - protein, 400 aa, Pelotomaculum thermopropionicum
MAQYQITVNQELLHQLFLSNNKDSGIAALLESVLNQILQAQATEQLQAGPYERTDERKGYRNGTYPHQLTTRVGTITLRVPRFRNGQFSTEMFARYQRSEQALVLTLMEMVINGVSTRKISQITEELCGAEFSKSTVSDLCKKLDPLVISWNNRDLREMRYPFILVDALVLKVREDGRVRSRGVMIAIGLNTEGYREVLGIMLGDSESEASWSEFFSWLKNRNLRGVDLVVSDDHSGLVKAVRNHFQGVTWQRCQTHFMRNIMDSAPKSVKEELYPRLRAILDAPDIGSARLLLNQTLEAFEKKAPRAMRVLEMGFDDATAVLVLPEKYRLRLRTTNGVERLIEEVRRRERVIRIFPNRESVVRLIGALLMEIDDKWAAGKKYLDMAEYLQWQKEQKHDR

SEQ ID NO: 1823 - protein, 374 aa, Bacillus  JF8
MAQYQITLDSQLLHQLFLSNAHDAGVAKLLESVLNQVLQAQATEQLGAEPYERTEERQGYRNGTYPHQLTTRVGTITLRVPRIRNGKFSTELFARYQRSEQALVLALMEMVVNGVSTRKVAQITEELCGTEFSKSTVSELCKRLDPVVTAWNNRPLDDHPFPFVIVDALVLKVREESRVRSRGALIGIGVNTDGYREVLGLMLGDSESEASWSEFFGWLKSRGLQGVDLIVSDDHGGLIRAIRRHFQGVTWQRCQTHFIRNILDATPKELQDEVHSWVRAILDAPDLDTARLLLNQVLETYETKAPKAMAILEAGFEDATAVLLLPEKYRKRLRTTNALERLNEEIRRRERVIRIFPNRESAMRLIGALLMEID

SEQ ID NO: 1824 - protein, 396 aa, Thermosinus carboxydivorans
MAQYQINIDSKILHQLFLSNAKDAAMASFLEEVLNQILQAQATEQLRAERYERTDERQGYRNGVYPHRLTTRVGTITLKVPRFRDGKFSTEMFARYQRSEQALVLTLMEMVVNGVSTRKVAQITEELCGSEFSKSTVSDLCKRLDPIVHAWNERPLKDQKYPFVMVDAMVIKVREEERVRSRGVMIAVGINAEGYREVLGIMLGDSESEASWSEFFSWLKRRGLCGVDLIISDHHGGLIRAIRQYFQGVTWQRCQTHFIRNILDATPKSLQPEILARVRAILAAPDRETAVMLLNETLAAYETKAPKAMAILEAGFDDAIAVLALPEKYRKRLRTTNGVERLNEEVRRRERVIRIFPNRASALRLIGALLMEIDDKWASGKKYLDMTDYWDWRERQ

SEQ ID NO: 1825 - protein, 305 aa, Thermosinus carboxydivorans
MFARYQRSEQALVLTLMEMVVNGVSTRKVAQITEELCGSEFSKSTVSDLCKRLDPIVHAWNERPLKDQKYPFVMVDAMVIKVREEERVRSRGVMIAVGINAEGYREVLGIMLGDSESEASWSEFFSWLKRRGLCGVDLIISDHHGGLIRAIRQYFQGVTWQRCQTHFIRNILDATPKSLQPEILARVRAILAAPDRETAVMLLNETLAAYETKAPKAMAILEAGFDDAIAVLALPEKYRKRLRTTNGVERLNEEVRRRERVIRIFPNRASALRLIGALLMEIDDKWASGKKYLDMTDYWDWRERQ

SEQ ID NO: 1826 - protein, 402 aa, Leptospirillum  Group II
MAELNLTLNPDLLPNLLTEGGDGLKKLVESVLNQVLEAQMTEHLGADRHERTEERAGYRNGVRERTLTTRVGTVILRVPQTRDGSFSTDLFKRYQRSEQALVLSMMEMVVQGVSTRKVANITEELCGTRFSKSTVSQLSTGLSARVQAWKNRKLSSPYPFVLIDALVIRVRKNESVSPMAALIATGITAEGQREILGLTLGDSENEASWDDMLRDLKHRGLSGVDLIVSDDHKGLKNAAWKHFQGVRWQRCQVHFLRNILGHAPASQRGPLAQALSRLFRSETMEEARMVRNEILRTFEKKAPKAMECLEEGFDETLNILTFPKKYRVRLRSTNSQERLNEEIRRRERVIRIFPNEESAIRLIGALLSEFHEQWSTGKKYLDMTEYHEWKKQESFKTSSTLA

SEQ ID NO: 1827 - protein, 424 aa, Artificial
  Alicyclobacillus acidocaldarius mutated SEQ ID NO 1820
MVECETEKKPLHQEGYRMAQYQITVDDEILEGLFQRDGGVAKLVESVVNQILQAQVQEQLKAAPYERTKERQGYRNGTVTRTLTTRVGRLVLRVPRVRNGQFSTELFARYQRSEQAFIIALMEMVVNGVSTRDVAKITEQLCGTTFSKSTVSELCKRLDPIGQGWNHRSLAEHRYPFLLVDALVLRIREEGRDRSRAAMIAVGINEEGYRGILGLMLGDSESEASWREFFAWLKNRGLRGVDVVVSDSHGGLVKALHTEFQGCTWQRCQTHFMRNLLDATPKALQEEVYQQVRAVLDAPDLKTARLLKDAFVEAYAEKAPKAVQVLEDGFDDVTAVLVLPERYRRRLRTTNGVERLNEEIRRRERVIRIFPNRESAIRLLGALLMEIDEEWTTGRKYLNMDEYEAWKRAQEASRGSTQACAATA

SEQ ID NO: 1828 - protein, 424 aa, Artificial
  Alicyclobacillus acidocaldarius mutated SEQ ID NO 1820
MVECETEKKPLHQEGYRMAQYQITVDDEILEGLFQRDGGVAKLVESVVNQILQAQVQEQLKAAPYERTKERQGYKNGTVTRTLTTRVGRLVLRVPRVRNGQFSTELFARYQRSEQAFIIALMEMVVNGVSTRDVAKITEQLCGTTFSKSTVSELCKRLDPIGQGWNHRSLAEHRYPFLLVDALVLRIREEGRDRSRAAMIAVGINEEGYRGILGLMLGDSESEASWREFFAWLKNRGLRGVDVVVSDSHGGLVKALHTEFQGCTWQRCQTHFMRNLLDATPKALQEEVYQQVRAVLDAPDLKTARLLKDAFVEAYAEKAPKAVQVLEDGFDDVTAVLVLPERYRRRLRTTNGVERLNEEIRRRERVIRIFPNRESAIRLLGALLMEIDEEWTTGRKYLNMDEYEAWKKAQEASRGSTQACAATA

SEQ ID NO: 1829 - protein, 424 aa, Artificial
  Alicyclobacillus acidocaldarius mutated SEQ ID NO 1820
MVECETEKKPLHQEGYRMAQYQITVDDEILEGLFQRDGGVAKLVESVVNQILQAQVQEQLKAAPYERTKERQGYRNGTVTRTLTTRVGRLVLRVPRVRNGQFSTELFARYQRSEQAFIIALMEMVVNGVSTRDVAKITEQLCGTTFSKSTVSELCKRLDPIGQGWNHRSLAEHRYPFLLVDALVLRIREEGRDRSRAAMIAVGINEEGYRGILGLMLGDSESEASWREFFAWLKNRGLRGVDVVVSDSHGGLIKALHTEFQGCTWQRCQTHFMRNLLDATPKALQEEVYQQVRAVLDAPDLKTARLLKDAFVEAYAEKAPKAVQVLEDGFDDVTAVLVLPERYRRRLRTTNGVERLNEEIRRRERVIRIFPNRESAIRLLGALLMEIDEEWTTGRKYLNMDEYEAWKKAQEASRGSTQACAATA

SEQ ID NO: 1830 - protein, 424 aa, Artificial
  Alicyclobacillus acidocaldarius mutated SEQ ID NO 1820
MVECETEKKPLHQEGYRMAQYQITVDDEILEGLFQRDGGVAKLVESVVNQILQAQVNEQLKAAPYERTKERQGYRNGTVTRTLTTRVGRLVLRVPRVRNGQFSTELFARYQRSEQAFIIALMEMVVNGVSTRDVAKITEQLCGTTFSKSTVSELCKRLDPIGQGWNHRSLAEHRYPFLLVDALVLRIREEGRDRSRAAMIAVGINEEGYRGILGLMLGDSESEASWREFFAWLKNRGLRGVDVVVSDSHGGLVKALHTEFQGCTWQRCQTHFMRNLLDATPKALQEEVYQQVRAVLDAPDLKTARLLKDAFVEAYAEKAPKAVQVLEDGFDDVTAVLVLPERYRRRLRTTNGVERLNEEIRRRERVIRIFPNRESAIRLLGALLMEIDEEWTTGRKYLNMDEYEAWKKAQEASRGSTQACAATA

SEQ ID NO: 1831 - protein, 424 aa, Artificial
  Alicyclobacillus acidocaldarius mutated SEQ ID NO 1820
MVECETEKKPLHQEGYRMAQYQITVDDEILEGLFQRDGGVAKLVESVVNQILQAQVQEQLKAAPYERTKERQGYRNGTVTRTLTTRVGRLVLRIPRVRNGQFSTELFARYQRSEQAFIIALMEMVVNGVSTRDVAKITEQLCGTTFSKSTVSELCKRLDPIGQGWNHRSLAEHRYPFLLVDALVLRIREEGRDRSRAAMIAVGINEEGYRGILGLMLGDSESEASWREFFAWLKNRGLRGVDVVVSDSHGGLVKALHTEFQGCTWQRCQTHFMRNLLDATPKALQEEVYQQVRAVLDAPDLKTARLLKDAFVEAYAEKAPKAVQVLEDGFDDVTAVLVLPERYRRRLRTTNGVERLNEEIRRRERVIRIFPNRESAIRLLGALLMEIDEEWTTGRKYLNMDEYEAWKKAQEASRGSTQACAATA

SEQ ID NO: 1832 - DNA, 1275 bp, Artificial
  Alicyclobacillus acidocaldarius mutated SEQ ID NO 1821
ttggtagaatgtgagacggagaagaaaccattacaccaggagggataccggatggctcagtaccagattaccgtggacgacgagattttggaaggcctctttcagcgggatggaggcgtggcaaagctggtggagagtgtggtcaaccagatcctccaagcgcaagtgcaggagcagctgaaagcggcgccatacgagcgcacgaaagaacgccaaggctatcgcaacggaacagtcacccgcacccttacaacccgtgtggggcggctggtgttgcgggttccgagggtccggaatggccagttctccacagagctgtttgctcggtaccagcgcagcgaacaagcgttcatcatcgccctaatggagatggttgtgaatggcgtgtccacccgggacgtggcgaaaatcaccgagcagttgtgcggcacgacgttctcgaagtccacggtctccgagctgtgcaagcgccttgatcccatcggtcagggatggaatcatcgcagccttgctgagcaccgttatccgttcctgctggtggacgctttggtactccggattcgggaggaagggcgtgatcgctctcgagcggccatgatcgcagttggcatcaacgaagaagggtatcgtgggattctcggcttgatgctgggcgacagcgaatcggaggccagttggcgggagttctttgcctggctgaagaaccggggtctccgcggcgttgacgttgtggtgtctgacagtcatggcgggctggtgaaggcactgcacacggagtttcagggatgcacctggcaacggtgccagacacactttatgcgcaacctcttagacgccacaccgaaggcattgcaggaggaggtctaccaacaggtccgcgcggtcctggatgcgcctgacctgaagactgcacggttgctcaaagatgcgtttgtcgaggcttacgcagagaaggcaccgaaggcggtgcaggtgttggaggatgggtttgatgatgtaaccgctgttttggtcttacctgagcgatatcggcggcgcttacgcaccaccaacggtgtcgaacggctcaacgaagaaattcggcgccgcgagcgcgtcattcgcatcttccccaaccgggaatcggcgatccgtctgctgggggcgttactcatggaaatcgacgaagaatggacgacggggcggaaatatctcaacatggacgagtatgaggcatggaagcgtgcacaggaggcttcgagagggtcaacgcaggcttgtgcagcaacggcctaa

SEQ ID NO: 1833 - DNA, 1275 bp, Artificial
  Alicyclobacillus acidocaldarius mutated SEQ ID NO 1821
ttggtagaatgtgagacggagaagaaaccattacaccaggagggataccggatggctcagtaccagattaccgtggacgacgagattttggaaggcctctttcagcgggatggaggcgtggcaaagctggtggagagtgtggtcaaccagatcctccaagcgcaagtgcaggagcagctgaaagcggcgccatacgagcgcacgaaagaacgccaaggctataaaaacggaacagtcacccgcacccttacaacccgtgtggggcggctggtgttgcgggttccgagggtccggaatggccagttctccacagagctgtttgctcggtaccagcgcagcgaacaagcgttcatcatcgccctaatggagatggttgtgaatggcgtgtccacccgggacgtggcgaaaatcaccgagcagttgtgcggcacgacgttctcgaagtccacggtctccgagctgtgcaagcgccttgatcccatcggtcagggatggaatcatcgcagccttgctgagcaccgttatccgttcctgctggtggacgctttggtactccggattcgggaggaagggcgtgatcgctctcgagcggccatgatcgcagttggcatcaacgaagaagggtatcgtgggattctcggcttgatgctgggcgacagcgaatcggaggccagttggcgggagttctttgcctggctgaagaaccggggtctccgcggcgttgacgttgtggtgtctgacagtcatggcgggctggtgaaggcactgcacacggagtttcagggatgcacctggcaacggtgccagacacactttatgcgcaacctcttagacgccacaccgaaggcattgcaggaggaggtctaccaacaggtccgcgcggtcctggatgcgcctgacctgaagactgcacggttgctcaaagatgcgtttgtcgaggcttacgcagagaaggcaccgaaggcggtgcaggtgttggaggatgggtttgatgatgtaaccgctgttttggtcttacctgagcgatatcggcggcgcttacgcaccaccaacggtgtcgaacggctcaacgaagaaattcggcgccgcgagcgcgtcattcgcatcttccccaaccgggaatcggcgatccgtctgctgggggcgttactcatggaaatcgacgaagaatggacgacggggcggaaatatctcaacatggacgagtatgaggcatggaagaaggcacaggaggcttcgagagggtcaacgcaggcttgtgcagcaacggcctaa

SEQ ID NO: 1834 - DNA, 1275 bp, Artificial
  Alicyclobacillus acidocaldarius mutated SEQ ID NO 1821
ttggtagaatgtgagacggagaagaaaccattacaccaggagggataccggatggctcagtaccagattaccgtggacgacgagattttggaaggcctctttcagcgggatggaggcgtggcaaagctggtggagagtgtggtcaaccagatcctccaagcgcaagtgcaggagcagctgaaagcggcgccatacgagcgcacgaaagaacgccaaggctatcgcaacggaacagtcacccgcacccttacaacccgtgtggggcggctggtgttgcgggttccgagggtccggaatggccagttctccacagagctgtttgctcggtaccagcgcagcgaacaagcgttcatcatcgccctaatggagatggttgtgaatggcgtgtccacccgggacgtggcgaaaatcaccgagcagttgtgcggcacgacgttctcgaagtccacggtctccgagctgtgcaagcgccttgatcccatcggtcagggatggaatcatcgcagccttgctgagcaccgttatccgttcctgctggtggacgctttggtactccggattcgggaggaagggcgtgatcgctctcgagcggccatgatcgcagttggcatcaacgaagaagggtatcgtgggattctcggcttgatgctgggcgacagcgaatcggaggccagttggcgggagttctttgcctggctgaagaaccggggtctccgcggcgttgacgttgtggtgtctgacagtcatggcgggctgattaaggcactgcacacggagtttcagggatgcacctggcaacggtgccagacacactttatgcgcaacctcttagacgccacaccgaaggcattgcaggaggaggtctaccaacaggtccgcgcggtcctggatgcgcctgacctgaagactgcacggttgctcaaagatgcgtttgtcgaggcttacgcagagaaggcaccgaaggcggtgcaggtgttggaggatgggtttgatgatgtaaccgctgttttggtcttacctgagcgatatcggcggcgcttacgcaccaccaacggtgtcgaacggctcaacgaagaaattcggcgccgcgagcgcgtcattcgcatcttccccaaccgggaatcggcgatccgtctgctgggggcgttactcatggaaatcgacgaagaatggacgacggggcggaaatatctcaacatggacgagtatgaggcatggaagaaggcacaggaggcttcgagagggtcaacgcaggcttgtgcagcaacggcctaa

SEQ ID NO: 1835 - DNA, 1275 bp, Artificial
  Alicyclobacillus acidocaldarius mutated SEQ ID NO 1821
ttggtagaatgtgagacggagaagaaaccattacaccaggagggataccggatggctcagtaccagattaccgtggacgacgagattttggaaggcctctttcagcgggatggaggcgtggcaaagctggtggagagtgtggtcaaccagatcctccaagcgcaagtgaatgagcagctgaaagcggcgccatacgagcgcacgaaagaacgccaaggctatcgcaacggaacagtcacccgcacccttacaacccgtgtggggcggctggtgttgcgggttccgagggtccggaatggccagttctccacagagctgtttgctcggtaccagcgcagcgaacaagcgttcatcatcgccctaatggagatggttgtgaatggcgtgtccacccgggacgtggcgaaaatcaccgagcagttgtgcggcacgacgttctcgaagtccacggtctccgagctgtgcaagcgccttgatcccatcggtcagggatggaatcatcgcagccttgctgagcaccgttatccgttcctgctggtggacgctttggtactccggattcgggaggaagggcgtgatcgctctcgagcggccatgatcgcagttggcatcaacgaagaagggtatcgtgggattctcggcttgatgctgggcgacagcgaatcggaggccagttggcgggagttctttgcctggctgaagaaccggggtctccgcggcgttgacgttgtggtgtctgacagtcatggcgggctggtgaaggcactgcacacggagtttcagggatgcacctggcaacggtgccagacacactttatgcgcaacctcttagacgccacaccgaaggcattgcaggaggaggtctaccaacaggtccgcgcggtcctggatgcgcctgacctgaagactgcacggttgctcaaagatgcgtttgtcgaggcttacgcagagaaggcaccgaaggcggtgcaggtgttggaggatgggtttgatgatgtaaccgctgttttggtcttacctgagcgatatcggcggcgcttacgcaccaccaacggtgtcgaacggctcaacgaagaaattcggcgccgcgagcgcgtcattcgcatcttccccaaccgggaatcggcgatccgtctgctgggggcgttactcatggaaatcgacgaagaatggacgacggggcggaaatatctcaacatggacgagtatgaggcatggaagaaggcacaggaggcttcgagagggtcaacgcaggcttgtgcagcaacggcctaa

SEQ ID NO: 1836 - DNA, 1275 bp, Artificial
  Alicyclobacillus acidocaldarius mutated SEQ ID NO 1821
ttggtagaatgtgagacggagaagaaaccattacaccaggagggataccggatggctcagtaccagattaccgtggacgacgagattttggaaggcctctttcagcgggatggaggcgtggcaaagctggtggagagtgtggtcaaccagatcctccaagcgcaagtgcaggagcagctgaaagcggcgccatacgagcgcacgaaagaacgccaaggctatcgcaacggaacagtcacccgcacccttacaacccgtgtggggcggctggtgttgcggattccgagggtccggaatggccagttctccacagagctgtttgctcggtaccagcgcagcgaacaagcgttcatcatcgccctaatggagatggttgtgaatggcgtgtccacccgggacgtggcgaaaatcaccgagcagttgtgcggcacgacgttctcgaagtccacggtctccgagctgtgcaagcgccttgatcccatcggtcagggatggaatcatcgcagccttgctgagcaccgttatccgttcctgctggtggacgctttggtactccggattcgggaggaagggcgtgatcgctctcgagcggccatgatcgcagttggcatcaacgaagaagggtatcgtgggattctcggcttgatgctgggcgacagcgaatcggaggccagttggcgggagttctttgcctggctgaagaaccggggtctccgcggcgttgacgttgtggtgtctgacagtcatggcgggctggtgaaggcactgcacacggagtttcagggatgcacctggcaacggtgccagacacactttatgcgcaacctcttagacgccacaccgaaggcattgcaggaggaggtctaccaacaggtccgcgcggtcctggatgcgcctgacctgaagactgcacggttgctcaaagatgcgtttgtcgaggcttacgcagagaaggcaccgaaggcggtgcaggtgttggaggatgggtttgatgatgtaaccgctgttttggtcttacctgagcgatatcggcggcgcttacgcaccaccaacggtgtcgaacggctcaacgaagaaattcggcgccgcgagcgcgtcattcgcatcttccccaaccgggaatcggcgatccgtctgctgggggcgttactcatggaaatcgacgaagaatggacgacggggcggaaatatctcaacatggacgagtatgaggcatggaagaaggcacaggaggcttcgagagggtcaacgcaggcttgtgcagcaacggcctaa

SEQ ID NO: 1837 - protein, 378 aa, Alicyclobacillus acidocaldarius
MFGSRRRRGSRAYALEEIEGWCVMGDKKAALEQALRKIEKEFGKGSIMRLGEAAAMTVETVPTGSIALDIALGVGGLPRGRIVEIYGPESSGKTTVALHVVAEVQKLGGQAAFIDAEHALDPVYAQKLGVNIDELLISQPDTGEQALEIAEALVRSGAVDVIVVDSVAALVPKNELEGDMGDSHVGLQARLMSQALRKLAGAISKSKTIAIFINQIREKVGVMFGNPETTTGGRALKFYASVRLEVRRVEAIKQGNDVVGSRTRIKVVKNKVAPPFRQCDVDIMFGEGISREGSLIDIATEIDVVQKSGAWYSFGEERLGQGRENAKQYLKEHPEIAEQIEAAVREYFHVNPAKPLVAAAAEDADDDADDAFDEFDAF

SEQ ID NO: 1838 - DNA, 1137 bp, Alicyclobacillus acidocaldarius
gtgttcgggagcaggcggagaagaggctcacgggcatacgcgcttgaagaaattgagggatggtgtgtcatgggagacaaaaaggcggctttggaacaagccctgcgaaaaattgagaaggaatttggcaagggttccatcatgagactcggcgaagcggccgcgatgacggtcgagaccgtgccgacggggtcgattgcgcttgacattgcgctcggcgtcggaggactgcctcgtgggagaatcgtggaaatctacggaccggagtcgtcgggcaagacgaccgtggcgcttcacgttgtcgcggaggtgcagaagctgggcggtcaggcggcgttcatcgacgccgaacacgcgttggatccggtctatgcccaaaagctcggcgtcaacatcgacgaactcctgatttctcagccggacacgggggaacaggcgctcgagatcgccgaggcgctggttcggagtggcgcggtggacgtgatcgtcgtggactccgtggcagccttggttccgaagaacgaactcgagggcgacatgggcgattcgcacgtcggattgcaggcgcgcctgatgtcgcaggcgctgcgcaagttggcgggcgccatcagcaagtcgaagaccatcgccatcttcatcaaccaaatccgcgaaaaggtcggcgtcatgttcggaaatcccgagaccacgacaggcgggcgcgcgctgaaattctacgcctccgtgcggctggaggtccggcgcgtcgaggccatcaaacaggggaatgacgtggtgggatcgcggacgcggatcaaggtcgtgaagaacaaggtggcgccgccgttccgccagtgcgacgtggatatcatgtttggggaagggatctcgcgagagggcagcttgatcgatatcgccaccgagatcgacgtcgtccagaaaagcggagcctggtattcctttggtgaggagcggctcggacaagggcgtgaaaacgccaagcagtacctgaaggagcatccggagatcgcggagcaaatcgaggcggcggttcgcgagtacttccacgtgaatccggccaagccgctggttgcagccgctgcggaggatgcggatgatgacgcggatgacgcattcgacgaattcgacgccttctga

SEQ ID NO: 1839 - protein, 323 aa, Paenibacillus  JDR-2
MSDRRAALEMALRQIEKQFGKGSIMKLGESTHMQVETVPSGSIALDIALGIGGLPRGRIIECYGPESSGKTTVALHAIAEVQRIGGQAAFIDAEHALDPLYASKLGVNIDELLLSQPDTGEQALEIAEALVRSGAVDIIVIDSVAALVPKAEIEGDMGDSHVGLQARLMSQALRKLGGAISKSKTIAIFINQLREKVGVMFGNPETTPGGRALKFYSSVRLEVRRIETIKQGNDMVGNRTRIKVVKNKVAPPFKQAEIDIMYGEGISREGSLVDIGVEMDIVQKSGAWFSYNGDRLGQGRENAKQFLKDHPEVAAVIEKQIRE

SEQ ID NO: 1840 - protein, 328 aa, Bacillus halodurans
MSDRKAALDMALRQIEKQFGKGSIMKLGEQAEQRVSTISSGALALDIALGVGGYPRGRVIEVYGPESSGKTTVALHAIAEVQRNGGQAAFIDAEHALDPVYAKKLGVNIDELLLSQPDTGEQALEIAEALVRSGAIDVIVIDSVAALVPKAEIEGEMGDSHVGLQARLMSQALRKLSGAINKSKTIAIFINQIREKVGVMFGNPETTPGGRALKFYSSVRLEVRRAETLKQGNDMVGNKTKIKVVKNKVAPPFKQAEVDIMYGEGISREGSILDIASELDIVQKSGAWYSFNDERLGQGRENAKQFLKENPEAAEEIESRIREHYGLN

SEQ ID NO: 1841 - protein, 324 aa, Bacillus megaterium
MNDRQAALDMALKQIEKQFGKGSIMKLGEQTEKRISTIPSGSLALDIALGVGGYPRGRVVEVYGPESSGKTTVALHAIAEVQQQGGQAAFIDAEHALDPVYAQKLGVNIDELLLSQPDTGEQALEIAEALVRSGAVDIIVVDSVAALVPKAEIEGEMGDSHVGLQARLMSQALRKLSGAINKSKTIAIFINQIREKVGVMFGNPETTPGGRALKFYSSVRLEVRRAEQLKQGNDIVGNKTRIKVVKNKVAPPFRAAEVDIMYGEGISKEGEILDIASELDIVQKSGSWYSYNDERLGQGRENAKQFLKENTDIRQEIAGQVREH

SEQ ID NO: 1842 - protein, 325 aa, Bacillus licheniformis
MSDRQAALDMALKQIEKQFGKGSIMKLGEQTETRISTVPSGSLALDAALGVGGYPRGRIIEVYGPESSGKTTVALHAIAEVQQQGGQAAFIDAEHALDPVYAQKLGVNIDELLLSQPDTGEQALEIAEALVRSGAVDIVVIDSVAALVPKAEIEGDMGDSHVGLQARLMSQALRKLSGAINKSKTIAIFINQIREKVGVMFGNPETTPGGRALKFYSSVRLEVRRAEQLKQGNDVMGNKTKIKVVKNKVAPPFRTAEVDIMYGEGISKEGEIIDLGTELDIVQKSGAWYSYQEERLGQGRENAKQFLKENKDILLMIQEQIREHY

SEQ ID NO: 1843 - protein, 325 aa, Bacillus amyloliquefaciens
MSDRQAALDMALKQIEKQFGKGSIMKLGEKTDTRISTVPSGSLALDTALGIGGYPRGRIIEVYGPESSGKTTVALHAIAEVQEKGGQAAFIDAEHALDPVYAQKLGVNIEELLLSQPDTGEQALEIAEALVRSGAVDIVVVDSVAALVPKAEIEGDMGDSHVGLQARLMSQALRKLSGAINKSKTIAIFINQIREKVGVMFGNPETTPGGRALKFYSSVRLEVRRAEQLKQGNDVMGNKTRIKVVKNKVAPPFRTAEVDIMYGEGISKEGEIIDLGTELDIVQKSGSWYSYEEERLGQGRENAKQFLKENKDIMLMIQEQIREYY

SEQ ID NO: 1844 - protein, 378 aa, Artificial
  Alicyclobacillus acidocaldarius mutated SEQ ID NO 1837
MFGSRRRRGSRAYALEDIEGWCVMGDKKAALEQALRKIEKEFGKGSIMRLGEAAAMTVETVPTGSIALDIALGVGGLPRGRIVEIYGPESSGKTTVALHVVAEVQKLGGQAAFIDAEHALDPVYAQKLGVNIDELLISQPDTGEQALEIAEALVRSGAVDVIVVDSVAALVPKNELEGDMGDSHVGLQARLMSQALRKLAGAISKSKTIAIFINQIREKVGVMFGNPETTTGGRALKFYASVRLEVRRVEAIKQGNDVVGSRTRIKVVKNKVAPPFRQCDVDIMFGEGISREGSLIDIATEIDVVQKSGAWYSFGEERLGQGRENAKQYLKEHPEIAEQIEAAVREYFHVNPAKPLVAAAAEDADDDADDAFDEFDAF

SEQ ID NO: 1845 - protein, 378 aa, Artificial
  Alicyclobacillus acidocaldarius mutated SEQ ID NO 1837
MFGSRRRRGSRAYALEEIEGWCVMGDKKAALEQALRKIEKEFGKGSIMRLGEAAAMTVETVPTGSIALDIALGVGGLPRGRIVEIYGPESSGKTTVALHVVAEVQKLGGQAAFIDAEHALDPVYAQKLGVNIDELLISQPDTGEQALEIAEALVRSGAVDVIVVDSVAALVPKNELEGDMGDSHVGLQARLMSQALRKLAGAISKSKTIAIFINQIREKVGVMFGNPETTTGGRALKFYASVRLEVRRVEAIKQGNDVVGSRTRIKVVKNKVAPPFRQCDVDIMFGEGISREGSLIDIATEIDVVQKSGAWYSFGEERLGQGRENAKQYLKEHPEIAEQIEAAVREYFHINPAKPLVAAAAEDADDDADDAFDEFDAF

SEQ ID NO: 1846 - protein, 378 aa, Artificial
  Alicyclobacillus acidocaldarius mutated SEQ ID NO 1837
MFGSRRRRGSKAYALEEIEGWCVMGDKKAALEQALRKIEKEFGKGSIMRLGEAAAMTVETVPTGSIALDIALGVGGLPRGRIVEIYGPESSGKTTVALHVVAEVQKLGGQAAFIDAEHALDPVYAQKLGVNIDELLISQPDTGEQALEIAEALVRSGAVDVIVVDSVAALVPKNELEGDMGDSHVGLQARLMSQALRKLAGAISKSKTIAIFINQIREKVGVMFGNPETTTGGRALKFYASVRLEVRRVEAIKQGNDVVGSRTRIKVVKNKVAPPFRQCDVDIMFGEGISREGSLIDIATEIDVVQKSGAWYSFGEERLGQGRENAKQYLKEHPEIAEQIEAAVREYFHVNPAKPLVAAAAEDADDDADDAFDEFDAF

SEQ ID NO: 1847 - protein, 378 aa, Artificial
  Alicyclobacillus acidocaldarius mutated SEQ ID NO 1837
MFGSRRRRGSRAYALEEIEGWCVMGDKKAALEQALRKIEKEFGKGSIMRLGEAAAMTVETVPTGSIALDIALGVGGLPRGRIVEIYGPESSGKTTVALHVVAEVQKLGGQAAFIDAEHALDPVYAQKLGVNIDELLISQPDTGEQALEIAEALVRSGAVDVIVVDSVAALVPKNELEGDMGDSHVGLQARLMSQALRKLAGAISKSKTIAIFINQIREKVGVMFGNPETTTGGRALKFYASVRLEVRRVEAIKQGNDVVGSRTRIKVVKNKVAPPFRQCDVDIMFGEGISREGSLIDIATEIDVVQKSGAWYSFGEERLGQGRENAKQYLKEHPEIAENIEAAVREYFHVNPAKPLVAAAAEDADDDADDAFDEFDAF

SEQ ID NO: 1848 - protein, 378 aa, Artificial
  Alicyclobacillus acidocaldarius mutated SEQ ID NO 1837
MFGSRRRRGSRAYALEEIDGWCVMGDKKAALEQALRKIEKEFGKGSIMRLGEAAAMTVETVPTGSIALDIALGVGGLPRGRIVEIYGPESSGKTTVALHVVAEVQKLGGQAAFIDAEHALDPVYAQKLGVNIDELLISQPDTGEQALEIAEALVRSGAVDVIVVDSVAALVPKNELEGDMGDSHVGLQARLMSQALRKLAGAISKSKTIAIFINQIREKVGVMFGNPETTTGGRALKFYASVRLEVRRVEAIKQGNDVVGSRTRIKVVKNKVAPPFRQCDVDIMFGEGISREGSLIDIATEIDVVQKSGAWYSFGEERLGQGRENAKQYLKEHPEIAEQIEAAVREYFHVNPAKPLVAAAAEDADDDADDAFDEFDAF

SEQ ID NO: 1849 - DNA, 1137 bp, Artificial
  Alicyclobacillus acidocaldarius mutated SEQ ID NO 1838
gtgttcgggagcaggcggagaagaggctcacgggcatacgcgcttgaagatattgagggatggtgtgtcatgggagacaaaaaggcggctttggaacaagccctgcgaaaaattgagaaggaatttggcaagggttccatcatgagactcggcgaagcggccgcgatgacggtcgagaccgtgccgacggggtcgattgcgcttgacattgcgctcggcgtcggaggactgcctcgtgggagaatcgtggaaatctacggaccggagtcgtcgggcaagacgaccgtggcgcttcacgttgtcgcggaggtgcagaagctgggcggtcaggcggcgttcatcgacgccgaacacgcgttggatccggtctatgcccaaaagctcggcgtcaacatcgacgaactcctgatttctcagccggacacgggggaacaggcgctcgagatcgccgaggcgctggttcggagtggcgcggtggacgtgatcgtcgtggactccgtggcagccttggttccgaagaacgaactcgagggcgacatgggcgattcgcacgtcggattgcaggcgcgcctgatgtcgcaggcgctgcgcaagttggcgggcgccatcagcaagtcgaagaccatcgccatcttcatcaaccaaatccgcgaaaaggtcggcgtcatgttcggaaatcccgagaccacgacaggcgggcgcgcgctgaaattctacgcctccgtgcggctggaggtccggcgcgtcgaggccatcaaacaggggaatgacgtggtgggatcgcggacgcggatcaaggtcgtgaagaacaaggtggcgccgccgttccgccagtgcgacgtggatatcatgtttggggaagggatctcgcgagagggcagcttgatcgatatcgccaccgagatcgacgtcgtccagaaaagcggagcctggtattcctttggtgaggagcggctcggacaagggcgtgaaaacgccaagcagtacctgaaggagcatccggagatcgcggagcaaatcgaggcggcggttcgcgagtacttccacgtgaatccggccaagccgctggttgcagccgctgcggaggatgcggatgatgacgcggatgacgcattcgacgaattcgacgccttctga

SEQ ID NO: 1850 - DNA, 1137 bp, Artificial
  Alicyclobacillus acidocaldarius mutated SEQ ID NO 1838
gtgttcgggagcaggcggagaagaggctcacgggcatacgcgcttgaagaaattgagggatggtgtgtcatgggagacaaaaaggcggctttggaacaagccctgcgaaaaattgagaaggaatttggcaagggttccatcatgagactcggcgaagcggccgcgatgacggtcgagaccgtgccgacggggtcgattgcgcttgacattgcgctcggcgtcggaggactgcctcgtgggagaatcgtggaaatctacggaccggagtcgtcgggcaagacgaccgtggcgcttcacgttgtcgcggaggtgcagaagctgggcggtcaggcggcgttcatcgacgccgaacacgcgttggatccggtctatgcccaaaagctcggcgtcaacatcgacgaactcctgatttctcagccggacacgggggaacaggcgctcgagatcgccgaggcgctggttcggagtggcgcggtggacgtgatcgtcgtggactccgtggcagccttggttccgaagaacgaactcgagggcgacatgggcgattcgcacgtcggattgcaggcgcgcctgatgtcgcaggcgctgcgcaagttggcgggcgccatcagcaagtcgaagaccatcgccatcttcatcaaccaaatccgcgaaaaggtcggcgtcatgttcggaaatcccgagaccacgacaggcgggcgcgcgctgaaattctacgcctccgtgcggctggaggtccggcgcgtcgaggccatcaaacaggggaatgacgtggtgggatcgcggacgcggatcaaggtcgtgaagaacaaggtggcgccgccgttccgccagtgcgacgtggatatcatgtttggggaagggatctcgcgagagggcagcttgatcgatatcgccaccgagatcgacgtcgtccagaaaagcggagcctggtattcctttggtgaggagcggctcggacaagggcgtgaaaacgccaagcagtacctgaaggagcatccggagatcgcggagcaaatcgaggcggcggttcgcgagtacttccacattaatccggccaagccgctggttgcagccgctgcggaggatgcggatgatgacgcggatgacgcattcgacgaattcgacgccttctga

SEQ ID NO: 1851 - DNA, 1137 bp, Artificial
  Alicyclobacillus acidocaldarius mutated SEQ ID NO 1838
gtgttcgggagcaggcggagaagaggctcaaaagcatacgcgcttgaagaaattgagggatggtgtgtcatgggagacaaaaaggcggctttggaacaagccctgcgaaaaattgagaaggaatttggcaagggttccatcatgagactcggcgaagcggccgcgatgacggtcgagaccgtgccgacggggtcgattgcgcttgacattgcgctcggcgtcggaggactgcctcgtgggagaatcgtggaaatctacggaccggagtcgtcgggcaagacgaccgtggcgcttcacgttgtcgcggaggtgcagaagctgggcggtcaggcggcgttcatcgacgccgaacacgcgttggatccggtctatgcccaaaagctcggcgtcaacatcgacgaactcctgatttctcagccggacacgggggaacaggcgctcgagatcgccgaggcgctggttcggagtggcgcggtggacgtgatcgtcgtggactccgtggcagccttggttccgaagaacgaactcgagggcgacatgggcgattcgcacgtcggattgcaggcgcgcctgatgtcgcaggcgctgcgcaagttggcgggcgccatcagcaagtcgaagaccatcgccatcttcatcaaccaaatccgcgaaaaggtcggcgtcatgttcggaaatcccgagaccacgacaggcgggcgcgcgctgaaattctacgcctccgtgcggctggaggtccggcgcgtcgaggccatcaaacaggggaatgacgtggtgggatcgcggacgcggatcaaggtcgtgaagaacaaggtggcgccgccgttccgccagtgcgacgtggatatcatgtttggggaagggatctcgcgagagggcagcttgatcgatatcgccaccgagatcgacgtcgtccagaaaagcggagcctggtattcctttggtgaggagcggctcggacaagggcgtgaaaacgccaagcagtacctgaaggagcatccggagatcgcggagcaaatcgaggcggcggttcgcgagtacttccacgtgaatccggccaagccgctggttgcagccgctgcggaggatgcggatgatgacgcggatgacgcattcgacgaattcgacgccttctga

SEQ ID NO: 1852 - DNA, 1137 bp, Artificial
  Alicyclobacillus acidocaldarius mutated SEQ ID NO 1838
gtgttcgggagcaggcggagaagaggctcacgggcatacgcgcttgaagaaattgagggatggtgtgtcatgggagacaaaaaggcggctttggaacaagccctgcgaaaaattgagaaggaatttggcaagggttccatcatgagactcggcgaagcggccgcgatgacggtcgagaccgtgccgacggggtcgattgcgcttgacattgcgctcggcgtcggaggactgcctcgtgggagaatcgtggaaatctacggaccggagtcgtcgggcaagacgaccgtggcgcttcacgttgtcgcggaggtgcagaagctgggcggtcaggcggcgttcatcgacgccgaacacgcgttggatccggtctatgcccaaaagctcggcgtcaacatcgacgaactcctgatttctcagccggacacgggggaacaggcgctcgagatcgccgaggcgctggttcggagtggcgcggtggacgtgatcgtcgtggactccgtggcagccttggttccgaagaacgaactcgagggcgacatgggcgattcgcacgtcggattgcaggcgcgcctgatgtcgcaggcgctgcgcaagttggcgggcgccatcagcaagtcgaagaccatcgccatcttcatcaaccaaatccgcgaaaaggtcggcgtcatgttcggaaatcccgagaccacgacaggcgggcgcgcgctgaaattctacgcctccgtgcggctggaggtccggcgcgtcgaggccatcaaacaggggaatgacgtggtgggatcgcggacgcggatcaaggtcgtgaagaacaaggtggcgccgccgttccgccagtgcgacgtggatatcatgtttggggaagggatctcgcgagagggcagcttgatcgatatcgccaccgagatcgacgtcgtccagaaaagcggagcctggtattcctttggtgaggagcggctcggacaagggcgtgaaaacgccaagcagtacctgaaggagcatccggagatcgcggagaatatcgaggcggcggttcgcgagtacttccacgtgaatccggccaagccgctggttgcagccgctgcggaggatgcggatgatgacgcggatgacgcattcgacgaattcgacgccttctga

SEQ ID NO: 1853 - DNA, 1137 bp, Artificial
  Alicyclobacillus acidocaldarius mutated SEQ ID NO 1838
gtgttcgggagcaggcggagaagaggctcacgggcatacgcgcttgaagaaattgatggatggtgtgtcatgggagacaaaaaggcggctttggaacaagccctgcgaaaaattgagaaggaatttggcaagggttccatcatgagactcggcgaagcggccgcgatgacggtcgagaccgtgccgacggggtcgattgcgcttgacattgcgctcggcgtcggaggactgcctcgtgggagaatcgtggaaatctacggaccggagtcgtcgggcaagacgaccgtggcgcttcacgttgtcgcggaggtgcagaagctgggcggtcaggcggcgttcatcgacgccgaacacgcgttggatccggtctatgcccaaaagctcggcgtcaacatcgacgaactcctgatttctcagccggacacgggggaacaggcgctcgagatcgccgaggcgctggttcggagtggcgcggtggacgtgatcgtcgtggactccgtggcagccttggttccgaagaacgaactcgagggcgacatgggcgattcgcacgtcggattgcaggcgcgcctgatgtcgcaggcgctgcgcaagttggcgggcgccatcagcaagtcgaagaccatcgccatcttcatcaaccaaatccgcgaaaaggtcggcgtcatgttcggaaatcccgagaccacgacaggcgggcgcgcgctgaaattctacgcctccgtgcggctggaggtccggcgcgtcgaggccatcaaacaggggaatgacgtggtgggatcgcggacgcggatcaaggtcgtgaagaacaaggtggcgccgccgttccgccagtgcgacgtggatatcatgtttggggaagggatctcgcgagagggcagcttgatcgatatcgccaccgagatcgacgtcgtccagaaaagcggagcctggtattcctttggtgaggagcggctcggacaagggcgtgaaaacgccaagcagtacctgaaggagcatccggagatcgcggagcaaatcgaggcggcggttcgcgagtacttccacgtgaatccggccaagccgctggttgcagccgctgcggaggatgcggatgatgacgcggatgacgcattcgacgaattcgacgccttctga

SEQ ID NO: 1854 - protein, 129 aa, Alicyclobacillus acidocaldarius
MNELSKYREIWIKERWHLQQSGKWQGGEKQFLFHNGFGEKYYPSTPSLHWRRFLDKHGLPRIRLHDLRHTTATILREDGADLKSIQERLRHTRLSITADLYTHETEAVSRETADRLEKLNPFRSRSQSI

SEQ ID NO: 1855 - DNA, 390 bp, Alicyclobacillus acidocaldarius
atgaacgaattgtcaaagtatagagaaatctggatcaaggaacgatggcacctgcaacagagtggcaagtggcaaggaggagagaagcaattcctctttcacaatggattcggagagaaatattatccgagtactccctccctccattggcgtcggttcttggataagcacggactgccgcgcattcgccttcatgacttgcgccacactacagcgactattttgcgcgaagacggtgcagaccttaagtccatccaagaacggcttcgccatacgcgactatccatcactgctgacctttacacgcatgagacggaagcagtcagtcgcgagacggcggatcgccttgaaaaactgaatccatttcgaagccgatctcagtcgatttga

SEQ ID NO: 1856 - protein, 127 aa, Paenibacillus larvae
MVELKEYEREWKKEKLSVGDKWIGGDRRYVFHAGLGKPYFYSYPSEWWSKFIKRHDLKRVRFHDLRHSSATLLIEAGASMKAIQQRLGHSKHQTTADVYAHVTKKVSRETAEKFDKFAPDSIRPQSV

SEQ ID NO: 1857 - protein, 119 aa, Paenibacillus larvae
MDELKIHKHEWKKEKLFVGDKWRGGDKQYVFHAGFGKPLYHTYPTQWWGEFIKRHNLKRVRFHDLRHSSATLLIEAGASMKAIQERLGHSKHQTTADIYAHITKKVSRETAEKFDKFAP

SEQ ID NO: 1858 - protein, 127 aa, Paenibacillus larvae
MQELKVHEREWKKEKLFMGDKWLGGDRQYVFHAGYGKPFFHTTPTKWWRSFISRNKLKYIRLHDLRHSSATLLIEAGAPMKAIQKRLGHSKHQTTADIYAHVTKKVSRDTAEKFDKFAPNNIRPQSV

SEQ ID NO: 1859 - protein, 127 aa, Paenibacillus larvae
MDELKVHEYEWKKEKLSVGDKWRGGDRQYVFHAGFGKPFHHTYPTEWWNGFTKRHNLKRVRFHDLRHSSATLLIEAGASMKAVQQRLGHSKHQTTADIYAHVTKKVSRDTAEKFNKFAPNNIRPQSV

SEQ ID NO: 1860 - protein, 118 aa, Paenibacillus larvae
DELSKFEIIWNEEKETAGQKWEERKHSFIFHNGLGKPFYRTVPSQRWLQFIRANNLPHIRLHDLRHTVATLLLEEGVRLKVIQERHGHANYQTTADIYSHVTKRLTEDAVDKFEKFGP

SEQ ID NO: 1861 - protein, 129 aa, Artificial
  Alicyclobacillus acidocaldarius mutated SEQ ID NO 1854
MNELSKYREIWIKERWHLQQSGKWQGGEKQFLFHNGFGEKYYPSTPSLHWRRFLDKHGLPRIRLHDLRHTTATILREDGADLKSIQERIRHTRLSITADLYTHETEAVSRETADRLEKLNPFRSRSQSI

SEQ ID NO: 1862 - protein, 129 aa, Artificial
  Alicyclobacillus acidocaldarius mutated SEQ ID NO 1854
MNELSKYREIWIKERWHLQQSGKWQGGEKQFLFHNGFGEKYYPSTPSLHWRRFLDKHGLPRIRLHDLRHTTATILREDGADLKSIQERLRHTRLSITADLYTHETEAVSRETADRLEKLNPFRSRSQSL

SEQ ID NO: 1863 - protein, 129 aa, Artificial
  Alicyclobacillus acidocaldarius mutated SEQ ID NO 1854
MNELSKYRDIWIKERWHLQQSGKWQGGEKQFLFHNGFGEKYYPSTPSLHWRRFLDKHGLPRIRLHDLRHTTATILREDGADLKSIQERLRHTRLSITADLYTHETEAVSRETADRLEKLNPFRSRSQSI

SEQ ID NO: 1864 - protein, 129 aa, Artificial
  Alicyclobacillus acidocaldarius mutated SEQ ID NO 1854
MNELSKYREIWIKERWHLQQSGKWQGGEKQFLFHNGFGEKYYPSTPSLHWRRFLDKHGLPRIRLHDLRHTTATILREDGADLKSIQERLKHTRLSITADLYTHETEAVSRETADRLEKLNPFRSRSQSI

SEQ ID NO: 1865 - protein, 129 aa, Artificial
  Alicyclobacillus acidocaldarius mutated SEQ ID NO 1854
MQELSKYREIWIKERWHLQQSGKWQGGEKQFLFHNGFGEKYYPSTPSLHWRRFLDKHGLPRIRLHDLRHTTATILREDGADLKSIQERLRHTRLSITADLYTHETEAVSRETADRLEKLNPFRSRSQSI

SEQ ID NO: 1866 - DNA, 390 bp, Artificial
  Alicyclobacillus acidocaldarius mutated SEQ ID NO 1855
atgaacgaattgtcaaagtatagagaaatctggatcaaggaacgatggcacctgcaacagagtggcaagtggcaaggaggagagaagcaattcctctttcacaatggattcggagagaaatattatccgagtactccctccctccattggcgtcggttcttggataagcacggactgccgcgcattcgccttcatgacttgcgccacactacagcgactattttgcgcgaagacggtgcagaccttaagtccatccaagaacggattcgccatacgcgactatccatcactgctgacctttacacgcatgagacggaagcagtcagtcgcgagacggcggatcgccttgaaaaactgaatccatttcgaagccgatctcagtcgatttga

SEQ ID NO: 1867 - DNA, 390 bp, Artificial
  Alicyclobacillus acidocaldarius mutated SEQ ID NO 1855
atgaacgaattgtcaaagtatagagaaatctggatcaaggaacgatggcacctgcaacagagtggcaagtggcaaggaggagagaagcaattcctctttcacaatggattcggagagaaatattatccgagtactccctccctccattggcgtcggttcttggataagcacggactgccgcgcattcgccttcatgacttgcgccacactacagcgactattttgcgcgaagacggtgcagaccttaagtccatccaagaacggcttcgccatacgcgactatccatcactgctgacctttacacgcatgagacggaagcagtcagtcgcgagacggcggatcgccttgaaaaactgaatccatttcgaagccgatctcagtcgttatga

SEQ ID NO: 1868 - DNA, 390 bp, Artificial
  Alicyclobacillus acidocaldarius mutated SEQ ID NO 1855
atgaacgaattgtcaaagtatagagatatctggatcaaggaacgatggcacctgcaacagagtggcaagtggcaaggaggagagaagcaattcctctttcacaatggattcggagagaaatattatccgagtactccctccctccattggcgtcggttcttggataagcacggactgccgcgcattcgccttcatgacttgcgccacactacagcgactattttgcgcgaagacggtgcagaccttaagtccatccaagaacggcttcgccatacgcgactatccatcactgctgacctttacacgcatgagacggaagcagtcagtcgcgagacggcggatcgccttgaaaaactgaatccatttcgaagccgatctcagtcgatttga

SEQ ID NO: 1869 - DNA, 390 bp, Artificial
  Alicyclobacillus acidocaldarius mutated SEQ ID NO 1855
atgaacgaattgtcaaagtatagagaaatctggatcaaggaacgatggcacctgcaacagagtggcaagtggcaaggaggagagaagcaattcctctttcacaatggattcggagagaaatattatccgagtactccctccctccattggcgtcggttcttggataagcacggactgccgcgcattcgccttcatgacttgcgccacactacagcgactattttgcgcgaagacggtgcagaccttaagtccatccaagaacggcttaaacatacgcgactatccatcactgctgacctttacacgcatgagacggaagcagtcagtcgcgagacggcggatcgccttgaaaaactgaatccatttcgaagccgatctcagtcgatttga

SEQ ID NO: 1870 - DNA, 390 bp, Artificial
  Alicyclobacillus acidocaldarius mutated SEQ ID NO 1855
atgcaagaattgtcaaagtatagagaaatctggatcaaggaacgatggcacctgcaacagagtggcaagtggcaaggaggagagaagcaattcctctttcacaatggattcggagagaaatattatccgagtactccctccctccattggcgtcggttcttggataagcacggactgccgcgcattcgccttcatgacttgcgccacactacagcgactattttgcgcgaagacggtgcagaccttaagtccatccaagaacggcttcgccatacgcgactatccatcactgctgacctttacacgcatgagacggaagcagtcagtcgcgagacggcggatcgccttgaaaaactgaatccatttcgaagccgatctcagtcgatttga

SEQ ID NO: 1871 - protein, 742 aa, Alicyclobacillus acidocaldarius
MGARRDRRQVGRGRIAGTRRALRRPHRREAAVCQVRADSQGGSLSGFKHPMQCVIRSVMRVVDAKSALSLEEARARAKVLREQIEYHNRKYYLEDNPEISDAEWDALMRDLIELERKYPELVDPASPTQRVGAPALEGFAKVVHEVPMLSLANAYSTEDLLDWDRRVRQAVGDDVRYVCELKVDGLAVALRYQDGRLVLGATRGDGSVGEDITANIRTIRNVPLELSEPVSLEVRGEAYMPKREFMRLNELREQQGEPLFANPRNAAAGSLRQLDPAVAASRRLGVIVYQLVRAEAHGCETHSQALDYVARLGLPAHRERHVCANIEDVIAYIEAWADKRHELPYATDGMVVKVDSLALQARLGATAKSPRWAIAYKYAAEQAETTLRAIELNVGRTGVVTPTAVFDPVQLAGTTVSRASLHNEDLVREKDIRVGDVIVVQKAGDIIPEVIRSLPERRTEPLPEFRMPETCPQCGSRLVRLDGEVAWRCINPDCPALLREGLIHFCSRDAMNIEGLGEQWITVLLDRGLVRTHADLYRLRKADLVQLDRMGDKLADKLLHNIQESKRNSLERLLFGLGIRHVGEKAAKTLAEHFVTIDALMSASEEDLMAVPDIGPKVAQSIRQYFDTPRVRQLIQELKDLGVNMTYLGPQKVSDGPLAGKTVVLTGVLQAADRKQATAWIEQMGGKVASSVSAKTDVLIAGDKAGSKLAKAQEILRNHPDAKLEIWDEAAFLRLVDEAGLR

SEQ ID NO: 1872 - DNA, 2229 bp, Alicyclobacillus acidocaldarius
gtgggggcgcggcgtgatcgtcgccaagtcgggcgagggcgaatcgctggaactcgtcgtgcgcttcgaagaccccatcggcgagaagcggctgtttgccaagttcgcgccgattcacaaggtggatccctaagcggattcaagcatcccatgcagtgcgtgatcaggagtgtgatgcgtgtcgtggacgccaaatcggccctgtccctggaagaagcgcgtgcgcgcgccaaagtgctccgggaacaaatcgaatatcacaatcgaaagtactacctggaggacaatccggagatctccgacgcggagtgggacgcgctgatgcgggatctcatcgagcttgagcgcaagtacccagagctcgtcgatccggcctcgcccacgcagcgtgtgggcgccccggcgctcgagggattcgccaaggtcgtgcacgaggtgcccatgctgtcgctcgcaaacgcgtattcgacggaggatctgctcgactgggatcgccgcgtgcgacaggcggtgggcgacgacgtccgctacgtgtgcgagctcaaggtcgacggcttggccgtggcgcttcgctaccaggacggccggctcgtgctcggtgcaacgcgcggcgacggatcggtcggggaggacatcacggccaacattcgcaccattcgcaacgtgccgcttgaactttcggaacccgtgtcgctcgaggtgcgaggcgaggcgtacatgccaaagcgcgagttcatgcggctcaacgagcttcgcgagcagcagggcgagccgcttttcgccaatccgcgcaacgcggccgccggatcgctgcgccagctcgatccggccgtggccgcgagccggaggctcggcgtgatcgtgtaccagttggtgcgcgccgaggcgcacgggtgtgagacgcacagccaggcgctggattacgtggcccgcctcggcctgcccgcgcatcgcgagcggcacgtgtgcgcgaacatcgaggacgtgatcgcgtacatcgaggcgtgggcggacaagcggcacgaactgccgtacgcgacggacggcatggtggtgaaggtcgactccctcgcgctgcaggcgcgcctcggcgccaccgcaaagagcccgcgctgggccattgcgtacaaatacgcggcggagcaggcggagaccacgcttcgcgccatcgagttgaacgtcggccgcacgggtgtagtcacaccgacggctgtgttcgatcccgtccagctcgcgggcaccacggtctcgagggcgtcgctgcacaacgaggacttggtgcgcgagaaggacatccgcgtgggcgacgtcattgttgtgcagaaggcgggggacatcattcccgaggtcattcgatcgctgcccgagcggcgcaccgagccgctgcccgaatttcgcatgccggagacgtgcccgcagtgcggatcgcggctcgtgcggctcgacggcgaggtggcgtggcgctgcatcaaccccgactgcccggctctcctgcgcgaggggctcatccacttctgttcgcgcgacgcgatgaacatcgagggcctcggcgagcagtggatcacggtgcttctggaccgcgggttggtacggacgcacgcggatttgtatcgcctccgaaaggccgatctcgtccaactggaccggatgggggataagctcgcggataaactgttgcacaacatccaggagagcaagcggaactcgctcgagcgcctcttgtttggactcggcatccggcacgtgggcgagaaggcggcgaagacgttggcggaacacttcgtcaccatcgacgcgctgatgtccgcgagcgaggaggacttgatggcggtccccgacatcggccccaaagtcgcgcagagcatccgccagtacttcgatacgccacgggtgaggcagctgattcaggagttgaaagacctgggcgtgaacatgacctacctcggcccgcagaaggtgtcggacggcccactcgccggaaagacggtggtattgaccggcgtgcttcaggcggcggatcgaaagcaggcgacggcgtggatcgagcagatgggtggcaaggtcgcctcgagtgtcagcgcgaagacggacgtgctcatcgcgggggacaaggcgggatcgaagctcgccaaggcgcaggagatcctgcggaatcacccggacgcaaagctcgagatctgggatgaggcggcgtttctgcgcctggtggacgaggcggggttgcgctga

SEQ ID NO: 1873 - protein, 663 aa, Geobacillus kaustophilus
QQAERRAAELRELLHRYGYEYYVLDRPSVPDAEYDRLMQELMAIEEQYPELKTSDSPTQRIGGPPLEAFRKVTHVVPMMSLANAFDEGDLRDFDRRVRQEVGEAAYVCELKIDGLAVSVRYEDGYFVQGATRGDGTTGEDITENLRTIRSLPLRLKEPVSLEARGEAFMPKASFLRLNEERKARGEELFANPRNAAAGSLRQLDPKVAASRQLDLFVYGLANAEELGIESHSEALDYLQALGFKVNPERRRCANIDEVIAFVNEWHEKRPQLPYEIDGIVIKVDSFAQQRELGATAKSPRWAIAYKFPAEEVVTTLIGIEVNVGRTGVVTPTAILEPVRVAGTTVQRATLHNEDFIREKDIRIGDAVIIKKAGDIIPEVVGVVVDRRDGDETPFAMPTHCPECESELVRLEGEVALRCLNPNCPAQLRERLIHFASRAAMNIEGLGEKVVTQLFNAGLVRDVADLYRLTKEQLIGLERMGEKSATNLLAAIEASKQNSLERLLFGLGIRYVGAKAAQLLAEHFETMERLERATKEELMAVPEIGEKMADAITAFFAQPEATELLQELRAYGVNMAYKGPKRSAEAPADSAFAGKTVVLTGKLASMSRNEAKEEIERLGGRVTGSVSRSTDLVIAGEDAGSKLEKAQQLGIEIWDESRFLQEIN

SEQ ID NO: 1874 - protein, 663 aa, Geobacillus stearothermophilus
QQAERRAAELRELLNRYGYEYYVLDRPSVPDAEYDRLMQELIAIEEQYPELKTSDSPTQRIGGPPLEAFRKVAHRVPMMSLANAFGEGDLRDFDRRVRQEVGEAAYVCELKIDGLAVSVRYEDGYFVQGATRGDGTTGEDITENLKTIRSLPLRLKEPVSLEARGEAFMPKASFLRLNEERKARGEELFANPRNAAAGSLRQLDPKVAASRQLDLFVYGLADAEALGIASHSEALDYLQALGFKVNPERRRCANIDEVIAFVSEWHDKRPQLPYEIDGIVIKVDSFAQQRALGATAKSPRWAIAYKFPAEEVVTTLIGIEVNVGRTGVVTPTAILEPVRVAGTTVQRATLHNEDFIREKDIRIGDAVIIKKAGDIIPEVVGVVVDRRDGDETPFAMPTHCPECESELVRLEGEVALRCLNPNCPAQLRERLIHFASRAAMNIEGLGEKVVTQLFNAGLVRDVADLYCLTKEQLVGLERMGEKSAANLLAAIEASKQNSLERLLFGLGIRYVGAKAAQLLAEHFETMERLERATKEELMAVPEIGEKMADAITAFFAQPEATELLQELRAYGVNMAYKGPKRSAEAPADSAFAGKTVVLTGKLASMSRNEAKEQIERLGGRVTGSVSRSTDLVIAGEDAGSKLEKAQQLGIEIWDESRFLQEIN

SEQ ID NO: 1875 - protein, 663 aa, Geobacillus  g
QQAERRAAELRELLHRYGYEYYVLGRPSVPDAEYDRLMQELMAIEEQYPELKTSDSPTQRIGGPPLEAFRKVTHVVPMMSLANAFDEGDLRDFDRRVRQEVGEAAYVCELKIDGLAVSVRYEDGYFVQGATRGDGTTGEDITENLRTIRSLPLRLKEPVSLEARGEAFMPKASFLRLNEERKARGEELFANPRNAAAGSLRQLDPKVAASRQLDLFVYGLANAEELGIESHSEALDYLQALGFKVNPERRRCANIDEVIAFVNEWHEKRPQLPYEIDGIVIKVDSFAQQRELGATAKSPRWAIAYKFPAEEVVTTLIGIEVNVGRTGVVTPTAILEPVRVAGTTVQRATLHNEDFIREKDIRIGDAVIIKKAGDIIPEVVGVVVDRRDGDETPFVMPTHCPECESELVRLDGEVALRCLNPKCPAQLRERLIHFASRAAMNIEGLGEKVVTQLFNAGLVHDVADLYRLTKEQLIGLERMGEKSATNLLAAIEASKQNSLERLLFGLGIRYVGAKAAQLLAEHFETMERLEKATKEELMAVPEIGEKMAGSIIAFFSQPEAAELLHELRLYGVNMAYKGPKRAAEAPADSAFAGKTVVLTGKLASMSRNEAKEEIERLGGRVTGSVSRSTDIVIAGEDAGSKLEKAQQLGIEIWDESRFLQEIN

SEQ ID NO: 1876 - protein, 660 aa, Geobacillus thermodenitrificans
QQAKRRAAELRELLNRYGYEYYVLDRPSVPDAEYDRLMQELIAIEKQYPELKTSDSPTQRIGGPPLEAFRKVTHRVPMMSLANAFNEGDLRDFDRRVRQEVGEAAYVCELKIDGLAVSVRYEDGYFVQGATRGDGTTGEDITENLKTIRSLPLRLNEPVSLEARGEAFMPKASFLRLNEERQARGEELFANPRNAAAGSLRQLDPKVAASRQLDLFVYGLANAEELGIESHSAALSYLQSLGFKVNPERRRCATIDEVIAFVNEWKEKRPQLPYEIDGIVIKVDSFAQQRQLGATAKSPRWAIAYKFPAEEVVTTLIGIEVNVGRTGAVTPTAILEPVRVAGTTVQRATLHNEDFIREKDIRIGDAVIIKKAGDIIPEVVGVVVDRRDGDEVPFTMPTHCPECESELVRLDGEVALRCLNPKCPAQLRERLIHFASRSAMNIEGLGEKVVTQLFNAGLVHDVADLYQLTKEQLVGLERMGEKSAANLLAAIEASKQNSLERLLFGLGIRYVGAKAAQLLAEHFETMERLEAATKDELMAVPEIGEKMADSITTYFSQPEAVELLNELRTYGVNMAYKGRKRTAETPASSVLAGKTVVLTGKLASMSRNEAKEQIERLGGRVTGSVSRSTDIVIAGEDAGSKLDKAQQLGIEIWDETRFLQ

SEQ ID NO: 1877 - protein, 665 aa, Bacillus  NRRL B-14911
MDLQNAEARVKELHNLLNQYGYEYYVLDKPSVPDSEYDRLLKELMELENEHPQLKTADSPTQRVGGEILDMFEKVEHQTPMLSLGNAFNEEDLRSFDRRVRQTAGENLSYVCELKIDGLAVALKYEDGLFIQGATRGDGTIGEDITVNLRTIRSIPLRLSEPVSIEVRGEAFMPGRSFEALNKGKEERGEEPFANPRNAAAGSLRQLDPRIAASRNLDIFLYGISNTGDTGVESHSAGLDYLETLGFKTNKERRKCASIEEVIEYVSSWTEKRPNLDYDIDGIVIKVDSLALQEELGATAKSPRWAIAYKFPAEEVVTTLRDIELSVGRTGVVTPTALLEPVRVAGTTVQRASLHNEDLIREKDIKIGDKVVVKKAGDIIPEVVNVLAEQRTGEEREFIMPTHCPECGSELVRLEGEVALRCINPKCPAQIREGLIHFVSRNAMNIDGLGEKVVSQLFAKELIKDVADLYKLTHEALIGMERMGEKSVNNLVQAIEASKQNSLEKLLFGLGIRHVGAKAAKTLAQHFSSMDNLMAASEDDLTAINEIGGKMAGAIVAFFEQEEAKELIRELKESGVNMEYKGPKPVAAEDSDSFFAGKTIVLTGKLSILSRNEAKEKIEALGGNVSGSVSKKTDLLIAGEDAGSKLAKAQDLGIDIWNEEQLVEE

SEQ ID NO: 1878 - protein, 742 aa, Artificial
  Alicyclobacillus acidocaldarius mutated SEQ ID NO 1871
MGARRDRRQVGRGRIAGTRRALRRPHRREAAVCQVRADSQGGSLSGFKHPMQCVIRSVMRVVDAKSALSLEEARARAKVLREQIEYHNRKYYLEDNPEISDAEWDALMRDLIELERKYPELVDPASPTQRVGAPALEGFAKVVHEVPMLSLANAYSTEDLLDWDRRVRQAVGDDVRYVCELKVDGLAVALRYQDGRLVLGATRGDGSVGEDITANIRTIRNVPLELSEPVSLEVRGEAYMPKREFMRLNELREQQGEPLFANPRNAAAGSLRQLDPAVAASRRLGVIVYQLVRAEAHGCETHSQALDYVARLGLPAHRERHVCANIEDVIAYIEAWADKRHELPYATDGMVVKVDSLALQARLGATAKSPRWAIAYKYAAEQAETTLRAIELNVGRTGVVTPTAVFDPVQLAGTTVSRASLHNEDLVREKDIRVGDVIVVQKAGDIIPEVIRSLPERRTEPLPEFRMPETCPQCGSRLVRLDGEVAWRCINPDCPALLREGLIHFCSRDAMNIEGLGEQWITVLLDRGLVRTHADLYRLRKAELVQLDRMGDKLADKLLHNIQESKRNSLERLLFGLGIRHVGEKAAKTLAEHFVTIDALMSASEEDLMAVPDIGPKVAQSIRQYFDTPRVRQLIQELKDLGVNMTYLGPQKVSDGPLAGKTVVLTGVLQAADRKQATAWIEQMGGKVASSVSAKTDVLIAGDKAGSKLAKAQEILRNHPDAKLEIWDEAAFLRLVDEAGLR

SEQ ID NO: 1879 - protein, 742 aa, Artificial
  Alicyclobacillus acidocaldarius mutated SEQ ID NO 1871
MGARRDRRQVGRGRIAGTRRALRRPHRREAAVCQVRADSQGGSLSGFKHPMQCVIRSVMRVVDAKSALSLEEARARAKVLREQIEYHNRKYYLEDNPEISDAEWDALMRDLIELERKYPELVDPASPTQRVGAPALEGFAKVVHEVPMLSLANAYSTEDLLDWDRRVRQAVGDDVRYVCELKVDGLAVALRYQDGRLVLGATRGDGSVGEDITANIRTIRNVPLELSEPVSLEVRGEAYMPKREFMRLNELREQQGEPLFANPRNAAAGSLRQLDPAVAASRRLGVIVYQLVRAEAHGCETHSQALDYVARLGLPAHRERHVCANIEDVIAYIEAWADKRHELPYATDGMVVKVDSLALQARLGATAKSPRWAIAYKYAAEQAETTLRAIELNVGRTGVVTPTAVFDPVQLAGTTVSRASLHNEDLVREKDIRVGDVIVVQKAGDIIPEVIRSLPERRTEPLPDFRMPETCPQCGSRLVRLDGEVAWRCINPDCPALLREGLIHFCSRDAMNIEGLGEQWITVLLDRGLVRTHADLYRLRKADLVQLDRMGDKLADKLLHNIQESKRNSLERLLFGLGIRHVGEKAAKTLAEHFVTIDALMSASEEDLMAVPDIGPKVAQSIRQYFDTPRVRQLIQELKDLGVNMTYLGPQKVSDGPLAGKTVVLTGVLQAADRKQATAWIEQMGGKVASSVSAKTDVLIAGDKAGSKLAKAQEILRNHPDAKLEIWDEAAFLRLVDEAGLR

SEQ ID NO: 1880 - protein, 742 aa, Artificial
  Alicyclobacillus acidocaldarius mutated SEQ ID NO 1871
MGARRDRRQVGRGRIAGTRRALRRPHRREAAVCQVRADSQGGSISGFKHPMQCVIRSVMRVVDAKSALSLEEARARAKVLREQIEYHNRKYYLEDNPEISDAEWDALMRDLIELERKYPELVDPASPTQRVGAPALEGFAKVVHEVPMLSLANAYSTEDLLDWDRRVRQAVGDDVRYVCELKVDGLAVALRYQDGRLVLGATRGDGSVGEDITANIRTIRNVPLELSEPVSLEVRGEAYMPKREFMRLNELREQQGEPLFANPRNAAAGSLRQLDPAVAASRRLGVIVYQLVRAEAHGCETHSQALDYVARLGLPAHRERHVCANIEDVIAYIEAWADKRHELPYATDGMVVKVDSLALQARLGATAKSPRWAIAYKYAAEQAETTLRAIELNVGRTGVVTPTAVFDPVQLAGTTVSRASLHNEDLVREKDIRVGDVIVVQKAGDIIPEVIRSLPERRTEPLPEFRMPETCPQCGSRLVRLDGEVAWRCINPDCPALLREGLIHFCSRDAMNIEGLGEQWITVLLDRGLVRTHADLYRLRKADLVQLDRMGDKLADKLLHNIQESKRNSLERLLFGLGIRHVGEKAAKTLAEHFVTIDALMSASEEDLMAVPDIGPKVAQSIRQYFDTPRVRQLIQELKDLGVNMTYLGPQKVSDGPLAGKTVVLTGVLQAADRKQATAWIEQMGGKVASSVSAKTDVLIAGDKAGSKLAKAQEILRNHPDAKLEIWDEAAFLRLVDEAGLR

SEQ ID NO: 1881 - protein, 742 aa, Artificial
  Alicyclobacillus acidocaldarius mutated SEQ ID NO 1871
MGARRDRRQVGRGRIAGTRRALRRPHRREAAVCQVRADSQGGSLSGFKHPMQCVIRSVMRVVDAKSALSLEEARARAKVLREQIEYHNRKYYLEDNPEISDAEWDALMRDLIELERKYPELVDPASPTQRVGAPALEGFAKVVHEVPMLSLANAYSTEDLLDWDRRVRQAVGDDVRYVCELKVDGLAVALRYQDGRLVLGATRGDGSVGEDITANIRTIRNVPLELSEPVSLEVRGEAYMPKREFMRLNELREQQGEPLFANPRNAAAGSLRQLDPAVAASRRLGVIVYQLVRAEAHGCETHSQALDYVARLGLPAHRERHVCANIEDVIAYIEAWADKRHELPYATDGMVVKVDSLALQARLGATAKSPRWAIAYKYAAEQAETTLRAIELNVGRTGVVTPTAVFDPVQLAGTTVSRASLHNEDLVREKDIRVGDVIVVQKAGDIIPEVIRSLPERRTEPLPEFRMPETCPQCGSRLVRLDGEVAWRCINPDCPALLREGLIHFCSRDAMNIEGLGEQWITVLLDRGLVRTHADLYRLRKADLVQLDRMGDKLADKLLHNIQESKRNSLERLLFGLGIRHVGEKAAKTLAEHFVTIDALMSASEEDLMAVPDIGPKVAQSIRQYFDTPRVKQLIQELKDLGVNMTYLGPQKVSDGPLAGKTVVLTGVLQAADRKQATAWIEQMGGKVASSVSAKTDVLIAGDKAGSKLAKAQEILRNHPDAKLEIWDEAAFLRLVDEAGLR

SEQ ID NO: 1882 - protein, 742 aa, Artificial
  Alicyclobacillus acidocaldarius mutated SEQ ID NO 1871
MGARRDRRQVGRGRIAGTRRALRRPHRREAAVCQVRADSQGGSLSGFKHPMQCVIRSVMRVVDAKSALSLEEARARAKVLREQIEYHNRKYYLEDNPEISDAEWDALMRDLIELERKYPELVDPASPTQRVGAPALEGFAKVVHEVPMLSLANAYSTEDLLDWDRRVRQAVGDDVRYVCELKVDGLAVALRYQDGRLVLGATRGDGSVGEDITANIRTIRNVPLELSEPVSLEVRGEAYMPKREFMRLNELREQQGEPLFANPRNAAAGSLRQLDPAVAASRRLGVIVYQLVRAEAHGCETHSQALDYVARLGLPAHRERHVCANIEDVIAYIEAWADKRHELPYATDGMVVKVDSLALQARLGATAKSPRWAIAYKYAAEQAETTLRAIELNVGRTGVVTPTAVFDPVQLAGTTVSRASLHNEDLVREKDIRVGDVIVVQKAGDIIPEVIRSLPERRTEPLPEFRMPETCPQCGSRLVRLDGEVAWRCINPDCPAILREGLIHFCSRDAMNIEGLGEQWITVLLDRGLVRTHADLYRLRKADLVQLDRMGDKLADKLLHNIQESKRNSLERLLFGLGIRHVGEKAAKTLAEHFVTIDALMSASEEDLMAVPDIGPKVAQSIRQYFDTPRVRQLIQELKDLGVNMTYLGPQKVSDGPLAGKTVVLTGVLQAADRKQATAWIEQMGGKVASSVSAKTDVLIAGDKAGSKLAKAQEILRNHPDAKLEIWDEAAFLRLVDEAGLR

SEQ ID NO: 1883 - DNA, 2229 bp, Artificial
  Alicyclobacillus acidocaldarius mutated SEQ ID NO 1872
gtgggggcgcggcgtgatcgtcgccaagtcgggcgagggcgaatcgctggaactcgtcgtgcgcttcgaagaccccatcggcgagaagcggctgtttgccaagttcgcgccgattcacaaggtggatccctaagcggattcaagcatcccatgcagtgcgtgatcaggagtgtgatgcgtgtcgtggacgccaaatcggccctgtccctggaagaagcgcgtgcgcgcgccaaagtgctccgggaacaaatcgaatatcacaatcgaaagtactacctggaggacaatccggagatctccgacgcggagtgggacgcgctgatgcgggatctcatcgagcttgagcgcaagtacccagagctcgtcgatccggcctcgcccacgcagcgtgtgggcgccccggcgctcgagggattcgccaaggtcgtgcacgaggtgcccatgctgtcgctcgcaaacgcgtattcgacggaggatctgctcgactgggatcgccgcgtgcgacaggcggtgggcgacgacgtccgctacgtgtgcgagctcaaggtcgacggcttggccgtggcgcttcgctaccaggacggccggctcgtgctcggtgcaacgcgcggcgacggatcggtcggggaggacatcacggccaacattcgcaccattcgcaacgtgccgcttgaactttcggaacccgtgtcgctcgaggtgcgaggcgaggcgtacatgccaaagcgcgagttcatgcggctcaacgagcttcgcgagcagcagggcgagccgcttttcgccaatccgcgcaacgcggccgccggatcgctgcgccagctcgatccggccgtggccgcgagccggaggctcggcgtgatcgtgtaccagttggtgcgcgccgaggcgcacgggtgtgagacgcacagccaggcgctggattacgtggcccgcctcggcctgcccgcgcatcgcgagcggcacgtgtgcgcgaacatcgaggacgtgatcgcgtacatcgaggcgtgggcggacaagcggcacgaactgccgtacgcgacggacggcatggtggtgaaggtcgactccctcgcgctgcaggcgcgcctcggcgccaccgcaaagagcccgcgctgggccattgcgtacaaatacgcggcggagcaggcggagaccacgcttcgcgccatcgagttgaacgtcggccgcacgggtgtagtcacaccgacggctgtgttcgatcccgtccagctcgcgggcaccacggtctcgagggcgtcgctgcacaacgaggacttggtgcgcgagaaggacatccgcgtgggcgacgtcattgttgtgcagaaggcgggggacatcattcccgaggtcattcgatcgctgcccgagcggcgcaccgagccgctgcccgaatttcgcatgccggagacgtgcccgcagtgcggatcgcggctcgtgcggctcgacggcgaggtggcgtggcgctgcatcaaccccgactgcccggctctcctgcgcgaggggctcatccacttctgttcgcgcgacgcgatgaacatcgagggcctcggcgagcagtggatcacggtgcttctggaccgcgggttggtacggacgcacgcggatttgtatcgcctccgaaaggccgaactcgtccaactggaccggatgggggataagctcgcggataaactgttgcacaacatccaggagagcaagcggaactcgctcgagcgcctcttgtttggactcggcatccggcacgtgggcgagaaggcggcgaagacgttggcggaacacttcgtcaccatcgacgcgctgatgtccgcgagcgaggaggacttgatggcggtccccgacatcggccccaaagtcgcgcagagcatccgccagtacttcgatacgccacgggtgaggcagctgattcaggagttgaaagacctgggcgtgaacatgacctacctcggcccgcagaaggtgtcggacggcccactcgccggaaagacggtggtattgaccggcgtgcttcaggcggcggatcgaaagcaggcgacggcgtggatcgagcagatgggtggcaaggtcgcctcgagtgtcagcgcgaagacggacgtgctcatcgcgggggacaaggcgggatcgaagctcgccaaggcgcaggagatcctgcggaatcacccggacgcaaagctcgagatctgggatgaggcggcgtttctgcgcctggtggacgaggcggggttgcgctga

SEQ ID NO: 1884 - DNA, 2229 bp, Artificial
  Alicyclobacillus acidocaldarius mutated SEQ ID NO 1872
gtgggggcgcggcgtgatcgtcgccaagtcgggcgagggcgaatcgctggaactcgtcgtgcgcttcgaagaccccatcggcgagaagcggctgtttgccaagttcgcgccgattcacaaggtggatccctaagcggattcaagcatcccatgcagtgcgtgatcaggagtgtgatgcgtgtcgtggacgccaaatcggccctgtccctggaagaagcgcgtgcgcgcgccaaagtgctccgggaacaaatcgaatatcacaatcgaaagtactacctggaggacaatccggagatctccgacgcggagtgggacgcgctgatgcgggatctcatcgagcttgagcgcaagtacccagagctcgtcgatccggcctcgcccacgcagcgtgtgggcgccccggcgctcgagggattcgccaaggtcgtgcacgaggtgcccatgctgtcgctcgcaaacgcgtattcgacggaggatctgctcgactgggatcgccgcgtgcgacaggcggtgggcgacgacgtccgctacgtgtgcgagctcaaggtcgacggcttggccgtggcgcttcgctaccaggacggccggctcgtgctcggtgcaacgcgcggcgacggatcggtcggggaggacatcacggccaacattcgcaccattcgcaacgtgccgcttgaactttcggaacccgtgtcgctcgaggtgcgaggcgaggcgtacatgccaaagcgcgagttcatgcggctcaacgagcttcgcgagcagcagggcgagccgcttttcgccaatccgcgcaacgcggccgccggatcgctgcgccagctcgatccggccgtggccgcgagccggaggctcggcgtgatcgtgtaccagttggtgcgcgccgaggcgcacgggtgtgagacgcacagccaggcgctggattacgtggcccgcctcggcctgcccgcgcatcgcgagcggcacgtgtgcgcgaacatcgaggacgtgatcgcgtacatcgaggcgtgggcggacaagcggcacgaactgccgtacgcgacggacggcatggtggtgaaggtcgactccctcgcgctgcaggcgcgcctcggcgccaccgcaaagagcccgcgctgggccattgcgtacaaatacgcggcggagcaggcggagaccacgcttcgcgccatcgagttgaacgtcggccgcacgggtgtagtcacaccgacggctgtgttcgatcccgtccagctcgcgggcaccacggtctcgagggcgtcgctgcacaacgaggacttggtgcgcgagaaggacatccgcgtgggcgacgtcattgttgtgcagaaggcgggggacatcattcccgaggtcattcgatcgctgcccgagcggcgcaccgagccgctgcccgattttcgcatgccggagacgtgcccgcagtgcggatcgcggctcgtgcggctcgacggcgaggtggcgtggcgctgcatcaaccccgactgcccggctctcctgcgcgaggggctcatccacttctgttcgcgcgacgcgatgaacatcgagggcctcggcgagcagtggatcacggtgcttctggaccgcgggttggtacggacgcacgcggatttgtatcgcctccgaaaggccgatctcgtccaactggaccggatgggggataagctcgcggataaactgttgcacaacatccaggagagcaagcggaactcgctcgagcgcctcttgtttggactcggcatccggcacgtgggcgagaaggcggcgaagacgttggcggaacacttcgtcaccatcgacgcgctgatgtccgcgagcgaggaggacttgatggcggtccccgacatcggccccaaagtcgcgcagagcatccgccagtacttcgatacgccacgggtgaggcagctgattcaggagttgaaagacctgggcgtgaacatgacctacctcggcccgcagaaggtgtcggacggcccactcgccggaaagacggtggtattgaccggcgtgcttcaggcggcggatcgaaagcaggcgacggcgtggatcgagcagatgggtggcaaggtcgcctcgagtgtcagcgcgaagacggacgtgctcatcgcgggggacaaggcgggatcgaagctcgccaaggcgcaggagatcctgcggaatcacccggacgcaaagctcgagatctgggatgaggcggcgtttctgcgcctggtggacgaggcggggttgcgctga

SEQ ID NO: 1885 - DNA, 2229 bp, Artificial
  Alicyclobacillus acidocaldarius mutated SEQ ID NO 1872
gtgggggcgcggcgtgatcgtcgccaagtcgggcgagggcgaatcgctggaactcgtcgtgcgcttcgaagaccccatcggcgagaagcggctgtttgccaagttcgcgccgattcacaaggtggatccattagcggattcaagcatcccatgcagtgcgtgatcaggagtgtgatgcgtgtcgtggacgccaaatcggccctgtccctggaagaagcgcgtgcgcgcgccaaagtgctccgggaacaaatcgaatatcacaatcgaaagtactacctggaggacaatccggagatctccgacgcggagtgggacgcgctgatgcgggatctcatcgagcttgagcgcaagtacccagagctcgtcgatccggcctcgcccacgcagcgtgtgggcgccccggcgctcgagggattcgccaaggtcgtgcacgaggtgcccatgctgtcgctcgcaaacgcgtattcgacggaggatctgctcgactgggatcgccgcgtgcgacaggcggtgggcgacgacgtccgctacgtgtgcgagctcaaggtcgacggcttggccgtggcgcttcgctaccaggacggccggctcgtgctcggtgcaacgcgcggcgacggatcggtcggggaggacatcacggccaacattcgcaccattcgcaacgtgccgcttgaactttcggaacccgtgtcgctcgaggtgcgaggcgaggcgtacatgccaaagcgcgagttcatgcggctcaacgagcttcgcgagcagcagggcgagccgcttttcgccaatccgcgcaacgcggccgccggatcgctgcgccagctcgatccggccgtggccgcgagccggaggctcggcgtgatcgtgtaccagttggtgcgcgccgaggcgcacgggtgtgagacgcacagccaggcgctggattacgtggcccgcctcggcctgcccgcgcatcgcgagcggcacgtgtgcgcgaacatcgaggacgtgatcgcgtacatcgaggcgtgggcggacaagcggcacgaactgccgtacgcgacggacggcatggtggtgaaggtcgactccctcgcgctgcaggcgcgcctcggcgccaccgcaaagagcccgcgctgggccattgcgtacaaatacgcggcggagcaggcggagaccacgcttcgcgccatcgagttgaacgtcggccgcacgggtgtagtcacaccgacggctgtgttcgatcccgtccagctcgcgggcaccacggtctcgagggcgtcgctgcacaacgaggacttggtgcgcgagaaggacatccgcgtgggcgacgtcattgttgtgcagaaggcgggggacatcattcccgaggtcattcgatcgctgcccgagcggcgcaccgagccgctgcccgaatttcgcatgccggagacgtgcccgcagtgcggatcgcggctcgtgcggctcgacggcgaggtggcgtggcgctgcatcaaccccgactgcccggctctcctgcgcgaggggctcatccacttctgttcgcgcgacgcgatgaacatcgagggcctcggcgagcagtggatcacggtgcttctggaccgcgggttggtacggacgcacgcggatttgtatcgcctccgaaaggccgatctcgtccaactggaccggatgggggataagctcgcggataaactgttgcacaacatccaggagagcaagcggaactcgctcgagcgcctcttgtttggactcggcatccggcacgtgggcgagaaggcggcgaagacgttggcggaacacttcgtcaccatcgacgcgctgatgtccgcgagcgaggaggacttgatggcggtccccgacatcggccccaaagtcgcgcagagcatccgccagtacttcgatacgccacgggtgaggcagctgattcaggagttgaaagacctgggcgtgaacatgacctacctcggcccgcagaaggtgtcggacggcccactcgccggaaagacggtggtattgaccggcgtgcttcaggcggcggatcgaaagcaggcgacggcgtggatcgagcagatgggtggcaaggtcgcctcgagtgtcagcgcgaagacggacgtgctcatcgcgggggacaaggcgggatcgaagctcgccaaggcgcaggagatcctgcggaatcacccggacgcaaagctcgagatctgggatgaggcggcgtttctgcgcctggtggacgaggcggggttgcgctga

SEQ ID NO: 1886 - DNA, 2229 bp, Artificial
  Alicyclobacillus acidocaldarius mutated SEQ ID NO 1872
gtgggggcgcggcgtgatcgtcgccaagtcgggcgagggcgaatcgctggaactcgtcgtgcgcttcgaagaccccatcggcgagaagcggctgtttgccaagttcgcgccgattcacaaggtggatccctaagcggattcaagcatcccatgcagtgcgtgatcaggagtgtgatgcgtgtcgtggacgccaaatcggccctgtccctggaagaagcgcgtgcgcgcgccaaagtgctccgggaacaaatcgaatatcacaatcgaaagtactacctggaggacaatccggagatctccgacgcggagtgggacgcgctgatgcgggatctcatcgagcttgagcgcaagtacccagagctcgtcgatccggcctcgcccacgcagcgtgtgggcgccccggcgctcgagggattcgccaaggtcgtgcacgaggtgcccatgctgtcgctcgcaaacgcgtattcgacggaggatctgctcgactgggatcgccgcgtgcgacaggcggtgggcgacgacgtccgctacgtgtgcgagctcaaggtcgacggcttggccgtggcgcttcgctaccaggacggccggctcgtgctcggtgcaacgcgcggcgacggatcggtcggggaggacatcacggccaacattcgcaccattcgcaacgtgccgcttgaactttcggaacccgtgtcgctcgaggtgcgaggcgaggcgtacatgccaaagcgcgagttcatgcggctcaacgagcttcgcgagcagcagggcgagccgcttttcgccaatccgcgcaacgcggccgccggatcgctgcgccagctcgatccggccgtggccgcgagccggaggctcggcgtgatcgtgtaccagttggtgcgcgccgaggcgcacgggtgtgagacgcacagccaggcgctggattacgtggcccgcctcggcctgcccgcgcatcgcgagcggcacgtgtgcgcgaacatcgaggacgtgatcgcgtacatcgaggcgtgggcggacaagcggcacgaactgccgtacgcgacggacggcatggtggtgaaggtcgactccctcgcgctgcaggcgcgcctcggcgccaccgcaaagagcccgcgctgggccattgcgtacaaatacgcggcggagcaggcggagaccacgcttcgcgccatcgagttgaacgtcggccgcacgggtgtagtcacaccgacggctgtgttcgatcccgtccagctcgcgggcaccacggtctcgagggcgtcgctgcacaacgaggacttggtgcgcgagaaggacatccgcgtgggcgacgtcattgttgtgcagaaggcgggggacatcattcccgaggtcattcgatcgctgcccgagcggcgcaccgagccgctgcccgaatttcgcatgccggagacgtgcccgcagtgcggatcgcggctcgtgcggctcgacggcgaggtggcgtggcgctgcatcaaccccgactgcccggctctcctgcgcgaggggctcatccacttctgttcgcgcgacgcgatgaacatcgagggcctcggcgagcagtggatcacggtgcttctggaccgcgggttggtacggacgcacgcggatttgtatcgcctccgaaaggccgatctcgtccaactggaccggatgggggataagctcgcggataaactgttgcacaacatccaggagagcaagcggaactcgctcgagcgcctcttgtttggactcggcatccggcacgtgggcgagaaggcggcgaagacgttggcggaacacttcgtcaccatcgacgcgctgatgtccgcgagcgaggaggacttgatggcggtccccgacatcggccccaaagtcgcgcagagcatccgccagtacttcgatacgccacgggtgaaacagctgattcaggagttgaaagacctgggcgtgaacatgacctacctcggcccgcagaaggtgtcggacggcccactcgccggaaagacggtggtattgaccggcgtgcttcaggcggcggatcgaaagcaggcgacggcgtggatcgagcagatgggtggcaaggtcgcctcgagtgtcagcgcgaagacggacgtgctcatcgcgggggacaaggcgggatcgaagctcgccaaggcgcaggagatcctgcggaatcacccggacgcaaagctcgagatctgggatgaggcggcgtttctgcgcctggtggacgaggcggggttgcgctga

SEQ ID NO: 1887 - DNA, 2229 bp, Artificial
  Alicyclobacillus acidocaldarius mutated SEQ ID NO 1872
gtgggggcgcggcgtgatcgtcgccaagtcgggcgagggcgaatcgctggaactcgtcgtgcgcttcgaagaccccatcggcgagaagcggctgtttgccaagttcgcgccgattcacaaggtggatccctaagcggattcaagcatcccatgcagtgcgtgatcaggagtgtgatgcgtgtcgtggacgccaaatcggccctgtccctggaagaagcgcgtgcgcgcgccaaagtgctccgggaacaaatcgaatatcacaatcgaaagtactacctggaggacaatccggagatctccgacgcggagtgggacgcgctgatgcgggatctcatcgagcttgagcgcaagtacccagagctcgtcgatccggcctcgcccacgcagcgtgtgggcgccccggcgctcgagggattcgccaaggtcgtgcacgaggtgcccatgctgtcgctcgcaaacgcgtattcgacggaggatctgctcgactgggatcgccgcgtgcgacaggcggtgggcgacgacgtccgctacgtgtgcgagctcaaggtcgacggcttggccgtggcgcttcgctaccaggacggccggctcgtgctcggtgcaacgcgcggcgacggatcggtcggggaggacatcacggccaacattcgcaccattcgcaacgtgccgcttgaactttcggaacccgtgtcgctcgaggtgcgaggcgaggcgtacatgccaaagcgcgagttcatgcggctcaacgagcttcgcgagcagcagggcgagccgcttttcgccaatccgcgcaacgcggccgccggatcgctgcgccagctcgatccggccgtggccgcgagccggaggctcggcgtgatcgtgtaccagttggtgcgcgccgaggcgcacgggtgtgagacgcacagccaggcgctggattacgtggcccgcctcggcctgcccgcgcatcgcgagcggcacgtgtgcgcgaacatcgaggacgtgatcgcgtacatcgaggcgtgggcggacaagcggcacgaactgccgtacgcgacggacggcatggtggtgaaggtcgactccctcgcgctgcaggcgcgcctcggcgccaccgcaaagagcccgcgctgggccattgcgtacaaatacgcggcggagcaggcggagaccacgcttcgcgccatcgagttgaacgtcggccgcacgggtgtagtcacaccgacggctgtgttcgatcccgtccagctcgcgggcaccacggtctcgagggcgtcgctgcacaacgaggacttggtgcgcgagaaggacatccgcgtgggcgacgtcattgttgtgcagaaggcgggggacatcattcccgaggtcattcgatcgctgcccgagcggcgcaccgagccgctgcccgaatttcgcatgccggagacgtgcccgcagtgcggatcgcggctcgtgcggctcgacggcgaggtggcgtggcgctgcatcaaccccgactgcccggctattctgcgcgaggggctcatccacttctgttcgcgcgacgcgatgaacatcgagggcctcggcgagcagtggatcacggtgcttctggaccgcgggttggtacggacgcacgcggatttgtatcgcctccgaaaggccgatctcgtccaactggaccggatgggggataagctcgcggataaactgttgcacaacatccaggagagcaagcggaactcgctcgagcgcctcttgtttggactcggcatccggcacgtgggcgagaaggcggcgaagacgttggcggaacacttcgtcaccatcgacgcgctgatgtccgcgagcgaggaggacttgatggcggtccccgacatcggccccaaagtcgcgcagagcatccgccagtacttcgatacgccacgggtgaggcagctgattcaggagttgaaagacctgggcgtgaacatgacctacctcggcccgcagaaggtgtcggacggcccactcgccggaaagacggtggtattgaccggcgtgcttcaggcggcggatcgaaagcaggcgacggcgtggatcgagcagatgggtggcaaggtcgcctcgagtgtcagcgcgaagacggacgtgctcatcgcgggggacaaggcgggatcgaagctcgccaaggcgcaggagatcctgcggaatcacccggacgcaaagctcgagatctgggatgaggcggcgtttctgcgcctggtggacgaggcggggttgcgctga

SEQ ID NO: 1888 - protein, 560 aa, Alicyclobacillus acidocaldarius
MFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHRQVGDTWQRVPATPHNPQIMRVLKLLNMDLSIYTEAQKTA

SEQ ID NO: 1889 - DNA, 1683 bp, Alicyclobacillus acidocaldarius
ttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacaggcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1890 - protein, 542 aa, Bacillus coagulans; identical to SEQ ID NO: 1584

SEQ ID NO: 1891 - protein, 542 aa, Bacillus coagulans; identical to SEQ ID NO: 1585

SEQ ID NO: 1892 - protein, 542 aa, Bacillus coagulans; identical to SEQ ID NO: 1586

SEQ ID NO: 1893 - protein, 538 aa, Bacillus coagulans; identical to SEQ ID NO: 1587

SEQ ID NO: 1894 - protein, 349 aa, Moorella thermoacetica; identical to SEQ ID NO: 1588

SEQ ID NO: 1895 - protein, 560 aa, Artificial
  Alicyclobacillus acidocaldarius mutated SEQ ID NO 1888
MFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEIAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHRQVGDTWQRVPATPHNPQIMRVLKLLNMDLSIYTEAQKTA

SEQ ID NO: 1896 - protein, 560 aa, Artificial
  Alicyclobacillus acidocaldarius mutated SEQ ID NO 1888
MFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGKTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHRQVGDTWQRVPATPHNPQIMRVLKLLNMDLSIYTEAQKTA

SEQ ID NO: 1897 - protein, 560 aa, Artificial
  Alicyclobacillus acidocaldarius mutated SEQ ID NO 1888
MFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWERENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHRQVGDTWQRVPATPHNPQIMRVLKLLNMDLSIYTEAQKTA

SEQ ID NO: 1898 - protein, 560 aa, Artificial
  Alicyclobacillus acidocaldarius mutated SEQ ID NO 1888
MFGPVKSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHRQVGDTWQRVPATPHNPQIMRVLKLLNMDLSIYTEAQKTA

SEQ ID NO: 1899 - protein, 560 aa, Artificial
  Alicyclobacillus acidocaldarius mutated SEQ ID NO 1888
MFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVIITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHRQVGDTWQRVPATPHNPQIMRVLKLLNMDLSIYTEAQKTA

SEQ ID NO: 1900 - DNA, 1683 bp, Artificial
  Alicyclobacillus acidocaldarius mutated SEQ ID NO 1889
ttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaaattgcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacaggcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1901 - DNA, 1683 bp, Artificial
  Alicyclobacillus acidocaldarius mutated SEQ ID NO 1889
ttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggaaaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacaggcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1902 - DNA, 1683 bp, Artificial
  Alicyclobacillus acidocaldarius mutated SEQ ID NO 1889
ttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagcgtgaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacaggcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1903 - DNA, 1683 bp, Artificial
  Alicyclobacillus acidocaldarius mutated SEQ ID NO 1889
ttgttcggtccagttaaatcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacaggcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1904 - DNA, 1683 bp, Artificial
  Alicyclobacillus acidocaldarius mutated SEQ ID NO 1889
ttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgattatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacaggcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1905 - protein, 514 aa, Alicyclobacillus acidocaldarius
MMWTAIYTRVSTEHQAQAGHGLDVQREACVQYALSLGVAPHDIRLYEEAGGSGEDMDRPELLRLLDDVRRGLVDRVVVKHPDRLSRNVADKAIVVRELSACGVKLHFVDVPNWDESDEAVLLFHVISSIAEYELRQIRRRTLAGKLKAVRGGKVMPSGVDPYGYRYEDGRYVVVPEEAEIVRLIYQWYGIDGMSLRAIAERLDAMGVPTKTRQSARWHHSTVARILDNPLYRGTWYYNRRRTRKRQGVRGARRGRGRQVVAVRDPGEWIAVSVPPVVDPDLARSVALRKQGSPRGGSTSAHTFLSGKLVCAHCQRAWRHEACRTAGGIVRKFRRPPAERGADPCAYRCARVPADEIERAVWRELVRRMRALGIGRELAAGGRASPGDPLMEDVARLRREMRAAVERRDRARELYLRGHLDRTAALRAMSEEARRLREGRAEACRLCHARQRRLNAWEDLWTALETHDGVELRRLWLEAAVSRVEMDASGGEVVLTLFARIGEQTGARVDDTLAT

SEQ ID NO: 1906 - DNA, 1545 bp, Alicyclobacillus acidocaldarius
gtgatgtggaccgccatctacacccgcgtgtcgaccgaacaccaggcgcaggcggggcatgggcttgacgtccagcgagaggcgtgcgtgcagtacgccctttcccttggggtggccccgcacgacatccgcctctacgaggaagcgggcgggtcgggcgaggacatggaccggccggagctgttgcgcctcctcgatgacgtccggcgtgggcttgtcgatcgcgtcgtcgtgaaacaccccgaccgcctgtcgcgcaacgtggccgacaaggccattgtggtacgggagttatccgcgtgcggcgtgaagctccactttgtcgacgtgcccaactgggatgagtccgacgaagcggtgcttctctttcacgtcatctcgagcattgccgagtacgaactgcgccagatcagacggcggacccttgcgggcaaactgaaggcagttcggggcggcaaggtgatgccatccggggtggatccgtacggctatcgctacgaggacgggcgatacgtcgtggttcccgaggaggccgagatcgtccggctcatctaccaatggtatgggatcgacggcatgagccttcgcgccatcgccgagcggctcgacgcgatgggggtgccgaccaagacgcgccagtcggcgcgctggcaccacagcacggtggcgaggatcctcgacaacccactctatcgaggcacctggtattacaaccgccggcgcacgcgcaaacggcagggcgtgagaggcgcgcgccgcggccgagggcggcaggtggtggccgtgcgcgatcccggcgaatggatcgccgtatcggtgccgcccgttgtcgatccggacctcgcgcgctcggtcgcgctgcgcaagcagggcagtccgcgaggcggctcgacttcggcgcacacgtttttatcgggcaaactcgtgtgcgcgcactgtcaacgcgcttggcgtcacgaggcatgtcgaaccgcgggcgggatcgtgcgcaagtttcggcgcccgccggcggaacgaggggccgacccatgcgcgtatcgatgtgcgcgcgtgcctgcggacgagatcgagcgggcggtgtggcgcgagctggtgcggcgcatgcgcgctttgggaattgggcgcgagctcgccgcaggcgggcgcgcgagcccgggcgacccgctgatggaggatgtggcgcgacttcgccgagagatgcgggccgcggtggaaaggcgggatcgcgcgagggagctgtatctgcgcgggcacctggaccgaaccgcggctctgcgcgcgatgtcggaggaggcccggcgcctgcgcgaggggcgcgccgaggcgtgccgactgtgtcacgcgcggcaacgtcggttgaacgcgtgggaagacctgtggacggcgcttgaaacgcacgatggcgtggagctcaggcggttgtggctcgaggctgcggtgtcgcgcgtcgagatggacgcctcgggcggcgaggtggtgctgaccctcttcgcccggatcggcgaacaaacgggtgcccgcgtcgacgacacgttggcgacgtga

SEQ ID NO: 1907 - protein, 374 aa, Paenibacillus larvae
MHAAIYVRVSTGLQAVEGTSLETQLDYCLRKAFELGISQNDIHIYREEGASGEDLDRPALNRLRQDVASGTFSVLILTHPDRLTRDLTDKLFICRELESRNIRLVFVDTEYKNTPEGQLFFNLMSVIAQYELSLIKKRTVRGRLKAVEKENKIMPMRTAPYGYDIIGSKLVINEEEARFVRYIYEWYVHQRWTIRQIGEKLVELGAIPKRKESRSWSASSIQRILTSEIYIGRYYYNRRKTGKVKGQKTPSGSNRKLLEWRKEEDWIRVEVPAIIDTGIYEQAMQQRQRNRKKSGHVKESYLLRGLIRCGECGRSWQATSYSGRADPMSGAKKKYLCYRCPNKTPATFGTTRLICTAPSLKAEWLDQNVWKSVL

SEQ ID NO: 1908 - protein, 358 aa, Pelotomaculum thermopropionicum
MRAAIYLRVSTEDQAKHGYSLPDQRTACREKAAALGAGEVMEFADEGISGELLDRPGLSALREAVKAGQLDLVVCFDPDRLARKLAHQLIITDEIEKAGVRLEFVNFEWQNTPDGRLFYALRGAIAEYEKEKIRERTVRGKLQKARLGGLPVQADSYGYIYDNGTVKPHPVESEVVKMIFRWFTTEDIGVNGVAARLSEQGIPTRKGRPAWQRCVVKTILTNPMYVGTFYYNRRDCRGTCYNKHLPPEKRVKVKEKPGEEWIAVPVPAIIDRETWEKAQEKIKAARRLWSGWSREEYLLSGLISCADCGNTMHGAVKTKSGGSRERGYTCVKTAAGASNQGCRPIKRVPAEIVEKAVW

SEQ ID NO: 1909 - protein, 357 aa, Thermosinus carboxydivorans
AIYARVSTDEQARTGYSLQDQVNQCRKKLLSLGLSNIKEYIDDGYSGEFLDRPALSRLRDDLRAGLIKTVMVYDPDRLSRNLTNQLIIADEIEKYGAKLEFITGSYDASPEGRLFFSIRGAIAEFEKEKIRERSLRGKRAKVLSGKPLFGRDPYGYICDRDTGQYVINEEEAKIVRLIFKLYTENRYSVAKLHAQLKAMGVVNRSGKPFSLSVLDHILANEMYAGTKWYFQKYQKTVGQKKRKVLKRNVNEWVSIDVPAIIDKETFQKAAEVRRQNKVTAKRNTKFEYLLSGIIKCPKCGYAMRGTRFPKRNNKDYAYYVCSAYVNAYECDNRRCVPSQELDEAVWQEIVNMFKKSG

SEQ ID NO: 1910 - protein, 356 aa, Pelotomaculum thermopropionicum
MRAAVYVRVSTEDQARHGYSLQEQKEACRCRAVDLGAKTVLEFADEGVSGATLDRPGLQGLRELIRSGQIDLVVVRDPDRLSRKLSHQLILTEEIEKAGVRLEFLDFDWKDTPDGRLFYAIRGAIAEFEKEKIRERMARGKTQKAKQGGMPIGFYNYGYVYEPETGKVRLHETEAKVVEEIFKWFVQEDIGINGVAKRLNEAEVPSRKGKRWHKQVVRQVLVNPVYKGTWQYKDICIPVPAIIDEAVWLKAQEKIRGARRLWAGQRKHDYLLSGIVTCGECGQTMTGVYSKWWNKKDRRYTCFKGYQGARHRGCLPSKYVLAGYVESAVWEQVKDWLQDPGALASEAYASSPRVED

SEQ ID NO: 1911 - protein, 386 aa, Nitrococcus mobilis
MKIAAIYARVSSDQQKGANTIASQTAALIEFAREQGFTVPDEWIIEDEGFSGASLLRPGLERLRDLAAEGQIQAVLIHSPDRLSRKYAYQVLLTEEFARHGVEAIFIKAPHSATPEDQLMLQFQGMIAEYERAQILERSRRGKRHRAKSGEISVLGGAPYGYRYIRKMPETPARYEIDAAEAAVVRLVFEKYTVDGLSIGAIARLLREMGPPTRRRVTRWERSVVWGMLRNPAYKGTACFNKTQVGPRQKVTKPFRLSGRSVHGEKTSAHERPREEWIEVPVPALVSEETFALAAERLADNKRFAPRRTIEPSLVQGLVSCRKCGYALYRASTRTSARKIHYYRCLGSDGWRHLGGSVCDSRPIRQDLLDHIVWQEVMRLIADPGL

SEQ ID NO: 1912 - protein, 514 aa, Artificial
  Alicyclobacillus acidocaldarius mutated SEQ ID NO 1905
MMWTAIYTRVSTEHQAQAGHGLDVQREACVQYALSLGVAPHDIRLYEEAGGSGEDMDRPELLRLLDDVRRGLVDRVVVKHPDRLSRNVADKAIVVRELSACGVKLHFVDVPNWDESDEAVLLFHVISSIAEYELRQIRRRTLAGKLKAVRGGKVMPSGVDPYGYRYEDGRYVVVPEEAEIVRLIYQWYGIDGMSLRAIAERLDAMGVPTKTRQSARWHHSTVARILDNPLYRGTWYYNRRRTRKRQGVRGARRGRGRQVVAVRDPGEWIAVSVPPVVDPDLARSVALRKQGSPRGGSTSAHTFLSGKLVCAHCQRAWRHEACRTAGGIVRKFRRPPAERGADPCAYRCARVPADEIERAVWRELVRRMRALGIGKELAAGGRASPGDPLMEDVARLRREMRAAVERRDRARELYLRGHLDRTAALRAMSEEARRLREGRAEACRLCHARQRRLNAWEDLWTALETHDGVELRRLWLEAAVSRVEMDASGGEVVLTLFARIGEQTGARVDDTLAT

SEQ ID NO: 1913 - protein, 514 aa, Artificial
  Alicyclobacillus acidocaldarius mutated SEQ ID NO 1905
MMWTAIYTRVSTEHQAQAGHGLDVQREACVQYALSLGVAPHDIRLYEEAGGSGEDMDRPELLRLLDDVRRGLVDRVVVKHPDRLSRNVADKAIVVRELSACGVKLHFVDVPNWDESDEAVLLFHVISSIAEYELRQIRRRTLAGKLKAVRGGKVMPSGVDPYGYRYEDGRYVVVPEEAEIVRLIYQWYGIDGMSLRAIAERLDAMGVPTKTRQSARWHHSTVARILDNPLYRGTWYYNRRRTRKRQGVRGARRGRGRQVVAVRDPGEWIAVSVPPVVDPDLARSVALRKQGSPRGGSTSAHTFLSGKLVCAHCQRAWRHEACRTAGGIVRKFRRPPAERGADPCAYRCARVPADEIERAVWRELVRRMRALGIGRELAAGGRASPGDPLMEDVARLRREMRAAVERRDRARELYLRGHLDRTAALRAMSEEARRLREGRAEACRLCHARQRRLNAWDDLWTALETHDGVELRRLWLEAAVSRVEMDASGGEVVLTLFARIGEQTGARVDDTLAT

SEQ ID NO: 1914 - protein, 514 aa, Artificial
  Alicyclobacillus acidocaldarius mutated SEQ ID NO 1905
MMWTAIYTRVSTEHQAQAGHGLDVQREACVQYAISLGVAPHDIRLYEEAGGSGEDMDRPELLRLLDDVRRGLVDRVVVKHPDRLSRNVADKAIVVRELSACGVKLHFVDVPNWDESDEAVLLFHVISSIAEYELRQIRRRTLAGKLKAVRGGKVMPSGVDPYGYRYEDGRYVVVPEEAEIVRLIYQWYGIDGMSLRAIAERLDAMGVPTKTRQSARWHHSTVARILDNPLYRGTWYYNRRRTRKRQGVRGARRGRGRQVVAVRDPGEWIAVSVPPVVDPDLARSVALRKQGSPRGGSTSAHTFLSGKLVCAHCQRAWRHEACRTAGGIVRKFRRPPAERGADPCAYRCARVPADEIERAVWRELVRRMRALGIGRELAAGGRASPGDPLMEDVARLRREMRAAVERRDRARELYLRGHLDRTAALRAMSEEARRLREGRAEACRLCHARQRRLNAWEDLWTALETHDGVELRRLWLEAAVSRVEMDASGGEVVLTLFARIGEQTGARVDDTLAT

SEQ ID NO: 1915 - protein, 514 aa, Artificial
  Alicyclobacillus acidocaldarius mutated SEQ ID NO 1905
MMWTAIYTRVSTEHQAQAGHGLDVQREACVQYALSLGVAPHDIRLYEEAGGSGEDMDRPELLRLLDDVRKGLVDRVVVKHPDRLSRNVADKAIVVRELSACGVKLHFVDVPNWDESDEAVLLFHVISSIAEYELRQIRRRTLAGKLKAVRGGKVMPSGVDPYGYRYEDGRYVVVPEEAEIVRLIYQWYGIDGMSLRAIAERLDAMGVPTKTRQSARWHHSTVARILDNPLYRGTWYYNRRRTRKRQGVRGARRGRGRQVVAVRDPGEWIAVSVPPVVDPDLARSVALRKQGSPRGGSTSAHTFLSGKLVCAHCQRAWRHEACRTAGGIVRKFRRPPAERGADPCAYRCARVPADEIERAVWRELVRRMRALGIGRELAAGGRASPGDPLMEDVARLRREMRAAVERRDRARELYLRGHLDRTAALRAMSEEARRLREGRAEACRLCHARQRRLNAWEDLWTALETHDGVELRRLWLEAAVSRVEMDASGGEVVLTLFARIGEQTGARVDDTLAT

SEQ ID NO: 1916 - protein, 514 aa, Artificial
  Alicyclobacillus acidocaldarius mutated SEQ ID NO 1905
MMWTAIYTRVSTEHQAQAGHGLDVQREACVQYALSLGVAPHDIRLYEEAGGSGEDMDRPELLRLLDDVRRGIVDRVVVKHPDRLSRNVADKAIVVRELSACGVKLHFVDVPNWDESDEAVLLFHVISSIAEYELRQIRRRTLAGKLKAVRGGKVMPSGVDPYGYRYEDGRYVVVPEEAEIVRLIYQWYGIDGMSLRAIAERLDAMGVPTKTRQSARWHHSTVARILDNPLYRGTWYYNRRRTRKRQGVRGARRGRGRQVVAVRDPGEWIAVSVPPVVDPDLARSVALRKQGSPRGGSTSAHTFLSGKLVCAHCQRAWRHEACRTAGGIVRKFRRPPAERGADPCAYRCARVPADEIERAVWRELVRRMRALGIGRELAAGGRASPGDPLMEDVARLRREMRAAVERRDRARELYLRGHLDRTAALRAMSEEARRLREGRAEACRLCHARQRRLNAWEDLWTALETHDGVELRRLWLEAAVSRVEMDASGGEVVLTLFARIGEQTGARVDDTLAT

SEQ ID NO: 1917 - DNA, 1545 bp, Artificial
  Alicyclobacillus acidocaldarius mutated SEQ ID NO 1906
gtgatgtggaccgccatctacacccgcgtgtcgaccgaacaccaggcgcaggcggggcatgggcttgacgtccagcgagaggcgtgcgtgcagtacgccctttcccttggggtggccccgcacgacatccgcctctacgaggaagcgggcgggtcgggcgaggacatggaccggccggagctgttgcgcctcctcgatgacgtccggcgtgggcttgtcgatcgcgtcgtcgtgaaacaccccgaccgcctgtcgcgcaacgtggccgacaaggccattgtggtacgggagttatccgcgtgcggcgtgaagctccactttgtcgacgtgcccaactgggatgagtccgacgaagcggtgcttctctttcacgtcatctcgagcattgccgagtacgaactgcgccagatcagacggcggacccttgcgggcaaactgaaggcagttcggggcggcaaggtgatgccatccggggtggatccgtacggctatcgctacgaggacgggcgatacgtcgtggttcccgaggaggccgagatcgtccggctcatctaccaatggtatgggatcgacggcatgagccttcgcgccatcgccgagcggctcgacgcgatgggggtgccgaccaagacgcgccagtcggcgcgctggcaccacagcacggtggcgaggatcctcgacaacccactctatcgaggcacctggtattacaaccgccggcgcacgcgcaaacggcagggcgtgagaggcgcgcgccgcggccgagggcggcaggtggtggccgtgcgcgatcccggcgaatggatcgccgtatcggtgccgcccgttgtcgatccggacctcgcgcgctcggtcgcgctgcgcaagcagggcagtccgcgaggcggctcgacttcggcgcacacgtttttatcgggcaaactcgtgtgcgcgcactgtcaacgcgcttggcgtcacgaggcatgtcgaaccgcgggcgggatcgtgcgcaagtttcggcgcccgccggcggaacgaggggccgacccatgcgcgtatcgatgtgcgcgcgtgcctgcggacgagatcgagcgggcggtgtggcgcgagctggtgcggcgcatgcgcgctttgggaattgggaaagagctcgccgcaggcgggcgcgcgagcccgggcgacccgctgatggaggatgtggcgcgacttcgccgagagatgcgggccgcggtggaaaggcgggatcgcgcgagggagctgtatctgcgcgggcacctggaccgaaccgcggctctgcgcgcgatgtcggaggaggcccggcgcctgcgcgaggggcgcgccgaggcgtgccgactgtgtcacgcgcggcaacgtcggttgaacgcgtgggaagacctgtggacggcgcttgaaacgcacgatggcgtggagctcaggcggttgtggctcgaggctgcggtgtcgcgcgtcgagatggacgcctcgggcggcgaggtggtgctgaccctcttcgcccggatcggcgaacaaacgggtgcccgcgtcgacgacacgttggcgacgtga

SEQ ID NO: 1918 - DNA, 1545 bp, Artificial
  Alicyclobacillus acidocaldarius mutated SEQ ID NO 1906
gtgatgtggaccgccatctacacccgcgtgtcgaccgaacaccaggcgcaggcggggcatgggcttgacgtccagcgagaggcgtgcgtgcagtacgccctttcccttggggtggccccgcacgacatccgcctctacgaggaagcgggcgggtcgggcgaggacatggaccggccggagctgttgcgcctcctcgatgacgtccggcgtgggcttgtcgatcgcgtcgtcgtgaaacaccccgaccgcctgtcgcgcaacgtggccgacaaggccattgtggtacgggagttatccgcgtgcggcgtgaagctccactttgtcgacgtgcccaactgggatgagtccgacgaagcggtgcttctctttcacgtcatctcgagcattgccgagtacgaactgcgccagatcagacggcggacccttgcgggcaaactgaaggcagttcggggcggcaaggtgatgccatccggggtggatccgtacggctatcgctacgaggacgggcgatacgtcgtggttcccgaggaggccgagatcgtccggctcatctaccaatggtatgggatcgacggcatgagccttcgcgccatcgccgagcggctcgacgcgatgggggtgccgaccaagacgcgccagtcggcgcgctggcaccacagcacggtggcgaggatcctcgacaacccactctatcgaggcacctggtattacaaccgccggcgcacgcgcaaacggcagggcgtgagaggcgcgcgccgcggccgagggcggcaggtggtggccgtgcgcgatcccggcgaatggatcgccgtatcggtgccgcccgttgtcgatccggacctcgcgcgctcggtcgcgctgcgcaagcagggcagtccgcgaggcggctcgacttcggcgcacacgtttttatcgggcaaactcgtgtgcgcgcactgtcaacgcgcttggcgtcacgaggcatgtcgaaccgcgggcgggatcgtgcgcaagtttcggcgcccgccggcggaacgaggggccgacccatgcgcgtatcgatgtgcgcgcgtgcctgcggacgagatcgagcgggcggtgtggcgcgagctggtgcggcgcatgcgcgctttgggaattgggcgcgagctcgccgcaggcgggcgcgcgagcccgggcgacccgctgatggaggatgtggcgcgacttcgccgagagatgcgggccgcggtggaaaggcgggatcgcgcgagggagctgtatctgcgcgggcacctggaccgaaccgcggctctgcgcgcgatgtcggaggaggcccggcgcctgcgcgaggggcgcgccgaggcgtgccgactgtgtcacgcgcggcaacgtcggttgaacgcgtgggatgacctgtggacggcgcttgaaacgcacgatggcgtggagctcaggcggttgtggctcgaggctgcggtgtcgcgcgtcgagatggacgcctcgggcggcgaggtggtgctgaccctcttcgcccggatcggcgaacaaacgggtgcccgcgtcgacgacacgttggcgacgtga

SEQ ID NO: 1919 - DNA, 1545 bp, Artificial
  Alicyclobacillus acidocaldarius mutated SEQ ID NO 1906
gtgatgtggaccgccatctacacccgcgtgtcgaccgaacaccaggcgcaggcggggcatgggcttgacgtccagcgagaggcgtgcgtgcagtacgccatttcccttggggtggccccgcacgacatccgcctctacgaggaagcgggcgggtcgggcgaggacatggaccggccggagctgttgcgcctcctcgatgacgtccggcgtgggcttgtcgatcgcgtcgtcgtgaaacaccccgaccgcctgtcgcgcaacgtggccgacaaggccattgtggtacgggagttatccgcgtgcggcgtgaagctccactttgtcgacgtgcccaactgggatgagtccgacgaagcggtgcttctctttcacgtcatctcgagcattgccgagtacgaactgcgccagatcagacggcggacccttgcgggcaaactgaaggcagttcggggcggcaaggtgatgccatccggggtggatccgtacggctatcgctacgaggacgggcgatacgtcgtggttcccgaggaggccgagatcgtccggctcatctaccaatggtatgggatcgacggcatgagccttcgcgccatcgccgagcggctcgacgcgatgggggtgccgaccaagacgcgccagtcggcgcgctggcaccacagcacggtggcgaggatcctcgacaacccactctatcgaggcacctggtattacaaccgccggcgcacgcgcaaacggcagggcgtgagaggcgcgcgccgcggccgagggcggcaggtggtggccgtgcgcgatcccggcgaatggatcgccgtatcggtgccgcccgttgtcgatccggacctcgcgcgctcggtcgcgctgcgcaagcagggcagtccgcgaggcggctcgacttcggcgcacacgtttttatcgggcaaactcgtgtgcgcgcactgtcaacgcgcttggcgtcacgaggcatgtcgaaccgcgggcgggatcgtgcgcaagtttcggcgcccgccggcggaacgaggggccgacccatgcgcgtatcgatgtgcgcgcgtgcctgcggacgagatcgagcgggcggtgtggcgcgagctggtgcggcgcatgcgcgctttgggaattgggcgcgagctcgccgcaggcgggcgcgcgagcccgggcgacccgctgatggaggatgtggcgcgacttcgccgagagatgcgggccgcggtggaaaggcgggatcgcgcgagggagctgtatctgcgcgggcacctggaccgaaccgcggctctgcgcgcgatgtcggaggaggcccggcgcctgcgcgaggggcgcgccgaggcgtgccgactgtgtcacgcgcggcaacgtcggttgaacgcgtgggaagacctgtggacggcgcttgaaacgcacgatggcgtggagctcaggcggttgtggctcgaggctgcggtgtcgcgcgtcgagatggacgcctcgggcggcgaggtggtgctgaccctcttcgcccggatcggcgaacaaacgggtgcccgcgtcgacgacacgttggcgacgtga

SEQ ID NO: 1920 - DNA, 1545 bp, Artificial
  Alicyclobacillus acidocaldarius mutated SEQ ID NO 1906
gtgatgtggaccgccatctacacccgcgtgtcgaccgaacaccaggcgcaggcggggcatgggcttgacgtccagcgagaggcgtgcgtgcagtacgccctttcccttggggtggccccgcacgacatccgcctctacgaggaagcgggcgggtcgggcgaggacatggaccggccggagctgttgcgcctcctcgatgacgtccggaaagggcttgtcgatcgcgtcgtcgtgaaacaccccgaccgcctgtcgcgcaacgtggccgacaaggccattgtggtacgggagttatccgcgtgcggcgtgaagctccactttgtcgacgtgcccaactgggatgagtccgacgaagcggtgcttctctttcacgtcatctcgagcattgccgagtacgaactgcgccagatcagacggcggacccttgcgggcaaactgaaggcagttcggggcggcaaggtgatgccatccggggtggatccgtacggctatcgctacgaggacgggcgatacgtcgtggttcccgaggaggccgagatcgtccggctcatctaccaatggtatgggatcgacggcatgagccttcgcgccatcgccgagcggctcgacgcgatgggggtgccgaccaagacgcgccagtcggcgcgctggcaccacagcacggtggcgaggatcctcgacaacccactctatcgaggcacctggtattacaaccgccggcgcacgcgcaaacggcagggcgtgagaggcgcgcgccgcggccgagggcggcaggtggtggccgtgcgcgatcccggcgaatggatcgccgtatcggtgccgcccgttgtcgatccggacctcgcgcgctcggtcgcgctgcgcaagcagggcagtccgcgaggcggctcgacttcggcgcacacgtttttatcgggcaaactcgtgtgcgcgcactgtcaacgcgcttggcgtcacgaggcatgtcgaaccgcgggcgggatcgtgcgcaagtttcggcgcccgccggcggaacgaggggccgacccatgcgcgtatcgatgtgcgcgcgtgcctgcggacgagatcgagcgggcggtgtggcgcgagctggtgcggcgcatgcgcgctttgggaattgggcgcgagctcgccgcaggcgggcgcgcgagcccgggcgacccgctgatggaggatgtggcgcgacttcgccgagagatgcgggccgcggtggaaaggcgggatcgcgcgagggagctgtatctgcgcgggcacctggaccgaaccgcggctctgcgcgcgatgtcggaggaggcccggcgcctgcgcgaggggcgcgccgaggcgtgccgactgtgtcacgcgcggcaacgtcggttgaacgcgtgggaagacctgtggacggcgcttgaaacgcacgatggcgtggagctcaggcggttgtggctcgaggctgcggtgtcgcgcgtcgagatggacgcctcgggcggcgaggtggtgctgaccctcttcgcccggatcggcgaacaaacgggtgcccgcgtcgacgacacgttggcgacgtga

SEQ ID NO: 1921 - DNA, 1545 bp, Artificial
  Alicyclobacillus acidocaldarius mutated SEQ ID NO 1906
gtgatgtggaccgccatctacacccgcgtgtcgaccgaacaccaggcgcaggcggggcatgggcttgacgtccagcgagaggcgtgcgtgcagtacgccctttcccttggggtggccccgcacgacatccgcctctacgaggaagcgggcgggtcgggcgaggacatggaccggccggagctgttgcgcctcctcgatgacgtccggcgtgggattgtcgatcgcgtcgtcgtgaaacaccccgaccgcctgtcgcgcaacgtggccgacaaggccattgtggtacgggagttatccgcgtgcggcgtgaagctccactttgtcgacgtgcccaactgggatgagtccgacgaagcggtgcttctctttcacgtcatctcgagcattgccgagtacgaactgcgccagatcagacggcggacccttgcgggcaaactgaaggcagttcggggcggcaaggtgatgccatccggggtggatccgtacggctatcgctacgaggacgggcgatacgtcgtggttcccgaggaggccgagatcgtccggctcatctaccaatggtatgggatcgacggcatgagccttcgcgccatcgccgagcggctcgacgcgatgggggtgccgaccaagacgcgccagtcggcgcgctggcaccacagcacggtggcgaggatcctcgacaacccactctatcgaggcacctggtattacaaccgccggcgcacgcgcaaacggcagggcgtgagaggcgcgcgccgcggccgagggcggcaggtggtggccgtgcgcgatcccggcgaatggatcgccgtatcggtgccgcccgttgtcgatccggacctcgcgcgctcggtcgcgctgcgcaagcagggcagtccgcgaggcggctcgacttcggcgcacacgtttttatcgggcaaactcgtgtgcgcgcactgtcaacgcgcttggcgtcacgaggcatgtcgaaccgcgggcgggatcgtgcgcaagtttcggcgcccgccggcggaacgaggggccgacccatgcgcgtatcgatgtgcgcgcgtgcctgcggacgagatcgagcgggcggtgtggcgcgagctggtgcggcgcatgcgcgctttgggaattgggcgcgagctcgccgcaggcgggcgcgcgagcccgggcgacccgctgatggaggatgtggcgcgacttcgccgagagatgcgggccgcggtggaaaggcgggatcgcgcgagggagctgtatctgcgcgggcacctggaccgaaccgcggctctgcgcgcgatgtcggaggaggcccggcgcctgcgcgaggggcgcgccgaggcgtgccgactgtgtcacgcgcggcaacgtcggttgaacgcgtgggaagacctgtggacggcgcttgaaacgcacgatggcgtggagctcaggcggttgtggctcgaggctgcggtgtcgcgcgtcgagatggacgcctcgggcggcgaggtggtgctgaccctcttcgcccggatcggcgaacaaacgggtgcccgcgtcgacgacacgttggcgacgtga

SEQ ID NO: 1922 - protein, 560 aa, Alicyclobacillus acidocaldarius
MFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYTEAQKTA

SEQ ID NO: 1923 - DNA, 1683 bp, Alicyclobacillus acidocaldarius
ttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1924 - protein, 542 aa, Bacillus coagulans; identical to SEQ ID NO: 1584

SEQ ID NO: 1925 - protein, 542 aa, Bacillus coagulans; identical to SEQ ID NO: 1585

SEQ ID NO: 1926 - protein, 542 aa, Bacillus coagulans; identical to SEQ ID NO: 1586

SEQ ID NO: 1927 - protein, 538 aa, Bacillus coagulans; identical to SEQ ID NO: 1587

SEQ ID NO: 1928 - protein, 349 aa, Moorella thermoacetica; identical to SEQ ID NO: 1588

SEQ ID NO: 1929 - protein, 560 aa, Artificial
  Alicyclobacillus acidocaldarius mutated SEQ ID NO 1922
MFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKEDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYTEAQKTA

SEQ ID NO: 1930 - protein, 560 aa, Artificial
  Alicyclobacillus acidocaldarius mutated SEQ ID NO 1922
MFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATIHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYTEAQKTA

SEQ ID NO: 1931 - protein, 560 aa, Artificial
  Alicyclobacillus acidocaldarius mutated SEQ ID NO 1922
MFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETKKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYTEAQKTA

SEQ ID NO: 1932 - protein, 560 aa, Artificial
  Alicyclobacillus acidocaldarius mutated SEQ ID NO 1922
MFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTNYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYTEAQKTA

SEQ ID NO: 1933 - protein, 560 aa, Artificial
  Alicyclobacillus acidocaldarius mutated SEQ ID NO 1922
MFGPVRSYVMGPAPVLARLIDELKWVEIIDEFVPRPDSKLSVGLRTKALLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQLMRVLKLLNMDLSIYTEAQKTA

SEQ ID NO: 1934 - DNA, 1683 bp, Artificial
  Alicyclobacillus acidocaldarius mutated SEQ ID NO 1923
ttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagaagacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1935 - DNA, 1683 bp, Artificial
  Alicyclobacillus acidocaldarius mutated SEQ ID NO 1923
ttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactattcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1936 - DNA, 1683 bp, Artificial
  Alicyclobacillus acidocaldarius mutated SEQ ID NO 1923
ttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgaaaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1937 - DNA, 1683 bp, Artificial
  Alicyclobacillus acidocaldarius mutated SEQ ID NO 1923
ttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacaaattaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacacggaagcgcaaaaaacggcttga

SEQ ID NO: 1938 - DNA, 1683 bp, Artificial
  Alicyclobacillus acidocaldarius mutated SEQ ID NO 1923
ttgttcggtccagttcgctcgtatgtcatggggcctgcgcccgttttagccagactgatcgacgagttgaagtgggtagagattatcgacgagttcgtgccacgtccggatagcaaactgtccgtcgggctgcgtaccaaggcgttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagttaatgagggttcttaagctgctgaacatggacctgagcatctacacggaagcgcaaaaaacggcttga

SEQ ID NO: 1939 - protein, 391 aa, Alicyclobacillus acidocaldarius
MTTGRVFSYTTKSNEKKYGYTITITPADPQTGRYPQVTRKGFKSERAAKSAMMEHLRSLEDTPVVHAKSFTLHEWASRWFADKSSSLRPWTRRTYHHVLQAYILPELGKMPISKIEARHIQALYRKLSNRLKPVTVHRIHRVLKTCLLAAVKAGYLDKSPFLNVEPPEHKTPPKPVLSVNDAFRLLAWLREHRPTSYMAAFLAIHTGMRMGEIAGLQWRDIDLDTGVIQLERTRYRPKGGQDFLGPPKTFGSRRRIVVTREVVDELRRWKQSQQEIERESWTPESFVVRLPNSAPPSPASFNNAIQNARKELGLPPVSFHGLRHTHATWLLESGVDLKIVSERLGHSSITITADIYAHVTDALQREAIEKLQRMMRSRRTNNSGSDDEEDL

SEQ ID NO: 1940 - DNA, 1176 bp, Alicyclobacillus acidocaldarius
gtgacaacgggccgagtattctcatacacaaccaagtcgaacgaaaaaaagtacggatatacgattaccattacgcccgcggacccacaaacaggaaggtaccctcaagtgactcgaaagggctttaagagcgaacgagctgcaaagtccgccatgatggagcatctgcgttcgctcgaagacactccagtcgtacatgccaaatcgttcactttacatgaatgggcaagtcgctggtttgccgataaatcgtcatccttgcggccgtggacgcgtcgaacttatcatcatgtcttgcaagcctacattctccccgaacttggtaagatgccgatctcaaaaattgaggcccgacatatccaagcactatatcgcaagctaagcaatcgattgaaaccagtgaccgtacatcgaatacaccgggtgctcaagacgtgcttacttgctgcggtgaaagcaggatacttggataagtctccgttcttgaacgtagaaccaccagaacataaaacgcctccgaagccagttttgtctgtgaacgacgcctttcggctcttagcgtggctacgagaacatcgaccaacgagctatatggcggcgttcttggccattcataccggcatgcgcatgggggagatcgctgggctgcaatggagagacatcgatttggacacgggcgtgatacaacttgaacgaactcgctacaggcccaagggtgggcaagactttttggggccgcccaagacatttggaagtcgtcgccgtattgtcgtcacgcgagaagtagtggacgaactcaggagatggaaacaatcgcaacaagaaatcgagcgcgaatcttggactcctgaatcctttgtcgttcgcctcccaaactccgcgcccccgtcacccgcttcctttaacaacgcgatccaaaacgcaagaaaagagcttgggttgccgcccgtttcctttcatggattgcgacatacccatgcgacgtggttgctagaaagcggggtcgatctcaaaattgtgagcgaacgtttggggcatagttcaattacgataacggcagacatatacgcgcatgtgacggatgcgctacaacgcgaagcgattgaaaaactgcaacgaatgatgcgttcaagacgcacaaacaacagtggctctgatgatgaagaggacttgtaa

SEQ ID NO: 1941 - protein, 365 aa, Bacillus anthracis
EKWSFTIDIGKDPITGKRKQKTASGFKTKKEAERACNELIHQFNTGSLVDDKNFTLSEYLQEWLENTAKQRVRETTFTNYKRAINSRIIPVLGSHKLKDLKPLHGQRFVKSLIDEGLSPAYIEYIFIVLKGSLEDAVRWELLFKNPFQHVEIPRPRKVVNSTWSIEETKKFLNRTKFENVIYYHLFLLALNTGMRRGEILGLKWKNFDLNEGKISVTETLIYDENGFRFTEPKTHGSKRLISIDQNLCKEFKSYKAKQNEFKLLFGQSYEDNDLVFAKETGQPILPRTMTTTFNQFIKKADVPQIRFHDLRHTHATILLKLGINPKIVSERLGHSSIKTTLDTYSHVTIDMQESAVLKLSEALKS

SEQ ID NO: 1942 - protein, 360 aa, Moorella thermoacetica
WTAQITVGIDHEGKQRRLTLYGKSKKEVLEKLTQALYQQQNGGFIEPSKITVEQWLNRWLTDYAKPHLRQSTWESYETVLRLHVIPTLGSIPLKKLQPADIQRLYASKLESGLSPTRVRYIHVVLHEAMSQARESGLLLQNPTEAAKPPRHPKKKVQPLNPEQVKRFLETAKQDPLYPAFLLALGTGLRRGEILGLRWQDLDLQKGILQVRQSLIRTREGLKFEEPKTEKSRRQIPLPPSVVAALKRHKAWVNQNKLILGPDYEDHDLVFPVENGRPRDPKGFAEYFNRLLDKAGLPHIRLHDLRHTHATLLLLEGVHPKVVQERLGHSTVSITLDIYSHILPGLQEKAAERIDGLLQPK

SEQ ID NO: 1943 - protein, 370 aa, Bacillus cereus
TVKKDDKTKTWYFVLTHGKKEDGKPRQFKKRGFKTKQEALKALHELEHSLMTGTYIAPTKMLYGEYLLNQWLEDKQTKVKKQTLQTYRWLVEKHIIPAIGNMELTQLTPMAIQKLYNQLTKEKALSDENIQKVHTLINDSLKKAERWGIISKNPASLVDRPKAEKKEIKVWDVKEVQTFLKHAQSHSRYYIAFLLALTTGMRQGEILGLRWRDVDFETGCIRITQTLSSDGKEILPYTKTKSGSRTVDLPEETIIQLKKHRKLIESEKLEAGSEVYNNWDLVVCTELGTPTNKSNIRRSFNSIIKKAKIPKIRFHDMRHTHATLLLLQGVNPKIVSERLGHADVRITLDTYSHLLPSMQKDTAIKFGEML

SEQ ID NO: 1944 - protein, 361 aa, Thermoanaerobacter pseudethanolicus
YSIVVDIGRDENGKRKQKWISGFKTKKEAEKALAEIIAKIEKNELELTNLTLGQFLNKWYETHCELKLAPKTLKSYKELIELYFKPYLGDIELTKLKPVMIQNYYNKLKELGLSDTTINYHHRVLKSALKKAVVWQLISKNPCDYVEPPKKNKNEITVWSINDVKKAKEIFKDTPIYLHFMLALYTGMRIGEICGLKWEDIDFNNKTCTVKRQYQQVGGKEIIKEPKSETSIRVIPLHSDVIEVLKEEKKKQLQNRMLLGEKYNKKYEGYISVWEDGRMKTPEYVSKKFSKILKAYPELPQIRFHDLRHSCASFLVQAGVPMKVVSEILGHSQIGITMDLYSHVLLDSKKEAIKKLEEYLQ

SEQ ID NO: 1945 - protein, 360 aa, Alkaliphilus oremlandii
KKNHKWYIVVDSIDENGKRKRKWISGFNTQKEAEKKLPEILQQLNTNTFVDTNNITLRDYMQLWLEDYAKPNVAPTTYDKYTYAANKVSEILGNMKLQQIKPIHIQQLVNKLNNSDVTPSTVLSYYRVLNTAINQAVKWQFIQYNPCVAVTPPRNTKNKMMILDQDEIQILLDKSKDHVLYPVIVLALLCGLRRGEILGLQWENIDFFSGVIHLENNLVMANNESILKETKTSTGRRAVDISSNVVEVLKKVKKQKMSYKLLYGSSYHDSNFVCTWEDGRPFRPDYIPKAFAKILVSANLPKIRFHDLRHTHASILLKSGIHPKVVQERLGHSSISITLDTYSHLVPSLQKSAAEKMATM

SEQ ID NO: 1946 - protein, 391 aa, Artificial
  Alicyclobacillus acidocaldarius mutated SEQ ID NO 1939
MTTGRVFSYTTKSNEKKYGYTITITPADPQTGRYPQVTRKGFKSERAAKSAMMEHLRSLEDTPVVHAKSFTLHEWASRWFADKSSSLRPWTRRTYHHVLQAYILPELGKMPISKIEARHIQALYRKISNRLKPVTVHRIHRVLKTCLLAAVKAGYLDKSPFLNVEPPEHKTPPKPVLSVNDAFRLLAWLREHRPTSYMAAFLAIHTGMRMGEIAGLQWRDIDLDTGVIQLERTRYRPKGGQDFLGPPKTFGSRRRIVVTREVVDELRRWKQSQQEIERESWTPESFVVRLPNSAPPSPASFNNAIQNARKELGLPPVSFHGLRHTHATWLLESGVDLKIVSERLGHSSITITADIYAHVTDALQREAIEKLQRMMRSRRTNNSGSDDEEDL

SEQ ID NO: 1947 - protein, 391 aa, Artificial
  Alicyclobacillus acidocaldarius mutated SEQ ID NO 1939
MTTGRVFSYTTKSNEKKYGYTITITPADPQTGRYPQVTRKGFKSERAAKSAMMEHLRSLEDTPVVHAKSFTLHEWASRWFADKSSSLRPWTRRTYHHVLQAYILPELGKMPISKIEARHIQALYRKLSNRLKPVTVHRIHRVLKTCLLAAVKAGYLDKSPFLNVEPPEHKTPPKPVLSVNDAFRLLAWLREHRPTSYMAAFLAIHTGMRMGEIAGLQWRDIDLDTGVIQLERTRYRPKGGQDFLGPPKTFGSRRRIVVTREVVDELRRWKQSQQEIERESWTPESFVVRLPNSAPPSPASFNNAIQNARKELGLPPVSFHGLRHTHATWLLESGVDLKIVSERLGHSSITITADIYAHVTEALQREAIEKLQRMMRSRRTNNSGSDDEEDL

SEQ ID NO: 1948 - protein, 391 aa, Artificial
  Alicyclobacillus acidocaldarius mutated SEQ ID NO 1939
MTTGRVFSYTTKSNEKKYGYTITITPADPQTGRYPQVTRKGFKSERAAKSAMMEHLRSLEDTPVVHAKSFTLHEWASRWFADKSSSLRPWTRRTYHHVLQAYILPELGKMPISKIEARHIQALYRKLSNRLKPVTVHRIHRVLKTCLLAAVKAGYLDKSPFLNVEPPEHKTPPKPVLSVNDAFRLLAWLREHRPTSYMAAFLAIHTGMRMGEIAGLQWRDIDLDTGVIQLERTRYRPKGGQDFLGPPKTFGSRRRIVVTREVVDELRRWKQSQQEIERESWTPESFVVRLPNSAPPSPASFNNAIQNARKELGLPPVSFHGLRHTHATWLLESGVDLKIVSERLGHSSITITADIYAHVTDALQREAIEKLQRMMRSRRTNNSGSDDEEEL

SEQ ID NO: 1949 - protein, 391 aa, Artificial
  Alicyclobacillus acidocaldarius mutated SEQ ID NO 1939
MTTGRVFSYTTKSNEKKYGYTITITPADPQTGRYPQVTRKGFKSERAAKSAMMEHLRSLEDTPVVHAKSFTLHEWASRWFADKSSSLRPWTRRTYHHVLQAYILPELGKMPISKIEARHIQALYRKLSNRLKPVTVHRIHRVLKTCLLAAVKAGYLDKSPFLNVEPPEHKTPPKPVLSVNDAFRLLAWLREHRPTSYMAAFLAIHTGMRMGEIAGLQWRDIDLDTGVIQLERTRYRPKGGQDFLGPPKTFGSRRRIVVTREVVEELRRWKQSQQEIERESWTPESFVVRLPNSAPPSPASFNNAIQNARKELGLPPVSFHGLRHTHATWLLESGVDLKIVSERLGHSSITITADIYAHVTDALQREAIEKLQRMMRSRRTNNSGSDDEEDL

SEQ ID NO: 1950 - protein, 391 aa, Artificial
  Alicyclobacillus acidocaldarius mutated SEQ ID NO 1939
MTTGRVFSYTTKSNEKKYGYTITITPADPQTGRYPQVTRKGFKSERAAKSAMMEHLRSLEDTPVVHAKSFTLHEWASRWFADKSSSLRPWTRRTYHHVIQAYILPELGKMPISKIEARHIQALYRKLSNRLKPVTVHRIHRVLKTCLLAAVKAGYLDKSPFLNVEPPEHKTPPKPVLSVNDAFRLLAWLREHRPTSYMAAFLAIHTGMRMGEIAGLQWRDIDLDTGVIQLERTRYRPKGGQDFLGPPKTFGSRRRIVVTREVVDELRRWKQSQQEIERESWTPESFVVRLPNSAPPSPASFNNAIQNARKELGLPPVSFHGLRHTHATWLLESGVDLKIVSERLGHSSITITADIYAHVTDALQREAIEKLQRMMRSRRTNNSGSDDEEDL

SEQ ID NO: 1951 - DNA, 1176 bp, Artificial
  Alicyclobacillus acidocaldarius mutated SEQ ID NO 1940
gtgacaacgggccgagtattctcatacacaaccaagtcgaacgaaaaaaagtacggatatacgattaccattacgcccgcggacccacaaacaggaaggtaccctcaagtgactcgaaagggctttaagagcgaacgagctgcaaagtccgccatgatggagcatctgcgttcgctcgaagacactccagtcgtacatgccaaatcgttcactttacatgaatgggcaagtcgctggtttgccgataaatcgtcatccttgcggccgtggacgcgtcgaacttatcatcatgtcttgcaagcctacattctccccgaacttggtaagatgccgatctcaaaaattgaggcccgacatatccaagcactatatcgcaagattagcaatcgattgaaaccagtgaccgtacatcgaatacaccgggtgctcaagacgtgcttacttgctgcggtgaaagcaggatacttggataagtctccgttcttgaacgtagaaccaccagaacataaaacgcctccgaagccagttttgtctgtgaacgacgcctttcggctcttagcgtggctacgagaacatcgaccaacgagctatatggcggcgttcttggccattcataccggcatgcgcatgggggagatcgctgggctgcaatggagagacatcgatttggacacgggcgtgatacaacttgaacgaactcgctacaggcccaagggtgggcaagactttttggggccgcccaagacatttggaagtcgtcgccgtattgtcgtcacgcgagaagtagtggacgaactcaggagatggaaacaatcgcaacaagaaatcgagcgcgaatcttggactcctgaatcctttgtcgttcgcctcccaaactccgcgcccccgtcacccgcttcctttaacaacgcgatccaaaacgcaagaaaagagcttgggttgccgcccgtttcctttcatggattgcgacatacccatgcgacgtggttgctagaaagcggggtcgatctcaaaattgtgagcgaacgtttggggcatagttcaattacgataacggcagacatatacgcgcatgtgacggatgcgctacaacgcgaagcgattgaaaaactgcaacgaatgatgcgttcaagacgcacaaacaacagtggctctgatgatgaagaggacttgtaa

SEQ ID NO: 1952 - DNA, 1176 bp, Artificial
  Alicyclobacillus acidocaldarius mutated SEQ ID NO 1940
gtgacaacgggccgagtattctcatacacaaccaagtcgaacgaaaaaaagtacggatatacgattaccattacgcccgcggacccacaaacaggaaggtaccctcaagtgactcgaaagggctttaagagcgaacgagctgcaaagtccgccatgatggagcatctgcgttcgctcgaagacactccagtcgtacatgccaaatcgttcactttacatgaatgggcaagtcgctggtttgccgataaatcgtcatccttgcggccgtggacgcgtcgaacttatcatcatgtcttgcaagcctacattctccccgaacttggtaagatgccgatctcaaaaattgaggcccgacatatccaagcactatatcgcaagctaagcaatcgattgaaaccagtgaccgtacatcgaatacaccgggtgctcaagacgtgcttacttgctgcggtgaaagcaggatacttggataagtctccgttcttgaacgtagaaccaccagaacataaaacgcctccgaagccagttttgtctgtgaacgacgcctttcggctcttagcgtggctacgagaacatcgaccaacgagctatatggcggcgttcttggccattcataccggcatgcgcatgggggagatcgctgggctgcaatggagagacatcgatttggacacgggcgtgatacaacttgaacgaactcgctacaggcccaagggtgggcaagactttttggggccgcccaagacatttggaagtcgtcgccgtattgtcgtcacgcgagaagtagtggacgaactcaggagatggaaacaatcgcaacaagaaatcgagcgcgaatcttggactcctgaatcctttgtcgttcgcctcccaaactccgcgcccccgtcacccgcttcctttaacaacgcgatccaaaacgcaagaaaagagcttgggttgccgcccgtttcctttcatggattgcgacatacccatgcgacgtggttgctagaaagcggggtcgatctcaaaattgtgagcgaacgtttggggcatagttcaattacgataacggcagacatatacgcgcatgtgacggaagcgctacaacgcgaagcgattgaaaaactgcaacgaatgatgcgttcaagacgcacaaacaacagtggctctgatgatgaagaggacttgtaa

SEQ ID NO: 1953 - DNA, 1176 bp, Artificial
  Alicyclobacillus acidocaldarius mutated SEQ ID NO 1940
gtgacaacgggccgagtattctcatacacaaccaagtcgaacgaaaaaaagtacggatatacgattaccattacgcccgcggacccacaaacaggaaggtaccctcaagtgactcgaaagggctttaagagcgaacgagctgcaaagtccgccatgatggagcatctgcgttcgctcgaagacactccagtcgtacatgccaaatcgttcactttacatgaatgggcaagtcgctggtttgccgataaatcgtcatccttgcggccgtggacgcgtcgaacttatcatcatgtcttgcaagcctacattctccccgaacttggtaagatgccgatctcaaaaattgaggcccgacatatccaagcactatatcgcaagctaagcaatcgattgaaaccagtgaccgtacatcgaatacaccgggtgctcaagacgtgcttacttgctgcggtgaaagcaggatacttggataagtctccgttcttgaacgtagaaccaccagaacataaaacgcctccgaagccagttttgtctgtgaacgacgcctttcggctcttagcgtggctacgagaacatcgaccaacgagctatatggcggcgttcttggccattcataccggcatgcgcatgggggagatcgctgggctgcaatggagagacatcgatttggacacgggcgtgatacaacttgaacgaactcgctacaggcccaagggtgggcaagactttttggggccgcccaagacatttggaagtcgtcgccgtattgtcgtcacgcgagaagtagtggacgaactcaggagatggaaacaatcgcaacaagaaatcgagcgcgaatcttggactcctgaatcctttgtcgttcgcctcccaaactccgcgcccccgtcacccgcttcctttaacaacgcgatccaaaacgcaagaaaagagcttgggttgccgcccgtttcctttcatggattgcgacatacccatgcgacgtggttgctagaaagcggggtcgatctcaaaattgtgagcgaacgtttggggcatagttcaattacgataacggcagacatatacgcgcatgtgacggatgcgctacaacgcgaagcgattgaaaaactgcaacgaatgatgcgttcaagacgcacaaacaacagtggctctgatgatgaagaggaattgtaa

SEQ ID NO: 1954 - DNA, 1176 bp, Artificial
  Alicyclobacillus acidocaldarius mutated SEQ ID NO 1940
gtgacaacgggccgagtattctcatacacaaccaagtcgaacgaaaaaaagtacggatatacgattaccattacgcccgcggacccacaaacaggaaggtaccctcaagtgactcgaaagggctttaagagcgaacgagctgcaaagtccgccatgatggagcatctgcgttcgctcgaagacactccagtcgtacatgccaaatcgttcactttacatgaatgggcaagtcgctggtttgccgataaatcgtcatccttgcggccgtggacgcgtcgaacttatcatcatgtcttgcaagcctacattctccccgaacttggtaagatgccgatctcaaaaattgaggcccgacatatccaagcactatatcgcaagctaagcaatcgattgaaaccagtgaccgtacatcgaatacaccgggtgctcaagacgtgcttacttgctgcggtgaaagcaggatacttggataagtctccgttcttgaacgtagaaccaccagaacataaaacgcctccgaagccagttttgtctgtgaacgacgcctttcggctcttagcgtggctacgagaacatcgaccaacgagctatatggcggcgttcttggccattcataccggcatgcgcatgggggagatcgctgggctgcaatggagagacatcgatttggacacgggcgtgatacaacttgaacgaactcgctacaggcccaagggtgggcaagactttttggggccgcccaagacatttggaagtcgtcgccgtattgtcgtcacgcgagaagtagtggaagaactcaggagatggaaacaatcgcaacaagaaatcgagcgcgaatcttggactcctgaatcctttgtcgttcgcctcccaaactccgcgcccccgtcacccgcttcctttaacaacgcgatccaaaacgcaagaaaagagcttgggttgccgcccgtttcctttcatggattgcgacatacccatgcgacgtggttgctagaaagcggggtcgatctcaaaattgtgagcgaacgtttggggcatagttcaattacgataacggcagacatatacgcgcatgtgacggatgcgctacaacgcgaagcgattgaaaaactgcaacgaatgatgcgttcaagacgcacaaacaacagtggctctgatgatgaagaggacttgtaa

SEQ ID NO: 1955 - DNA, 1176 bp, Artificial
  Alicyclobacillus acidocaldarius mutated SEQ ID NO 1940
gtgacaacgggccgagtattctcatacacaaccaagtcgaacgaaaaaaagtacggatatacgattaccattacgcccgcggacccacaaacaggaaggtaccctcaagtgactcgaaagggctttaagagcgaacgagctgcaaagtccgccatgatggagcatctgcgttcgctcgaagacactccagtcgtacatgccaaatcgttcactttacatgaatgggcaagtcgctggtttgccgataaatcgtcatccttgcggccgtggacgcgtcgaacttatcatcatgtcattcaagcctacattctccccgaacttggtaagatgccgatctcaaaaattgaggcccgacatatccaagcactatatcgcaagctaagcaatcgattgaaaccagtgaccgtacatcgaatacaccgggtgctcaagacgtgcttacttgctgcggtgaaagcaggatacttggataagtctccgttcttgaacgtagaaccaccagaacataaaacgcctccgaagccagttttgtctgtgaacgacgcctttcggctcttagcgtggctacgagaacatcgaccaacgagctatatggcggcgttcttggccattcataccggcatgcgcatgggggagatcgctgggctgcaatggagagacatcgatttggacacgggcgtgatacaacttgaacgaactcgctacaggcccaagggtgggcaagactttttggggccgcccaagacatttggaagtcgtcgccgtattgtcgtcacgcgagaagtagtggacgaactcaggagatggaaacaatcgcaacaagaaatcgagcgcgaatcttggactcctgaatcctttgtcgttcgcctcccaaactccgcgcccccgtcacccgcttcctttaacaacgcgatccaaaacgcaagaaaagagcttgggttgccgcccgtttcctttcatggattgcgacatacccatgcgacgtggttgctagaaagcggggtcgatctcaaaattgtgagcgaacgtttggggcatagttcaattacgataacggcagacatatacgcgcatgtgacggatgcgctacaacgcgaagcgattgaaaaactgcaacgaatgatgcgttcaagacgcacaaacaacagtggctctgatgatgaagaggacttgtaa

SEQ ID NO: 1956 - protein, 251 aa, Alicyclobacillus acidocaldarius
MSRTYKGHDGYAPIFAYLGQEGYVVNVQLREGSTHVQKGTSTFLRESIQYARQVTELPLLVRLDAGNDSAENIAVCRSQDSRAEFIIKRNLRKESPAAWLEIAQRHGTCHEPRPGKKVYHGSLMCPVKGVSEPVRMVFEVIERTTTADGQILLVPDIEVSAYWTSLPDDPAVIIRLYHDHAVMEQFHSEIKTDLDAERLPSGKFATNNLVLHFVCVAYNLLRVIGQESLKRNDAPLRKKAERRRIRTVIRT

SEQ ID NO: 1957 - DNA, 756 bp, Alicyclobacillus acidocaldarius
gtgtcccgtacatacaagggtcacgacggatatgcccccatctttgcttaccttggccaagagggctacgtggtcaatgtccagctgcgtgaaggcagtacccacgtacaaaagggcacgtcgactttcctgcgggagagtattcagtatgcaaggcaggtgacggagctcccgcttctggttcgtctggatgccggcaatgacagtgcagaaaacatcgccgtgtgtcgctcccaggacagcagggccgagttcatcatcaagcgcaacttgcgaaaggagagccccgcggcctggcttgagattgcccagcgacacgggacatgtcatgaacctcgtcccggcaagaaggtatatcacggttcgctgatgtgtcccgtcaagggtgtatccgaaccggttcgcatggtgttcgaagttatcgaacggaccacgacggccgacggccaaatcttattggtaccggacattgaggtcagcgcctactggacctcactgccggatgacccggctgtgatcattcgcctgtatcacgaccacgccgtgatggaacagttccacagcgaaatcaagacggatctggacgccgagcggctgccctcgggcaaattcgccacgaacaacttggtattgcactttgtatgcgtggcgtacaatctgctgcgagtgatcggccaggagagtctgaagcgaaatgatgcgccgctacgaaaaaaggcagaacgtcgccggatccggactgtgatcagaacctga

SEQ ID NO: 1958 - protein, 251 aa, Desulfotomaculum reducens
VSRTYKGTDGYAPIFAYLAKEGYCVNTELRQGSEHCQKNTSEFVAESIRYARKITQLPLLLRMDSGNDSASNIEICLNDDTKADFIIKRNLRKETPEGWLLLAKNNKDIYCQEREGKKVYYGSMMKYKKELKREIRVVYKITERTFGKDGQIFLVPQVEAETYWTSLPDPPHVIERLYHEHGTSEQFHSELKTDLDLERLPSGKFDTNNLILHFGVVAYNLLRMIGQSTTRMQHVPLRKQAERRRIRTVIQ

SEQ ID NO: 1959 - protein, 251 aa, Desulfotomaculum reducens; identical to SEQ ID NO: 1958

SEQ ID NO: 1960 - protein, 251 aa, Desulfotomaculum reducens; identical to SEQ ID NO: 1958

SEQ ID NO: 1961 - protein, 251 aa, Desulfotomaculum reducens; identical to SEQ ID NO: 1958

SEQ ID NO: 1962 - protein, 251 aa, Desulfotomaculum reducens; identical to SEQ ID NO: 1958

SEQ ID NO: 1963 - protein, 251 aa, Artificial
  Alicyclobacillus acidocaldarius mutated SEQ ID NO 1956
MSRTYKGHDGYAPIFAYLGQEGYVVNVQLREGSTHVQKGTSTFLRESIQYARQVTELPLLVRLDAGNDSAENIAVCRSQDSRAEFIIKRNLRKESPAAWLEIAQRHGTCHEPRPGKKVYHGSLMCPVKGVSEPVRMVFEVIERTTTADGQILLVPDIEVSAYWTSLPDDPAVIIRLYHDHAVMEQFHSEIKTDLDAERLPSGKFATNNLVLHFICVAYNLLRVIGQESLKRNDAPLRKKAERRRIRTVIRT

SEQ ID NO: 1964 - protein, 251 aa, Artificial
  Alicyclobacillus acidocaldarius mutated SEQ ID NO 1956
MSRTYKGHDGYAPIFAYLGQEGYVVNVQLREGSTHVQKGTSTFLRESIQYARQVTELPLLVRLDAGNDSAENIAVCRSQDSRAEFIIKRNLRKESPAAWLEIAQRHGTCHEPRPGKKVYHGSLMCPVKGVSEPVRMVFEVLERTTTADGQILLVPDIEVSAYWTSLPDDPAVIIRLYHDHAVMEQFHSEIKTDLDAERLPSGKFATNNLVLHFVCVAYNLLRVIGQESLKRNDAPLRKKAERRRIRTVIRT

SEQ ID NO: 1965 - protein, 251 aa, Artificial
  Alicyclobacillus acidocaldarius mutated SEQ ID NO 1956
MSRTYKGHDGYAPIFAYLGQEGYVVNVQLREGSTHVQKGTSTFLRESIQYARQVTELPLLVRLDAGNDSAENIAVCRSQDSRAEFIIKRNLRKESPAAWLEIAQRHGTCHEPRPGKKVYHGSLMCPVKGVSEPVRMVFEVIERTTTADGQILLVPDIEVSAYWTSLPDEPAVIIRLYHDHAVMEQFHSEIKTDLDAERLPSGKFATNNLVLHFVCVAYNLLRVIGQESLKRNDAPLRKKAERRRIRTVIRT

SEQ ID NO: 1966 - protein, 251 aa, Artificial
  Alicyclobacillus acidocaldarius mutated SEQ ID NO 1956
MSRTYKGHDGYAPIFAYLGQEGYIVNVQLREGSTHVQKGTSTFLRESIQYARQVTELPLLVRLDAGNDSAENIAVCRSQDSRAEFIIKRNLRKESPAAWLEIAQRHGTCHEPRPGKKVYHGSLMCPVKGVSEPVRMVFEVIERTTTADGQILLVPDIEVSAYWTSLPDDPAVIIRLYHDHAVMEQFHSEIKTDLDAERLPSGKFATNNLVLHFVCVAYNLLRVIGQESLKRNDAPLRKKAERRRIRTVIRT

SEQ ID NO: 1967 - protein, 251 aa, Artificial
  Alicyclobacillus acidocaldarius mutated SEQ ID NO 1956
MSRTYKGHDGYAPIFAYLGQEGYVVNVQLREGSTHVQKGTSTFLRESIQYARQVTELPLLVRLDAGNDSAENIAVCRSQDSRAEFIIKRNLRKESPAAWLEIAQRHGTCHEPRPGKKVYHGSLMCPVKGVSEPVRMVFEVIERTTTADGQILLVPDIEVSAYWTSLPDDPAVIIRLYHDHAVMEQFHSEIKTDLDAERLPSGKFATNNLVLHFVCVAYNLLRVIGQESLKKNDAPLRKKAERRRIRTVIRT

SEQ ID NO: 1968 - DNA, 756 bp, Artificial
  Alicyclobacillus acidocaldarius mutated SEQ ID NO 1957
gtgtcccgtacatacaagggtcacgacggatatgcccccatctttgcttaccttggccaagagggctacgtggtcaatgtccagctgcgtgaaggcagtacccacgtacaaaagggcacgtcgactttcctgcgggagagtattcagtatgcaaggcaggtgacggagctcccgcttctggttcgtctggatgccggcaatgacagtgcagaaaacatcgccgtgtgtcgctcccaggacagcagggccgagttcatcatcaagcgcaacttgcgaaaggagagccccgcggcctggcttgagattgcccagcgacacgggacatgtcatgaacctcgtcccggcaagaaggtatatcacggttcgctgatgtgtcccgtcaagggtgtatccgaaccggttcgcatggtgttcgaagttatcgaacggaccacgacggccgacggccaaatcttattggtaccggacattgaggtcagcgcctactggacctcactgccggatgacccggctgtgatcattcgcctgtatcacgaccacgccgtgatggaacagttccacagcgaaatcaagacggatctggacgccgagcggctgccctcgggcaaattcgccacgaacaacttggtattgcactttatttgcgtggcgtacaatctgctgcgagtgatcggccaggagagtctgaagcgaaatgatgcgccgctacgaaaaaaggcagaacgtcgccggatccggactgtgatcagaacctga

SEQ ID NO: 1969 - DNA, 756 bp, Artificial
  Alicyclobacillus acidocaldarius mutated SEQ ID NO 1957
gtgtcccgtacatacaagggtcacgacggatatgcccccatctttgcttaccttggccaagagggctacgtggtcaatgtccagctgcgtgaaggcagtacccacgtacaaaagggcacgtcgactttcctgcgggagagtattcagtatgcaaggcaggtgacggagctcccgcttctggttcgtctggatgccggcaatgacagtgcagaaaacatcgccgtgtgtcgctcccaggacagcagggccgagttcatcatcaagcgcaacttgcgaaaggagagccccgcggcctggcttgagattgcccagcgacacgggacatgtcatgaacctcgtcccggcaagaaggtatatcacggttcgctgatgtgtcccgtcaagggtgtatccgaaccggttcgcatggtgttcgaagttttagaacggaccacgacggccgacggccaaatcttattggtaccggacattgaggtcagcgcctactggacctcactgccggatgacccggctgtgatcattcgcctgtatcacgaccacgccgtgatggaacagttccacagcgaaatcaagacggatctggacgccgagcggctgccctcgggcaaattcgccacgaacaacttggtattgcactttgtatgcgtggcgtacaatctgctgcgagtgatcggccaggagagtctgaagcgaaatgatgcgccgctacgaaaaaaggcagaacgtcgccggatccggactgtgatcagaacctga

SEQ ID NO: 1970 - DNA, 756 bp, Artificial
  Alicyclobacillus acidocaldarius mutated SEQ ID NO 1957
gtgtcccgtacatacaagggtcacgacggatatgcccccatctttgcttaccttggccaagagggctacgtggtcaatgtccagctgcgtgaaggcagtacccacgtacaaaagggcacgtcgactttcctgcgggagagtattcagtatgcaaggcaggtgacggagctcccgcttctggttcgtctggatgccggcaatgacagtgcagaaaacatcgccgtgtgtcgctcccaggacagcagggccgagttcatcatcaagcgcaacttgcgaaaggagagccccgcggcctggcttgagattgcccagcgacacgggacatgtcatgaacctcgtcccggcaagaaggtatatcacggttcgctgatgtgtcccgtcaagggtgtatccgaaccggttcgcatggtgttcgaagttatcgaacggaccacgacggccgacggccaaatcttattggtaccggacattgaggtcagcgcctactggacctcactgccggatgaaccggctgtgatcattcgcctgtatcacgaccacgccgtgatggaacagttccacagcgaaatcaagacggatctggacgccgagcggctgccctcgggcaaattcgccacgaacaacttggtattgcactttgtatgcgtggcgtacaatctgctgcgagtgatcggccaggagagtctgaagcgaaatgatgcgccgctacgaaaaaaggcagaacgtcgccggatccggactgtgatcagaacctga

SEQ ID NO: 1971 - DNA, 756 bp, Artificial
  Alicyclobacillus acidocaldarius mutated SEQ ID NO 1957
gtgtcccgtacatacaagggtcacgacggatatgcccccatctttgcttaccttggccaagagggctacattgtcaatgtccagctgcgtgaaggcagtacccacgtacaaaagggcacgtcgactttcctgcgggagagtattcagtatgcaaggcaggtgacggagctcccgcttctggttcgtctggatgccggcaatgacagtgcagaaaacatcgccgtgtgtcgctcccaggacagcagggccgagttcatcatcaagcgcaacttgcgaaaggagagccccgcggcctggcttgagattgcccagcgacacgggacatgtcatgaacctcgtcccggcaagaaggtatatcacggttcgctgatgtgtcccgtcaagggtgtatccgaaccggttcgcatggtgttcgaagttatcgaacggaccacgacggccgacggccaaatcttattggtaccggacattgaggtcagcgcctactggacctcactgccggatgacccggctgtgatcattcgcctgtatcacgaccacgccgtgatggaacagttccacagcgaaatcaagacggatctggacgccgagcggctgccctcgggcaaattcgccacgaacaacttggtattgcactttgtatgcgtggcgtacaatctgctgcgagtgatcggccaggagagtctgaagcgaaatgatgcgccgctacgaaaaaaggcagaacgtcgccggatccggactgtgatcagaacctga

SEQ ID NO: 1972 - DNA, 756 bp, Artificial
  Alicyclobacillus acidocaldarius mutated SEQ ID NO 1957
gtgtcccgtacatacaagggtcacgacggatatgcccccatctttgcttaccttggccaagagggctacgtggtcaatgtccagctgcgtgaaggcagtacccacgtacaaaagggcacgtcgactttcctgcgggagagtattcagtatgcaaggcaggtgacggagctcccgcttctggttcgtctggatgccggcaatgacagtgcagaaaacatcgccgtgtgtcgctcccaggacagcagggccgagttcatcatcaagcgcaacttgcgaaaggagagccccgcggcctggcttgagattgcccagcgacacgggacatgtcatgaacctcgtcccggcaagaaggtatatcacggttcgctgatgtgtcccgtcaagggtgtatccgaaccggttcgcatggtgttcgaagttatcgaacggaccacgacggccgacggccaaatcttattggtaccggacattgaggtcagcgcctactggacctcactgccggatgacccggctgtgatcattcgcctgtatcacgaccacgccgtgatggaacagttccacagcgaaatcaagacggatctggacgccgagcggctgccctcgggcaaattcgccacgaacaacttggtattgcactttgtatgcgtggcgtacaatctgctgcgagtgatcggccaggagagtctgaagaaaaatgatgcgccgctacgaaaaaaggcagaacgtcgccggatccggactgtgatcagaacctga

SEQ ID NO: 1973 - protein, 139 aa, Alicyclobacillus acidocaldarius
MRFIIEESDEVIVTHSGMTLVGVLLDKTRIGERLNHTRLPGMGKPNISNRDVAYSYIGLLCQGKTDFDHIEAFRDDEFFTIALQVDNVPSSPTLRQRLDMVAGKSGWESILREESARLLRALDVTLHPIELGEPAERRT

SEQ ID NO: 1974 - DNA, 420 bp, Alicyclobacillus acidocaldarius
ttgcgtttcatcattgaagaatccgatgaagtcatcgtcacgcattcgggaatgacccttgtcggcgtgttgcttgataaaaccagaatcggcgagcggttgaatcatacccgcctgcctggtatgggcaaaccgaatatttcaaaccgggacgtggcatactcatacatcgggctgctttgccaaggcaagaccgacttcgaccacatcgaagcgtttcgagatgacgagtttttcacgatcgcactgcaagtagacaacgtgccttcgagcccgacgctgcgccagcgtttggacatggttgccggaaaatccggctgggagtccattctccgggaagagtccgcaaggctcctgagagccctcgatgtaactctgcatccgattgaactgggcgagcctgcagagcgtcgaacttaa

SEQ ID NO: 1975 - protein, 131 aa, Desulfotomaculum reducens
FEIEQGDEELTTHSGLALIGALLTNTKIKTRLNNTMSAEQKKPHISNGSVGIAYIGLLCQGKSDFDHIEPFREDNFFAISLNIKETPSSPTLRQRLDMVAKDKQWNNILLEESAGLIKKTNAPLTPVYLGQ

SEQ ID NO: 1976 - protein, 135 aa, Desulfotomaculum reducens
FEIEQGDKELTTHSGLALIGALLTNTKIKTRLNNTMSAEQKKPHISNGSVGIAYIGLLCQGKSDFDHIEPFREDNFFAISLNIKETPSSPTLRQRLDMVAKDKQWNNILLEESAGLIKKTNAPLTPVYLGLENRT

SEQ ID NO: 1977 - protein, 105 aa, Desulfotomaculum reducens
FEIEQGDEELTTHSGLALIGALLTNTKIKTRLNNTMSAEQKKPHISNGSVGIAYIGLLCQGKSDFDHIEPFREDNFFAISLNIKETPSSPTLRQRLDMVAKDKQW

SEQ ID NO: 1978 - protein, 105 aa, Desulfotomaculum reducens; identical to SEQ ID NO: 1977

SEQ ID NO: 1979 - protein, 108 aa, Bacillus halodurans
VKFILENSDDTLTTHSGLGLIGLLLSKTKFHKRFSSLKVPEIKSSPKILNGDVTTSYVGLLCQGKNDFDHIEQFRDDPFFYRALDIKLVPSSPTLRQRLDQIAKVTGW

SEQ ID NO: 1980 - protein, 139 aa, Artificial
  Alicyclobacillus acidocaldarius mutated SEQ ID NO 1973
MRFIIEESDEVIVTHSGMTLVGVLLDKTRIGERLNHTRLPGMGKPNISNRDVAYSYIGLLCQGKTDFDHIEAFRDDEFFTIALQVDNVPSSPTLRQRLDMVAGKSGWESILRDESARLLRALDVTLHPIELGEPAERRT

SEQ ID NO: 1981 - protein, 139 aa, Artificial
  Alicyclobacillus acidocaldarius mutated SEQ ID NO 1973
MRFIIEESDEVIVTHSGMTLVGVLLDKTRIGERLNHTRLPGMGKPNISNRDVAYSYIGLLCQGKTDFDHIEAFRDDEFFTIALQVDNVPSSPTLRQRLDMVAGKSGWESILREESARLLRAIDVTLHPIELGEPAERRT

SEQ ID NO: 1982 - protein, 139 aa, Artificial
  Alicyclobacillus acidocaldarius mutated SEQ ID NO 1973
MRFIIEESDEVIVTHSGMTLVGVLLDKTRIGERLNHTRLPGMGKPNISNRDVAYSYIGLLCQGKTDFDHIEAFRDDEFFTLALQVDNVPSSPTLRQRLDMVAGKSGWESILREESARLLRALDVTLHPIELGEPAERRT

SEQ ID NO: 1983 - protein, 139 aa, Artificial
  Alicyclobacillus acidocaldarius mutated SEQ ID NO 1973
MRFIIEESDEVIVTHSGMTLVGVLLEKTRIGERLNHTRLPGMGKPNISNRDVAYSYIGLLCQGKTDFDHIEAFRDDEFFTIALQVDNVPSSPTLRQRLDMVAGKSGWESILREESARLLRALDVTLHPIELGEPAERRT

SEQ ID NO: 1984 - protein, 139 aa, Artificial
  Alicyclobacillus acidocaldarius mutated SEQ ID NO 1973
MRFIIEESDEVIVTHSGMTLVGVLLDKTRIGERLNHTRLPGMGKPNISNRDVAYSYIGLLCQGKTDFDHIEAFRDDEFFTIALQVDNVPSSPTLRQRLDMVAGRSGWESILREESARLLRALDVTLHPIELGEPAERRT

SEQ ID NO: 1985 - DNA, 420 bp, Artificial
  Alicyclobacillus acidocaldarius mutated SEQ ID NO 1974
ttgcgtttcatcattgaagaatccgatgaagtcatcgtcacgcattcgggaatgacccttgtcggcgtgttgcttgataaaaccagaatcggcgagcggttgaatcatacccgcctgcctggtatgggcaaaccgaatatttcaaaccgggacgtggcatactcatacatcgggctgctttgccaaggcaagaccgacttcgaccacatcgaagcgtttcgagatgacgagtttttcacgatcgcactgcaagtagacaacgtgccttcgagcccgacgctgcgccagcgtttggacatggttgccggaaaatccggctgggagtccattctccgggatgagtccgcaaggctcctgagagccctcgatgtaactctgcatccgattgaactgggcgagcctgcagagcgtcgaacttaa

SEQ ID NO: 1986 - DNA, 420 bp, Artificial
  Alicyclobacillus acidocaldarius mutated SEQ ID NO 1974
ttgcgtttcatcattgaagaatccgatgaagtcatcgtcacgcattcgggaatgacccttgtcggcgtgttgcttgataaaaccagaatcggcgagcggttgaatcatacccgcctgcctggtatgggcaaaccgaatatttcaaaccgggacgtggcatactcatacatcgggctgctttgccaaggcaagaccgacttcgaccacatcgaagcgtttcgagatgacgagtttttcacgatcgcactgcaagtagacaacgtgccttcgagcccgacgctgcgccagcgtttggacatggttgccggaaaatccggctgggagtccattctccgggaagagtccgcaaggctcctgagagccattgatgtaactctgcatccgattgaactgggcgagcctgcagagcgtcgaacttaa

SEQ ID NO: 1987 - DNA, 420 bp, Artificial
  Alicyclobacillus acidocaldarius mutated SEQ ID NO 1974
ttgcgtttcatcattgaagaatccgatgaagtcatcgtcacgcattcgggaatgacccttgtcggcgtgttgcttgataaaaccagaatcggcgagcggttgaatcatacccgcctgcctggtatgggcaaaccgaatatttcaaaccgggacgtggcatactcatacatcgggctgctttgccaaggcaagaccgacttcgaccacatcgaagcgtttcgagatgacgagtttttcacgttagcactgcaagtagacaacgtgccttcgagcccgacgctgcgccagcgtttggacatggttgccggaaaatccggctgggagtccattctccgggaagagtccgcaaggctcctgagagccctcgatgtaactctgcatccgattgaactgggcgagcctgcagagcgtcgaacttaa

SEQ ID NO: 1988 - DNA, 420 bp, Artificial
  Alicyclobacillus acidocaldarius mutated SEQ ID NO 1974
ttgcgtttcatcattgaagaatccgatgaagtcatcgtcacgcattcgggaatgacccttgtcggcgtgttgcttgaaaaaaccagaatcggcgagcggttgaatcatacccgcctgcctggtatgggcaaaccgaatatttcaaaccgggacgtggcatactcatacatcgggctgctttgccaaggcaagaccgacttcgaccacatcgaagcgtttcgagatgacgagtttttcacgatcgcactgcaagtagacaacgtgccttcgagcccgacgctgcgccagcgtttggacatggttgccggaaaatccggctgggagtccattctccgggaagagtccgcaaggctcctgagagccctcgatgtaactctgcatccgattgaactgggcgagcctgcagagcgtcgaacttaa

SEQ ID NO: 1989 - DNA, 420 bp, Artificial
  Alicyclobacillus acidocaldarius mutated SEQ ID NO 1974
ttgcgtttcatcattgaagaatccgatgaagtcatcgtcacgcattcgggaatgacccttgtcggcgtgttgcttgataaaaccagaatcggcgagcggttgaatcatacccgcctgcctggtatgggcaaaccgaatatttcaaaccgggacgtggcatactcatacatcgggctgctttgccaaggcaagaccgacttcgaccacatcgaagcgtttcgagatgacgagtttttcacgatcgcactgcaagtagacaacgtgccttcgagcccgacgctgcgccagcgtttggacatggttgccggacgttccggctgggagtccattctccgggaagagtccgcaaggctcctgagagccctcgatgtaactctgcatccgattgaactgggcgagcctgcagagcgtcgaacttaa

SEQ ID NO: 1990 - protein, 110 aa, Alicyclobacillus acidocaldarius
MSYCLKQWPKLVRYMEDGHLEIDNNRCERSLKPFVIGRKNWLFANTPRGARASAIAYSIVETAKENGLNPFAYLEYLFEKLPNMDTDDKTAMAALLPWSETLPAHIRRRK

SEQ ID NO: 1991 - DNA, 333 bp, Alicyclobacillus acidocaldarius
gtgagctattgcctgaagcagtggccgaagctggtgcgctatatggaagacgggcatttggagatcgacaacaaccggtgcgagcggtcgctgaagccgtttgtgatcggacgaaagaactggctgttcgcgaacacgccgcgcggcgcgcgggcaagcgccattgcctatagcatcgtggagacggcgaaggaaaacggcctgaatccttttgcctacttggagtacctgttcgagaagctgccgaacatggacacggatgacaaaaccgccatggccgcgttgttgccatggtcagagacgctaccagctcatatcaggcgccgaaaataa

SEQ ID NO: 1992 - protein, 110 aa, Pelotomaculum thermopropionicum
IKYCLSQWDKLEAFLQDGRLELDNNRSERSIKPFVIGRKNWLFANTPRGARASAIVYSIVETAKENGLNPFHYLSYLFEKLPNLDTKDENALDKLLPWSDSLPSVCRVNK

SEQ ID NO: 1993 - protein, 103 aa, Moorella thermoacetica
INYCLGQWDKLTAFLQDGRLELDNNRSERSIKPFVIGRKNWLFANTPRGAKASAITYSIIETAKDNGLNPFQYLIYLFERLPNLDLKDKDALDQLLPWSASLP

SEQ ID NO: 1994 - protein, 107 aa, Syntrophomonas wolfei
ITYCLNQWDALNTFLLDGRLEIDNNRAERSIKPFVIGRKNFLFSNTPRGARGSAIIYSIIETAKENNLKPYDYLVYLFEQLPNVDTSDQTAVDRLMPWSDTLPEGCR

SEQ ID NO: 1995 - protein, 103 aa, Syntrophomonas wolfei
ITYCLNQWDCLNSFLLDGRLEIDNNRAERSIKPFVIGRKNWLFTNTPRGARGSAIIYSVIETAKENNLKPYNYMFYLFEQLPNVDTGDQAAIDRLLPWSDTLP

SEQ ID NO: 1996 - protein, 109 aa, Alkaliphilus metalliredigens
ISYSLKQWDKLAAFMKDGRIAIDNNLAERGIKPFVLGRKNYLFAKSPKGATASALCYSIIETAKANKLIPFQYLTYLFEQLPNLDIEDPEALDAMLPWAESLPNEVRHK

SEQ ID NO: 1997 - protein, 110 aa, Artificial
  Alicyclobacillus acidocaldarius mutated SEQ ID NO 1990
MSYCLRQWPKLVRYMEDGHLEIDNNRCERSLKPFVIGRKNWLFANTPRGARASAIAYSIVETAKENGLNPFAYLEYLFEKLPNMDTDDKTAMAALLPWSETLPAHIRRRK

SEQ ID NO: 1998 - protein, 110 aa, Artificial
  Alicyclobacillus acidocaldarius mutated SEQ ID NO 1990
MSYCLKQWPKLVKYMEDGHLEIDNNRCERSLKPFVIGRKNWLFANTPRGARASAIAYSIVETAKENGLNPFAYLEYLFEKLPNMDTDDKTAMAALLPWSETLPAHIRRRK

SEQ ID NO: 1999 - protein, 110 aa, Artificial
  Alicyclobacillus acidocaldarius mutated SEQ ID NO 1990
MSYCLKQWPKLIRYMEDGHLEIDNNRCERSLKPFVIGRKNWLFANTPRGARASAIAYSIVETAKENGLNPFAYLEYLFEKLPNMDTDDKTAMAALLPWSETLPAHIRRRK

SEQ ID NO: 2000 - protein, 110 aa, Artificial
  Alicyclobacillus acidocaldarius mutated SEQ ID NO 1990
MSYCLKQWPKLVRYMEDGHLEIDNNRCERSLKPFVIGRKNWLFANTPRGARASAIAYSIVETAKENGLNPFAYLEYLFEKLPNMDTDDRTAMAALLPWSETLPAHIRRRK

SEQ ID NO: 2001 - protein, 110 aa, Artificial
  Alicyclobacillus acidocaldarius mutated SEQ ID NO 1990
MSYCLKQWPKLVRYMEDGHLEIDNNRCERSLKPFVIGRKNWLFANTPRGARASAIAYSIVETAKENGLNPFAYLEYLFEKLPNMDTDDKTAMAALLPWSDTLPAHIRRRK

SEQ ID NO: 2002 - DNA, 333 bp, Artificial
  Alicyclobacillus acidocaldarius mutated SEQ ID NO 1991
gtgagctattgcctgcgtcagtggccgaagctggtgcgctatatggaagacgggcatttggagatcgacaacaaccggtgcgagcggtcgctgaagccgtttgtgatcggacgaaagaactggctgttcgcgaacacgccgcgcggcgcgcgggcaagcgccattgcctatagcatcgtggagacggcgaaggaaaacggcctgaatccttttgcctacttggagtacctgttcgagaagctgccgaacatggacacggatgacaaaaccgccatggccgcgttgttgccatggtcagagacgctaccagctcatatcaggcgccgaaaataa

SEQ ID NO: 2003 - DNA, 333 bp, Artificial
  Alicyclobacillus acidocaldarius mutated SEQ ID NO 1991
gtgagctattgcctgaagcagtggccgaagctggtgaaatatatggaagacgggcatttggagatcgacaacaaccggtgcgagcggtcgctgaagccgtttgtgatcggacgaaagaactggctgttcgcgaacacgccgcgcggcgcgcgggcaagcgccattgcctatagcatcgtggagacggcgaaggaaaacggcctgaatccttttgcctacttggagtacctgttcgagaagctgccgaacatggacacggatgacaaaaccgccatggccgcgttgttgccatggtcagagacgctaccagctcatatcaggcgccgaaaataa

SEQ ID NO: 2004 - DNA, 333 bp, Artificial
  Alicyclobacillus acidocaldarius mutated SEQ ID NO 1991
gtgagctattgcctgaagcagtggccgaagctgattcgctatatggaagacgggcatttggagatcgacaacaaccggtgcgagcggtcgctgaagccgtttgtgatcggacgaaagaactggctgttcgcgaacacgccgcgcggcgcgcgggcaagcgccattgcctatagcatcgtggagacggcgaaggaaaacggcctgaatccttttgcctacttggagtacctgttcgagaagctgccgaacatggacacggatgacaaaaccgccatggccgcgttgttgccatggtcagagacgctaccagctcatatcaggcgccgaaaataa

SEQ ID NO: 2005 - DNA, 333 bp, Artificial
  Alicyclobacillus acidocaldarius mutated SEQ ID NO 1991
gtgagctattgcctgaagcagtggccgaagctggtgcgctatatggaagacgggcatttggagatcgacaacaaccggtgcgagcggtcgctgaagccgtttgtgatcggacgaaagaactggctgttcgcgaacacgccgcgcggcgcgcgggcaagcgccattgcctatagcatcgtggagacggcgaaggaaaacggcctgaatccttttgcctacttggagtacctgttcgagaagctgccgaacatggacacggatgaccgtaccgccatggccgcgttgttgccatggtcagagacgctaccagctcatatcaggcgccgaaaataa

SEQ ID NO: 2006 - DNA, 333 bp, Artificial
  Alicyclobacillus acidocaldarius mutated SEQ ID NO 1991
gtgagctattgcctgaagcagtggccgaagctggtgcgctatatggaagacgggcatttggagatcgacaacaaccggtgcgagcggtcgctgaagccgtttgtgatcggacgaaagaactggctgttcgcgaacacgccgcgcggcgcgcgggcaagcgccattgcctatagcatcgtggagacggcgaaggaaaacggcctgaatccttttgcctacttggagtacctgttcgagaagctgccgaacatggacacggatgacaaaaccgccatggccgcgttgttgccatggtcagatacgctaccagctcatatcaggcgccgaaaataa

SEQ ID NO: 2007 - protein, 263 aa, Alicyclobacillus acidocaldarius
MDETVQQFKERPLEREYPYVWLDATFPKVREGGRVQSMALVIAIGVSDTGEREVLGFDVGTSEDGAFWTDFLRDLKTRGLRGVRLVVSDAHAGLRQAIAEVLTGATWQRCKVHAIRNVLSQVPKKEQPMMASILRTIFTQPTQDAAREQLRRVVGEFRRRYPKAMAILADAEEDVLAFMALPFEHWRQICSTNPLERLNREMRRRMNVVGIFPNRDSVVRLVGAILQEQHEEWLVSRRYFSLESMAKLKPQQPMLSAQALLQK

SEQ ID NO: 2008 - DNA, 792 bp, Alicyclobacillus acidocaldarius
atggacgagacggtgcagcagtttaaggagcggccgctcgagcgcgagtatccgtacgtgtggctggatgccacgtttcccaaggtgcgcgaaggtggacgtgtgcaaagcatggccttggtcatcgcgattggcgtgtcggacacgggcgagcgagaggtgctcgggtttgacgtcggcacgagcgaagacggcgcattctggacggacttccttcgtgacttgaagacacgggggctgcgcggggtacggctggtcgtgagcgacgcgcacgcgggcttgcgtcaagcgattgcagaggtgttgacgggcgcgacctggcaacgatgcaaggtccacgcaattcgaaacgtgctgagccaggtacccaagaaagagcagccgatgatggcatccatccttcgcaccatcttcacgcaacccacgcaggacgcggctcgcgagcaactccgtcgcgtggtcggggagtttcgtaggcgatatccgaaggcgatggccatcctggccgacgcggaggaggatgtgctggccttcatggcacttccgtttgagcactggcgacagatttgctcgacgaacccgctggagcgcctgaatcgggaaatgcggcggcggatgaacgtcgtggggattttcccgaatcgagactccgtggtgaggttggtgggcgcaattttgcaagagcaacatgaagagtggctggtttcgcgccggtacttcagcttagagtcgatggcgaagctgaagccacagcagcccatgctatccgcgcaggctctgttgcagaagtag

SEQ ID NO: 2009 - protein, 264 aa, Clostridium thermocellum
LDEFVEEFKNRRLEGEYPYLWLDATFPKVREGGRVCSMALVIAVGVNQQGEREILGFDVGMSEDGAFWEEFLRRLVARGLKGVRLVISDAHEGLKAAIKKILTGSAWQRCRVHFMRNVLSQVPKHYQGMVSSIIRTIFAQNDQESAREQLRHVVDELKKRFPKAMKILEEAEEEILAYMAFPREHWAQIHSTNPLERLNREIRRRTDVVCIFPNREAVIRLVGAMLMEQNDEWKVGRRYFSLESMSKITSINEFTLTPVALLHK

SEQ ID NO: 2010 - protein, 264 aa, Clostridium thermocellum
LDEFVEEFKNRRLEGEYPYLWLDATFPKVREGGRVCSMALVIAVGVNQQGEREILGFDVGMSEDGAFWEEFLRRLVARGLKGVRLVISDAHEGLKAAIKKILTGSAWQRCRVHFMRNVLSQVPKHYQGMVSSIIRTIFAQNDQESAREQLRHVVDELKNRFPKAMKILEEAEEEILAYMAFPREHWAQIHSTNPLERLNREIRRRTDVVCIFPNREAVIRLVGAMLMEQNDEWKVGRRYFSLESMSKITSINEFTLTPVALLHK

SEQ ID NO: 2011 - protein, 264 aa, Clostridium thermocellum
LDEFVEEFKNRRLEGEYPYLWLDATFPKVREGGRVCSMALVIAVGVNQQGEREILGFDVGMSEDGAFWEEFLRRLVARGLKGVRLVISDAHEGLKAAIKKILTGSAWQRCRVHFMRNVLSQVPKHYQGMVSSIIRTIFAQNDQESAREQLRHVVDELKNRFPKAMKILEEAEEEILAYMAFPREHWAQIHSTNPLERLNREIRRRTDVVCIFPNRKAVIRLVGAMLMEQNDEWKVGRRYFSLESMSKITSINEFTLTPVALLHK

SEQ ID NO: 2012 - protein, 262 aa, Symbiobacterium thermophilum
LDEVVEAFRNRPLEGRYPYVWLDAKYEKVRENGRVSSMALVIAMGVREDGEREILGLDVGPSEDGAFWTAFLRQLVARGLKGVLLVISDNHVGLREAIRTVFSGASWQRCRVHFMRNLLGYVPKNLQSMVSAAVRTIFAQPDQQAAKSQLAVVVENLRKQFPRAAQLLEDAEEDILAYMAFPTEHWRRLHSTNPLERLNREIGRRTEIVGIFPNREALIRLAGAVMIEQQEEWMTAPRRYFSQASMAKLYAHDPSLGRPELL

SEQ ID NO: 2013 - protein, 262 aa, Symbiobacterium thermophilum
LDEVVQAFRNRPLEGRYPYVWLDAKYVKVRENGRVSSMALVVAVGVREDGDREILGLDVGPSEDGAFWTAFLRQLVARGLKGVLLAISDSHVGLQEAIRTVLSGASWQRCRVHFMRNLLSYVPKHWQSMVAAAVRTIFAQPDQQAARRQLAVVADNLRPQFPRAAQLLEEAEDDILAYMAFPTEHWRQLHSTNPLERLNREIGRRTDVVGIFPNREAVIRLAGAVLIEQQDEWTAAPRRYFSQASMAKLYTSNQSVSGTDFL

SEQ ID NO: 2014 - protein, 263 aa, Artificial
  Alicyclobacillus acidocaldarius mutated SEQ ID NO 2007
MDETVQQFKERPLEKEYPYVWLDATFPKVREGGRVQSMALVIAIGVSDTGEREVLGFDVGTSEDGAFWTDFLRDLKTRGLRGVRLVVSDAHAGLRQAIAEVLTGATWQRCKVHAIRNVLSQVPKKEQPMMASILRTIFTQPTQDAAREQLRRVVGEFRRRYPKAMAILADAEEDVLAFMALPFEHWRQICSTNPLERLNREMRRRMNVVGIFPNRDSVVRLVGAILQEQHEEWLVSRRYFSLESMAKLKPQQPMLSAQALLQK

SEQ ID NO: 2015 - protein, 263 aa, Artificial
  Alicyclobacillus acidocaldarius mutated SEQ ID NO 2007
MDETVQQFKERPLEREYPYVWLDATFPKVREGGRVQSMALVIAIGVSDTGEREVLGFDVGTSEDGAFWTDFLRDLKTRGLRGVRLVVSDAHAGLRNAIAEVLTGATWQRCKVHAIRNVLSQVPKKEQPMMASILRTIFTQPTQDAAREQLRRVVGEFRRRYPKAMAILADAEEDVLAFMALPFEHWRQICSTNPLERLNREMRRRMNVVGIFPNRDSVVRLVGAILQEQHEEWLVSRRYFSLESMAKLKPQQPMLSAQALLQK

SEQ ID NO: 2016 - protein, 263 aa, Artificial
  Alicyclobacillus acidocaldarius mutated SEQ ID NO 2007
MDETVQQFKERPLEREYPYVWLDATFPKVREGGRVQSMALVIAIGVSDTGEREVLGFDVGTSEDGAFWTDFLRDLKTRGLRGVRLVVSDAHAGLRQAIAEVLTGATWQRCKVHAIRNVLSQVPKKDQPMMASILRTIFTQPTQDAAREQLRRVVGEFRRRYPKAMAILADAEEDVLAFMALPFEHWRQICSTNPLERLNREMRRRMNVVGIFPNRDSVVRLVGAILQEQHEEWLVSRRYFSLESMAKLKPQQPMLSAQALLQK

SEQ ID NO: 2017 - protein, 263 aa, Artificial
  Alicyclobacillus acidocaldarius mutated SEQ ID NO 2007
MDETVQQFKERPLEREYPYVWLDATFPKVREGGRVQSMALVIAIGVSDTGEREVLGFDVGTSEDGAFWTDFLRDLKTRGLRGVRLVVSDAHAGLRQAIADVLTGATWQRCKVHAIRNVLSQVPKKEQPMMASILRTIFTQPTQDAAREQLRRVVGEFRRRYPKAMAILADAEEDVLAFMALPFEHWRQICSTNPLERLNREMRRRMNVVGIFPNRDSVVRLVGAILQEQHEEWLVSRRYFSLESMAKLKPQQPMLSAQALLQK

SEQ ID NO: 2018 - protein, 263 aa, Artificial
  Alicyclobacillus acidocaldarius mutated SEQ ID NO 2007
MDETVQQFKERPLEREYPYVWLDATFPKVREGGRVQSMALVIAIGVSDTGEREVLGFDVGTSEDGAFWTDFLRDLKTRGLRGVRLVVSDAHAGLRQAIAEVLTGATWQRCKVHAIRNVLSQVPKKEQPMMASILRTIFTQPTQDAAREQLRRVVGEFRKRYPKAMAILADAEEDVLAFMALPFEHWRQICSTNPLERLNREMRRRMNVVGIFPNRDSVVRLVGAILQEQHEEWLVSRRYFSLESMAKLKPQQPMLSAQALLQK

SEQ ID NO: 2019 - DNA, 792 bp, Artificial
  Alicyclobacillus acidocaldarius mutated SEQ ID NO 2008
atggacgagacggtgcagcagtttaaggagcggccgctcgagaaagagtatccgtacgtgtggctggatgccacgtttcccaaggtgcgcgaaggtggacgtgtgcaaagcatggccttggtcatcgcgattggcgtgtcggacacgggcgagcgagaggtgctcgggtttgacgtcggcacgagcgaagacggcgcattctggacggacttccttcgtgacttgaagacacgggggctgcgcggggtacggctggtcgtgagcgacgcgcacgcgggcttgcgtcaagcgattgcagaggtgttgacgggcgcgacctggcaacgatgcaaggtccacgcaattcgaaacgtgctgagccaggtacccaagaaagagcagccgatgatggcatccatccttcgcaccatcttcacgcaacccacgcaggacgcggctcgcgagcaactccgtcgcgtggtcggggagtttcgtaggcgatatccgaaggcgatggccatcctggccgacgcggaggaggatgtgctggccttcatggcacttccgtttgagcactggcgacagatttgctcgacgaacccgctggagcgcctgaatcgggaaatgcggcggcggatgaacgtcgtggggattttcccgaatcgagactccgtggtgaggttggtgggcgcaattttgcaagagcaacatgaagagtggctggtttcgcgccggtacttcagcttagagtcgatggcgaagctgaagccacagcagcccatgctatccgcgcaggctctgttgcagaagtag

SEQ ID NO: 2020 - DNA, 792 bp, Artificial
  Alicyclobacillus acidocaldarius mutated SEQ ID NO 2008
atggacgagacggtgcagcagtttaaggagcggccgctcgagcgcgagtatccgtacgtgtggctggatgccacgtttcccaaggtgcgcgaaggtggacgtgtgcaaagcatggccttggtcatcgcgattggcgtgtcggacacgggcgagcgagaggtgctcgggtttgacgtcggcacgagcgaagacggcgcattctggacggacttccttcgtgacttgaagacacgggggctgcgcggggtacggctggtcgtgagcgacgcgcacgcgggcttgcgtaatgcgattgcagaggtgttgacgggcgcgacctggcaacgatgcaaggtccacgcaattcgaaacgtgctgagccaggtacccaagaaagagcagccgatgatggcatccatccttcgcaccatcttcacgcaacccacgcaggacgcggctcgcgagcaactccgtcgcgtggtcggggagtttcgtaggcgatatccgaaggcgatggccatcctggccgacgcggaggaggatgtgctggccttcatggcacttccgtttgagcactggcgacagatttgctcgacgaacccgctggagcgcctgaatcgggaaatgcggcggcggatgaacgtcgtggggattttcccgaatcgagactccgtggtgaggttggtgggcgcaattttgcaagagcaacatgaagagtggctggtttcgcgccggtacttcagcttagagtcgatggcgaagctgaagccacagcagcccatgctatccgcgcaggctctgttgcagaagtag

SEQ ID NO: 2021 - DNA, 792 bp, Artificial
  Alicyclobacillus acidocaldarius mutated SEQ ID NO 2008
atggacgagacggtgcagcagtttaaggagcggccgctcgagcgcgagtatccgtacgtgtggctggatgccacgtttcccaaggtgcgcgaaggtggacgtgtgcaaagcatggccttggtcatcgcgattggcgtgtcggacacgggcgagcgagaggtgctcgggtttgacgtcggcacgagcgaagacggcgcattctggacggacttccttcgtgacttgaagacacgggggctgcgcggggtacggctggtcgtgagcgacgcgcacgcgggcttgcgtcaagcgattgcagaggtgttgacgggcgcgacctggcaacgatgcaaggtccacgcaattcgaaacgtgctgagccaggtacccaagaaagatcagccgatgatggcatccatccttcgcaccatcttcacgcaacccacgcaggacgcggctcgcgagcaactccgtcgcgtggtcggggagtttcgtaggcgatatccgaaggcgatggccatcctggccgacgcggaggaggatgtgctggccttcatggcacttccgtttgagcactggcgacagatttgctcgacgaacccgctggagcgcctgaatcgggaaatgcggcggcggatgaacgtcgtggggattttcccgaatcgagactccgtggtgaggttggtgggcgcaattttgcaagagcaacatgaagagtggctggtttcgcgccggtacttcagcttagagtcgatggcgaagctgaagccacagcagcccatgctatccgcgcaggctctgttgcagaagtag

SEQ ID NO: 2022 - DNA, 792 bp, Artificial
  Alicyclobacillus acidocaldarius mutated SEQ ID NO 2008
atggacgagacggtgcagcagtttaaggagcggccgctcgagcgcgagtatccgtacgtgtggctggatgccacgtttcccaaggtgcgcgaaggtggacgtgtgcaaagcatggccttggtcatcgcgattggcgtgtcggacacgggcgagcgagaggtgctcgggtttgacgtcggcacgagcgaagacggcgcattctggacggacttccttcgtgacttgaagacacgggggctgcgcggggtacggctggtcgtgagcgacgcgcacgcgggcttgcgtcaagcgattgcagatgtgttgacgggcgcgacctggcaacgatgcaaggtccacgcaattcgaaacgtgctgagccaggtacccaagaaagagcagccgatgatggcatccatccttcgcaccatcttcacgcaacccacgcaggacgcggctcgcgagcaactccgtcgcgtggtcggggagtttcgtaggcgatatccgaaggcgatggccatcctggccgacgcggaggaggatgtgctggccttcatggcacttccgtttgagcactggcgacagatttgctcgacgaacccgctggagcgcctgaatcgggaaatgcggcggcggatgaacgtcgtggggattttcccgaatcgagactccgtggtgaggttggtgggcgcaattttgcaagagcaacatgaagagtggctggtttcgcgccggtacttcagcttagagtcgatggcgaagctgaagccacagcagcccatgctatccgcgcaggctctgttgcagaagtag

SEQ ID NO: 2023 - DNA, 792 bp, Artificial
  Alicyclobacillus acidocaldarius mutated SEQ ID NO 2008
atggacgagacggtgcagcagtttaaggagcggccgctcgagcgcgagtatccgtacgtgtggctggatgccacgtttcccaaggtgcgcgaaggtggacgtgtgcaaagcatggccttggtcatcgcgattggcgtgtcggacacgggcgagcgagaggtgctcgggtttgacgtcggcacgagcgaagacggcgcattctggacggacttccttcgtgacttgaagacacgggggctgcgcggggtacggctggtcgtgagcgacgcgcacgcgggcttgcgtcaagcgattgcagaggtgttgacgggcgcgacctggcaacgatgcaaggtccacgcaattcgaaacgtgctgagccaggtacccaagaaagagcagccgatgatggcatccatccttcgcaccatcttcacgcaacccacgcaggacgcggctcgcgagcaactccgtcgcgtggtcggggagtttcgtaaacgatatccgaaggcgatggccatcctggccgacgcggaggaggatgtgctggccttcatggcacttccgtttgagcactggcgacagatttgctcgacgaacccgctggagcgcctgaatcgggaaatgcggcggcggatgaacgtcgtggggattttcccgaatcgagactccgtggtgaggttggtgggcgcaattttgcaagagcaacatgaagagtggctggtttcgcgccggtacttcagcttagagtcgatggcgaagctgaagccacagcagcccatgctatccgcgcaggctctgttgcagaagtag

SEQ ID NO: 2024 - protein, 136 aa, Alicyclobacillus acidocaldarius
MALLNSFAVLEWIRKMQDEDHIDVLRELMQLVAQFLIDAEAVEKIGAERYERTDSRVTQRNGSRSRTWDTRLGTVDLKIPKLRQGSFFPSLLEPRRRAEQALAAVIQEAYVKGVSTRKVDDLVRALGLEGISKSEV

SEQ ID NO: 2025 - DNA, 411 bp, Alicyclobacillus acidocaldarius
atggctttgctcaatagcttcgcagttttggaatggatccgcaagatgcaagatgaggatcacatcgacgtgttgcgagagttgatgcagcttgtcgcccagtttctcatcgatgcagaggccgtcgagaaaatcggagccgaacgctatgaacgcacggatagccgcgtgacgcagcgaaacggctcgcgctcccgcacgtgggacacgcgccttgggactgttgacctgaaaatcccgaaactccgtcaggggagcttcttcccctcgttgctcgaaccaaggcgccgagcggaacaggcgttggcagctgtcattcaagaagcgtatgtgaagggcgtgagcacccgtaaagtcgacgacttagttcgagcgctggggctggaaggtatcagcaagagcgaggtgtga

SEQ ID NO: 2026 - protein, 127 aa, Symbiobacterium thermophilum
LEELLRKSGVDDVDFLREGVRVLAQGLMELEVSQQIGAERYERSSERSNYRNGYRERQWDTRVGTIDLQIPKLRKGSYMPSWLEPRRRAEKALVAVVQEAYIQGVSTRKVDELVQALGMTGVSKSQV

SEQ ID NO: 2027 - protein, 127 aa, Symbiobacterium thermophilum
LEELLRKTGVDDFDFLREGLRVLAQGLMELEVSQRIGADRYERSAERSTYRNGYRERQWDTRVGTIDLQIPKLRKGSYMPSFLEPRRRAEKALVAVVLEAYVNGVSTRKVDDLVQALGMTGVSKSQV

SEQ ID NO: 2028 - protein, 136 aa, Clostridium thermocellum
MATNNRMALLEQLSKYVVEKDKDFLKEALTLLINALMDAEVTSIIGAEKYERNNNRNNYRNGYRLREWDTRVGTLQLSIPKLRHGSYFPSLLEPRKMSEKALLNVVQEAYVHGVSTRKVDELVEALGMKGIDKSEV

SEQ ID NO: 2029 - protein, 136 aa, Clostridium thermocellum; identical to SEQ ID NO: 2028

SEQ ID NO: 2030 - protein, 136 aa, Clostridium thermocellum; identical to SEQ ID NO: 2028

SEQ ID NO: 2031 - protein, 136 aa, Artificial
  Alicyclobacillus acidocaldarius mutated SEQ ID NO 2024
MAILNSFAVLEWIRKMQDEDHIDVLRELMQLVAQFLIDAEAVEKIGAERYERTDSRVTQRNGSRSRTWDTRLGTVDLKIPKLRQGSFFPSLLEPRRRAEQALAAVIQEAYVKGVSTRKVDDLVRALGLEGISKSEV

SEQ ID NO: 2032 - protein, 136 aa, Artificial
  Alicyclobacillus acidocaldarius mutated SEQ ID NO 2024
MALINSFAVLEWIRKMQDEDHIDVLRELMQLVAQFLIDAEAVEKIGAERYERTDSRVTQRNGSRSRTWDTRLGTVDLKIPKLRQGSFFPSLLEPRRRAEQALAAVIQEAYVKGVSTRKVDDLVRALGLEGISKSEV

SEQ ID NO: 2033 - protein, 136 aa, Artificial
  Alicyclobacillus acidocaldarius mutated SEQ ID NO 2024
MALLNSFAVLEWIRKMQEEDHIDVLRELMQLVAQFLIDAEAVEKIGAERYERTDSRVTQRNGSRSRTWDTRLGTVDLKIPKLRQGSFFPSLLEPRRRAEQALAAVIQEAYVKGVSTRKVDDLVRALGLEGISKSEV

SEQ ID NO: 2034 - protein, 136 aa, Artificial
  Alicyclobacillus acidocaldarius mutated SEQ ID NO 2024
MALLNSFAVLEWIRKMQDEDHIDVLRELMQLVAQFLIDAEAVEKIGAERYERTDSRITQRNGSRSRTWDTRLGTVDLKIPKLRQGSFFPSLLEPRRRAEQALAAVIQEAYVKGVSTRKVDDLVRALGLEGISKSEV

SEQ ID NO: 2035 - protein, 136 aa, Artificial
  Alicyclobacillus acidocaldarius mutated SEQ ID NO 2024
MALLNSFAVLEWIRKMQDEDHLDVLRELMQLVAQFLIDAEAVEKIGAERYERTDSRVTQRNGSRSRTWDTRLGTVDLKIPKLRQGSFFPSLLEPRRRAEQALAAVIQEAYVKGVSTRKVDDLVRALGLEGISKSEV

SEQ ID NO: 2036 - DNA, 411 bp, Artificial
  Alicyclobacillus acidocaldarius mutated SEQ ID NO 2025
atggctattctcaatagcttcgcagttttggaatggatccgcaagatgcaagatgaggatcacatcgacgtgttgcgagagttgatgcagcttgtcgcccagtttctcatcgatgcagaggccgtcgagaaaatcggagccgaacgctatgaacgcacggatagccgcgtgacgcagcgaaacggctcgcgctcccgcacgtgggacacgcgccttgggactgttgacctgaaaatcccgaaactccgtcaggggagcttcttcccctcgttgctcgaaccaaggcgccgagcggaacaggcgttggcagctgtcattcaagaagcgtatgtgaagggcgtgagcacccgtaaagtcgacgacttagttcgagcgctggggctggaaggtatcagcaagagcgaggtgtga

SEQ ID NO: 2037 - DNA, 411 bp, Artificial
  Alicyclobacillus acidocaldarius mutated SEQ ID NO 2025
atggctttgattaatagcttcgcagttttggaatggatccgcaagatgcaagatgaggatcacatcgacgtgttgcgagagttgatgcagcttgtcgcccagtttctcatcgatgcagaggccgtcgagaaaatcggagccgaacgctatgaacgcacggatagccgcgtgacgcagcgaaacggctcgcgctcccgcacgtgggacacgcgccttgggactgttgacctgaaaatcccgaaactccgtcaggggagcttcttcccctcgttgctcgaaccaaggcgccgagcggaacaggcgttggcagctgtcattcaagaagcgtatgtgaagggcgtgagcacccgtaaagtcgacgacttagttcgagcgctggggctggaaggtatcagcaagagcgaggtgtga

SEQ ID NO: 2038 - DNA, 411 bp, Artificial
  Alicyclobacillus acidocaldarius mutated SEQ ID NO 2025
atggctttgctcaatagcttcgcagttttggaatggatccgcaagatgcaagaagaggatcacatcgacgtgttgcgagagttgatgcagcttgtcgcccagtttctcatcgatgcagaggccgtcgagaaaatcggagccgaacgctatgaacgcacggatagccgcgtgacgcagcgaaacggctcgcgctcccgcacgtgggacacgcgccttgggactgttgacctgaaaatcccgaaactccgtcaggggagcttcttcccctcgttgctcgaaccaaggcgccgagcggaacaggcgttggcagctgtcattcaagaagcgtatgtgaagggcgtgagcacccgtaaagtcgacgacttagttcgagcgctggggctggaaggtatcagcaagagcgaggtgtga

SEQ ID NO: 2039 - DNA, 411 bp, Artificial
  Alicyclobacillus acidocaldarius mutated SEQ ID NO 2025
atggctttgctcaatagcttcgcagttttggaatggatccgcaagatgcaagatgaggatcacatcgacgtgttgcgagagttgatgcagcttgtcgcccagtttctcatcgatgcagaggccgtcgagaaaatcggagccgaacgctatgaacgcacggatagccgcattacgcagcgaaacggctcgcgctcccgcacgtgggacacgcgccttgggactgttgacctgaaaatcccgaaactccgtcaggggagcttcttcccctcgttgctcgaaccaaggcgccgagcggaacaggcgttggcagctgtcattcaagaagcgtatgtgaagggcgtgagcacccgtaaagtcgacgacttagttcgagcgctggggctggaaggtatcagcaagagcgaggtgtga

SEQ ID NO: 2040 - DNA, 411 bp, Artificial
  Alicyclobacillus acidocaldarius mutated SEQ ID NO 2025
atggctttgctcaatagcttcgcagttttggaatggatccgcaagatgcaagatgaggatcacttagacgtgttgcgagagttgatgcagcttgtcgcccagtttctcatcgatgcagaggccgtcgagaaaatcggagccgaacgctatgaacgcacggatagccgcgtgacgcagcgaaacggctcgcgctcccgcacgtgggacacgcgccttgggactgttgacctgaaaatcccgaaactccgtcaggggagcttcttcccctcgttgctcgaaccaaggcgccgagcggaacaggcgttggcagctgtcattcaagaagcgtatgtgaagggcgtgagcacccgtaaagtcgacgacttagttcgagcgctggggctggaaggtatcagcaagagcgaggtgtga

SEQ ID NO: 2041 - protein, 386 aa, Alicyclobacillus acidocaldarius
MSAIPPPSEGEVNGMELTRTVRVRLDPTPEQASALALTIEANRQALDYVSRIAFERRIRNAFDLQRIVYRTIRTRFGLRAQMACTVCRTVAAVYKSMKSNGNANALAKFKHAKPVFQWNKDYVLRSGLAYITTLDGRLRIPFRVEPPYQRYLQDGWTFGAAELVQKRHGWFLHVSVSKTVPDPVGDFDAVIGVDQGMRFLVTASCGNEVMFIRGGKVKQTRLRYVRLRASLQRKGTRSAKRRLKAIGRRESRFMTDVNHQIAKAVVRFAKAQGQRPLIVLEDLTGSNLSVRFRMKDQYWRMSWAFRQLADFIRYKAEEVGIAVMVIDPTGTSETCPKCGHCEAANRSRKRHEFRCKKCGYRCNDDLAASRVIAQKGLECLRQSQSA

SEQ ID NO: 2042 - DNA, 1161 bp, Alicyclobacillus acidocaldarius
ttgtctgccattccccctccaagtgagggggaggtgaatggcatggagctcacccgtaccgtccgcgttcgattggatccaacgccggaacaagcttctgcgcttgctctcaccatcgaggcgaatcgtcaggcgctcgattatgtgagtcgtatcgccttcgagcgtcggatccgcaatgcgtttgacttgcagcgtatcgtataccgaaccattcgcacccgattcggtctgcgtgcgcagatggcctgcaccgtgtgtcgcaccgtcgccgcggtgtacaagagcatgaaatcgaacggcaacgcgaacgcgctggcaaagttcaagcatgccaagcccgtgttccagtggaacaaggattatgtgctgcgaagcggcttggcgtacatcacgacgcttgatggtcgcctgcgaatcccgtttcgtgtggagcctccataccaacggtatttgcaggacggctggaccttcggtgcagccgaactcgttcaaaagcgacacggatggtttttgcatgtgtccgtgtcgaagacggttccggatcccgttggcgatttcgacgccgtgatcggcgttgaccaaggaatgcgcttccttgtcacagcctcttgtggcaatgaggtgatgttcatccgcggcggcaaggtcaaacagacccgcctccgctacgtccgtctgcgcgcgtcccttcagcgcaaaggcactcgctcggccaagcgccgcctgaaggcgatcggtcgaagagaatcccgtttcatgacggacgtcaaccaccaaatcgccaaggctgtggtccgcttcgcaaaggcccaaggtcaacgtccgctcattgtgcttgaggatctcacaggcagtaacctgtccgtccgattccggatgaaagatcaatactggcgcatgagttgggcgttccggcagttggcagacttcattcgctacaaggcggaagaagtcgggattgccgttatggtcattgatccgacgggcacaagcgagacctgcccgaagtgcggacactgcgaagctgcgaatcgaagccgcaagcgtcacgaattccgttgcaagaagtgcggctatcgatgcaacgacgatttggccgcaagccgcgtgatcgcccaaaagggcctggaatgcttgcggcagagccagagcgcatga

SEQ ID NO: 2043 - protein, 363 aa, Geobacillus kaustophilus
MDMTLTAKIKIYPTAEQAEVLKATLSAYRQACNAVSVVIFDTKVLAQAKLHDMTYRLLRSNYALRSQMAQSVIKTVIARYRSLKSNGHEWTLVRFKKPEYDLVWNRDYSIVQGLFSVNTLEGRIKVPFEPKGMEPYFDGSWTFGTAKLVYKHNKFFLHIPMTKTIPTVDEHNIRQVVGVDVGVNFLAAAYDSQGKTTFFNGRKIKHMRAKYKRMRKTLQQKGTASARRKLKTIGQRENRWMTDVNHAVTKALVRQYGERTLFVLEDLTGIREKTERVRIHDRYETVSWAFYQFRQLLEYKARLHGSKVMVVAPHYTSLTCPKCGHTEKANRNKRTHTFCCRTCGYTSNDDRIGAMNLQRKGIE

SEQ ID NO: 2044 - protein, 363 aa, Geobacillus kaustophilus
MDMTLTAKIKIYPTAEQAEVLKATLSAYRQACNAVSVVIFDTKVLAQAKLHDMTYRLLRSNYALRSQMAQSVIKTVIARYRSLKSNGHEWTLVRFKKPEYDLVWNRDYSIVQGLFSVNTLEGRIKVSFEPKGMEPYFDGSWTFGTAKLVYKHNKFFLHIPMTKTIPTVDEHNIRQVVGVDVGVNFLAVAYDSQGKTIFFNGRKIKHMRAKYKRMRKTLQQKGTASARRKLKTIGQRENRWMTDVNHAVTKALVRQYGERTLFVLEDLTGIREKTERVRIHDRYETVSWAFYQFRQMLEYKARLHGSKVIVVAPHYTSLTCPKCGHTEKANRKKRTHTFCCRTCGYTSNDDRIGAMNLQRKGIE

SEQ ID NO: 2045 - protein, 367 aa, Clostridium botulinum
MEIVRTLKIKLNINQEEKNMINSTLEAFLKALNYASQVAFNNGEITNKPKLQKLVYDDLRTKFNLKSQMAVNTCTTVCSSYVTQHSNKVFNSLAVYKSPKAIYSYGRDYSFLNDGQTISINTIAKRIKVHFKVNNYFKKYLTKEWSFGSLEIVERENSYYAHITVSKEVQEKPLNEFKNIIGIDLGQNFIATFYDSKGKIKFFKGRYLKDMRAKYTRLRKQLQRKGTYNAHKKIVTINQREQRTMTYINHKISKEIVEYAKQNNAIIAMENLTGINLSCKVKKDNRYYRVSWAFNQLQQFIEYKAVQAGLKVIYINPKYTSQTCPICGHIHKDNRNKKLHIFKCRACGCTLNDDLIGAKNIQHKGYD

SEQ ID NO: 2046 - protein, 362 aa, Bacillus selenitireducens
MKLTLTAKTKIVPTVEQEDTLRKTAHAYRDACNAVSEVVFDENTLVQAKLHKRTYRELRSTFGLKSQMAQSALKTVIATYKTNQSNGHERSQVQFKKPQFDLVFNRDYSLTKGLFSVNTLEGRIKVPFYTEGLEPYFDGTWTFGTAKLVHKYGKWFLHIPVSKDVQEANLDNINQVVGIDMGVNFTATTYDSNGQTRFFNGKQIKHKRAKYKQMRKELQQKQTPSARRKLKKIGQRENRWMQNINYCISKALVEQYGKDTLFVMEDLTGVRNATEKVRVKDRYQTVSWSFNDLRQKIAYKAQKTGALGIAVDPGYTSQTCPKCGHTEKANRNKKTHTFCCQTCQYTSNDDRIGAMNLQRKGI

SEQ ID NO: 2047 - protein, 360 aa, Bacillus cereus
TITAKIQIHVSDNQAESLKITTNAYRKACNWLSKHIFETKNLNQVNLNNLYYSDLRNQFRLKSQMAQSVMKTVIARYKSAKSNGHEWSLIDFKLAEYDLVWNRDYSLTKNQFSVNTLEGRLKLNYERKAMKKYFNSTWKFGTAKLVHKYKKWFLHIPMTKEYQTLDFADVNNIVGVDLGINFLATTYDSQSKTTFYNGNIVKHKRGKFKATRKQLQTRQTPSSRKKIKQIGSRENRYVTDVNHQITKALVEAYPRGTMFVLEDLTGVRSATEKVRVKNRYVSVSWAFYQFRQMLEYKAELNGQKVIVVDPKYTSQTCPKCGNIEKANRNKKLHTFKCKNCQYQSNDDRISAMNLHRKGIK

SEQ ID NO: 2048 - protein, 386 aa, Artificial
  Alicyclobacillus acidocaldarius mutated SEQ ID NO 2041
MSAIPPPSEGEVNGMELTRTVRVRLDPTPEQASALALTIEANRQALDYVSRIAFERRIRNAFDLQRIVYRTIRTRFGLRAQMACTVCRTVAAVYKSMKSNGNANALAKFKHAKPVFQWNKDYVLRSGLAYITTLDGRLRIPFRVEPPYQRYLQDGWTFGAAELVQKRHGWFLHVSVSKTVPDPVGDFDAVIGVDQGMRFLVTASCGNEVMFIRGGKVKQTRIRYVRLRASLQRKGTRSAKRRLKAIGRRESRFMTDVNHQIAKAVVRFAKAQGQRPLIVLEDLTGSNLSVRFRMKDQYWRMSWAFRQLADFIRYKAEEVGIAVMVIDPTGTSETCPKCGHCEAANRSRKRHEFRCKKCGYRCNDDLAASRVIAQKGLECLRQSQSA

SEQ ID NO: 2049 - protein, 386 aa, Artificial
  Alicyclobacillus acidocaldarius mutated SEQ ID NO 2041
MSAIPPPSEGEVNGMELTRTVRVRLDPTPEQASALALTIEANRQALDYVSRIAFERRIRNAFDLQRIVYRTIRTRFGLRAQMACTVCRTVAAVYKSMKSNGNANALAKFKHAKPVFQWNKDYVLRSGLAYITTLDGRLRIPFRVEPPYQRYLQDGWTFGAAELVQKRHGWFLHVSVSKTVPDPVGDFDAVIGVDQGMRFLVTASCGNEVMFIRGGKVKQTRLRYVRLRASLQRKGTRSAKRRLKAIGRRESRFMTDVNHQIAKAVVRFAKAQGQRPLIVLEDLTGSNLSVRFRMKDQYWRMSWAFRQLADFIRYKAEEVGIAVMVIDPTGTSETCPKCGHCEAANRSRKRHEFRCKKCGYRCNDDLAASRVIAQKGIECLRQSQSA

SEQ ID NO: 2050 - protein, 386 aa, Artificial
  Alicyclobacillus acidocaldarius mutated SEQ ID NO 2041
MSAIPPPSEGEVNGMELTRTVRVRLDPTPEQASALALTIEANRQALDYVSRIAFERRIRNAFDLQRIVYRTIRTRFGLRAQMACTVCRTVAAVYKSMKSNGNANALAKFKHAKPVFQWNKDYVLRSGLAYITTLDGRLRIPFRVEPPYQRYLQDGWTFGAAELVQKRHGWFLHVSVSKTVPDPVGDFDAVIGVDQGMRFLVTASCGNEVMFIRGGKVKQTRLRYVRLRASLQRKGTRSAKRRLKAIGRRESRFMTDVNHQIAKAVVRFAKAQGQRPLIVLEDLTGSNLSVRFRMKDQYWRMSWAFRQLADFIRYKAEEVGIAVMVIDPTGTSETCPKCGHCEAANRSRKRHEFRCKKCGYRCNDDIAASRVIAQKGLECLRQSQSA

SEQ ID NO: 2051 - protein, 386 aa, Artificial
  Alicyclobacillus acidocaldarius mutated SEQ ID NO 2041
MSAIPPPSEGEVNGMELTRTVRVRLDPTPEQASALALTIEANRQALDYVSRIAFERRIRNAFDLQRIVYRTIRTRFGLRAQMACTVCRTVAAVYKSMKSNGNANALAKFKHAKPVFQWNKDYVLRSGLAYITTLDGRLRIPFRVEPPYQRYLQDGWTFGAAELVQKRHGWFLHVSVSKTVPDPVGDFDAVIGVDQGMRFLVTASCGNEVMFIRGGKVKQTRLRYVRLRASLQRKGTRSAKRRLKAIGRRESRFMTDVNHQIAKAVVRFAKAQGQRPLIVLEDLTGSNLSVRFRMKDQYWRMSWAFRQLADFIRYKAEEVGIAVMVIDPTGTSETCPKCGHCEAANRSRKRHEFRCKKCGYKCNDDLAASRVIAQKGLECLRQSQSA

SEQ ID NO: 2052 - protein, 386 aa, Artificial
  Alicyclobacillus acidocaldarius mutated SEQ ID NO 2041
MSAIPPPSEGEVNGMELTRTVRVRLDPTPEQASALALTIEANRQALDYVSRIAFERRIRNAFDLQRIVYRTIRTRFGLRAQMACTVCRTVAAVYKSMKSNGNANALAKFKHAKPVFQWNKDYVLRSGLAYITTLDGRLRIPFRVEPPYQRYLQDGWTFGAAELVQKRHGWFLHVSVSKTVPDPVGDFDAVIGVDQGMRFLVTASCGNEVMFIRGGKVKQTRLRYVRLRASLQRKGTRSAKRRLKAIGRRESRFMTDVNHQIAKAVVRFAKAQGQRPLIVLEDLTGSNLSVRFRMKDQYWRMSWAFRQLADFIRYKADEVGIAVMVIDPTGTSETCPKCGHCEAANRSRKRHEFRCKKCGYRCNDDLAASRVIAQKGLECLRQSQSA

SEQ ID NO: 2053 - DNA, 1161 bp, Artificial
  Alicyclobacillus acidocaldarius mutated SEQ ID NO 2042
ttgtctgccattccccctccaagtgagggggaggtgaatggcatggagctcacccgtaccgtccgcgttcgattggatccaacgccggaacaagcttctgcgcttgctctcaccatcgaggcgaatcgtcaggcgctcgattatgtgagtcgtatcgccttcgagcgtcggatccgcaatgcgtttgacttgcagcgtatcgtataccgaaccattcgcacccgattcggtctgcgtgcgcagatggcctgcaccgtgtgtcgcaccgtcgccgcggtgtacaagagcatgaaatcgaacggcaacgcgaacgcgctggcaaagttcaagcatgccaagcccgtgttccagtggaacaaggattatgtgctgcgaagcggcttggcgtacatcacgacgcttgatggtcgcctgcgaatcccgtttcgtgtggagcctccataccaacggtatttgcaggacggctggaccttcggtgcagccgaactcgttcaaaagcgacacggatggtttttgcatgtgtccgtgtcgaagacggttccggatcccgttggcgatttcgacgccgtgatcggcgttgaccaaggaatgcgcttccttgtcacagcctcttgtggcaatgaggtgatgttcatccgcggcggcaaggtcaaacagacccgcattcgctacgtccgtctgcgcgcgtcccttcagcgcaaaggcactcgctcggccaagcgccgcctgaaggcgatcggtcgaagagaatcccgtttcatgacggacgtcaaccaccaaatcgccaaggctgtggtccgcttcgcaaaggcccaaggtcaacgtccgctcattgtgcttgaggatctcacaggcagtaacctgtccgtccgattccggatgaaagatcaatactggcgcatgagttgggcgttccggcagttggcagacttcattcgctacaaggcggaagaagtcgggattgccgttatggtcattgatccgacgggcacaagcgagacctgcccgaagtgcggacactgcgaagctgcgaatcgaagccgcaagcgtcacgaattccgttgcaagaagtgcggctatcgatgcaacgacgatttggccgcaagccgcgtgatcgcccaaaagggcctggaatgcttgcggcagagccagagcgcatga

SEQ ID NO: 2054 - DNA, 1161 bp, Artificial
  Alicyclobacillus acidocaldarius mutated SEQ ID NO 2042
ttgtctgccattccccctccaagtgagggggaggtgaatggcatggagctcacccgtaccgtccgcgttcgattggatccaacgccggaacaagcttctgcgcttgctctcaccatcgaggcgaatcgtcaggcgctcgattatgtgagtcgtatcgccttcgagcgtcggatccgcaatgcgtttgacttgcagcgtatcgtataccgaaccattcgcacccgattcggtctgcgtgcgcagatggcctgcaccgtgtgtcgcaccgtcgccgcggtgtacaagagcatgaaatcgaacggcaacgcgaacgcgctggcaaagttcaagcatgccaagcccgtgttccagtggaacaaggattatgtgctgcgaagcggcttggcgtacatcacgacgcttgatggtcgcctgcgaatcccgtttcgtgtggagcctccataccaacggtatttgcaggacggctggaccttcggtgcagccgaactcgttcaaaagcgacacggatggtttttgcatgtgtccgtgtcgaagacggttccggatcccgttggcgatttcgacgccgtgatcggcgttgaccaaggaatgcgcttccttgtcacagcctcttgtggcaatgaggtgatgttcatccgcggcggcaaggtcaaacagacccgcctccgctacgtccgtctgcgcgcgtcccttcagcgcaaaggcactcgctcggccaagcgccgcctgaaggcgatcggtcgaagagaatcccgtttcatgacggacgtcaaccaccaaatcgccaaggctgtggtccgcttcgcaaaggcccaaggtcaacgtccgctcattgtgcttgaggatctcacaggcagtaacctgtccgtccgattccggatgaaagatcaatactggcgcatgagttgggcgttccggcagttggcagacttcattcgctacaaggcggaagaagtcgggattgccgttatggtcattgatccgacgggcacaagcgagacctgcccgaagtgcggacactgcgaagctgcgaatcgaagccgcaagcgtcacgaattccgttgcaagaagtgcggctatcgatgcaacgacgatttggccgcaagccgcgtgatcgcccaaaagggcattgaatgcttgcggcagagccagagcgcatga

SEQ ID NO: 2055 - DNA, 1161 bp, Artificial
  Alicyclobacillus acidocaldarius mutated SEQ ID NO 2042
ttgtctgccattccccctccaagtgagggggaggtgaatggcatggagctcacccgtaccgtccgcgttcgattggatccaacgccggaacaagcttctgcgcttgctctcaccatcgaggcgaatcgtcaggcgctcgattatgtgagtcgtatcgccttcgagcgtcggatccgcaatgcgtttgacttgcagcgtatcgtataccgaaccattcgcacccgattcggtctgcgtgcgcagatggcctgcaccgtgtgtcgcaccgtcgccgcggtgtacaagagcatgaaatcgaacggcaacgcgaacgcgctggcaaagttcaagcatgccaagcccgtgttccagtggaacaaggattatgtgctgcgaagcggcttggcgtacatcacgacgcttgatggtcgcctgcgaatcccgtttcgtgtggagcctccataccaacggtatttgcaggacggctggaccttcggtgcagccgaactcgttcaaaagcgacacggatggtttttgcatgtgtccgtgtcgaagacggttccggatcccgttggcgatttcgacgccgtgatcggcgttgaccaaggaatgcgcttccttgtcacagcctcttgtggcaatgaggtgatgttcatccgcggcggcaaggtcaaacagacccgcctccgctacgtccgtctgcgcgcgtcccttcagcgcaaaggcactcgctcggccaagcgccgcctgaaggcgatcggtcgaagagaatcccgtttcatgacggacgtcaaccaccaaatcgccaaggctgtggtccgcttcgcaaaggcccaaggtcaacgtccgctcattgtgcttgaggatctcacaggcagtaacctgtccgtccgattccggatgaaagatcaatactggcgcatgagttgggcgttccggcagttggcagacttcattcgctacaaggcggaagaagtcgggattgccgttatggtcattgatccgacgggcacaagcgagacctgcccgaagtgcggacactgcgaagctgcgaatcgaagccgcaagcgtcacgaattccgttgcaagaagtgcggctatcgatgcaacgacgatattgccgcaagccgcgtgatcgcccaaaagggcctggaatgcttgcggcagagccagagcgcatga

SEQ ID NO: 2056 - DNA, 1161 bp, Artificial
  Alicyclobacillus acidocaldarius mutated SEQ ID NO 2042
ttgtctgccattccccctccaagtgagggggaggtgaatggcatggagctcacccgtaccgtccgcgttcgattggatccaacgccggaacaagcttctgcgcttgctctcaccatcgaggcgaatcgtcaggcgctcgattatgtgagtcgtatcgccttcgagcgtcggatccgcaatgcgtttgacttgcagcgtatcgtataccgaaccattcgcacccgattcggtctgcgtgcgcagatggcctgcaccgtgtgtcgcaccgtcgccgcggtgtacaagagcatgaaatcgaacggcaacgcgaacgcgctggcaaagttcaagcatgccaagcccgtgttccagtggaacaaggattatgtgctgcgaagcggcttggcgtacatcacgacgcttgatggtcgcctgcgaatcccgtttcgtgtggagcctccataccaacggtatttgcaggacggctggaccttcggtgcagccgaactcgttcaaaagcgacacggatggtttttgcatgtgtccgtgtcgaagacggttccggatcccgttggcgatttcgacgccgtgatcggcgttgaccaaggaatgcgcttccttgtcacagcctcttgtggcaatgaggtgatgttcatccgcggcggcaaggtcaaacagacccgcctccgctacgtccgtctgcgcgcgtcccttcagcgcaaaggcactcgctcggccaagcgccgcctgaaggcgatcggtcgaagagaatcccgtttcatgacggacgtcaaccaccaaatcgccaaggctgtggtccgcttcgcaaaggcccaaggtcaacgtccgctcattgtgcttgaggatctcacaggcagtaacctgtccgtccgattccggatgaaagatcaatactggcgcatgagttgggcgttccggcagttggcagacttcattcgctacaaggcggaagaagtcgggattgccgttatggtcattgatccgacgggcacaagcgagacctgcccgaagtgcggacactgcgaagctgcgaatcgaagccgcaagcgtcacgaattccgttgcaagaagtgcggctataaatgcaacgacgatttggccgcaagccgcgtgatcgcccaaaagggcctggaatgcttgcggcagagccagagcgcatga

SEQ ID NO: 2057 - DNA, 1161 bp, Artificial
  Alicyclobacillus acidocaldarius mutated SEQ ID NO 2042
ttgtctgccattccccctccaagtgagggggaggtgaatggcatggagctcacccgtaccgtccgcgttcgattggatccaacgccggaacaagcttctgcgcttgctctcaccatcgaggcgaatcgtcaggcgctcgattatgtgagtcgtatcgccttcgagcgtcggatccgcaatgcgtttgacttgcagcgtatcgtataccgaaccattcgcacccgattcggtctgcgtgcgcagatggcctgcaccgtgtgtcgcaccgtcgccgcggtgtacaagagcatgaaatcgaacggcaacgcgaacgcgctggcaaagttcaagcatgccaagcccgtgttccagtggaacaaggattatgtgctgcgaagcggcttggcgtacatcacgacgcttgatggtcgcctgcgaatcccgtttcgtgtggagcctccataccaacggtatttgcaggacggctggaccttcggtgcagccgaactcgttcaaaagcgacacggatggtttttgcatgtgtccgtgtcgaagacggttccggatcccgttggcgatttcgacgccgtgatcggcgttgaccaaggaatgcgcttccttgtcacagcctcttgtggcaatgaggtgatgttcatccgcggcggcaaggtcaaacagacccgcctccgctacgtccgtctgcgcgcgtcccttcagcgcaaaggcactcgctcggccaagcgccgcctgaaggcgatcggtcgaagagaatcccgtttcatgacggacgtcaaccaccaaatcgccaaggctgtggtccgcttcgcaaaggcccaaggtcaacgtccgctcattgtgcttgaggatctcacaggcagtaacctgtccgtccgattccggatgaaagatcaatactggcgcatgagttgggcgttccggcagttggcagacttcattcgctacaaggcggatgaagtcgggattgccgttatggtcattgatccgacgggcacaagcgagacctgcccgaagtgcggacactgcgaagctgcgaatcgaagccgcaagcgtcacgaattccgttgcaagaagtgcggctatcgatgcaacgacgatttggccgcaagccgcgtgatcgcccaaaagggcctggaatgcttgcggcagagccagagcgcatga

SEQ ID NO: 2058 - protein, 599 aa, Alicyclobacillus acidocaldarius
MILLFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGGHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAITKEALRDGKFLIRTNTDLPAADVVQSYKTLMGIERAFHQIKNFLDVGPIYHWNEQRVRGHIFVCVLAYLFEQEMQVLYRRQWAHDKAVAESLACVEEQAKVLAELESRWYTGEAIVRELRRWKAVRATFLDKEFVSVTKATDQAKAILTSLGIPTPNKTLSVTKVPSMTPDE

SEQ ID NO: 2059 - DNA, 1800 bp, Alicyclobacillus acidocaldarius
gtgatcctcttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagggcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgccatcaccaaggaagcactgcgcgacggaaagttcctgattcgaaccaatacggatttgcctgcagccgacgtggtccaatcgtacaagacgttgatggggatcgaacgtgcgtttcaccaaatcaaaaacttcctggatgtcgggccgatctatcactggaatgagcagcgggttcgcgggcacatcttcgtctgcgtgctggcctacctcttcgagcaggagatgcaagtgctctatcgccgccaatgggcccacgacaaggcagtggcggaaagccttgcatgcgttgaagagcaggccaaggtgctagccgaactcgagtcgcggtggtacaccggcgaagccatcgtacgggagctgagacgctggaaagcggtgcgcgccacattcttggacaaggagttcgtcagtgtgaccaaagcgacggaccaggcgaaggccatcctcacgagcctgggcattccgacgccaaacaagaccttgtcggtgacgaaagtcccatccatgacgccggacgagtaa

SEQ ID NO: 2060 - protein, 522 aa, Desulfitobacterium hafniense
MFARIKTAYNRDGSPRRYLQLVESRREEGKVRQKVLCNLGRVEDLQNGKLDDLIRSLAKFSDTLAVVDAAEDLFADWSKEFGPSMVFRRLWENLGLHKILSGLFNERELSIDVQEAIFCMVLNRLTEPTSKLGVSDWKDSVYRPEFESLKLHHFYKAIDFLDENKESIEEQLFFHQTNLFTQQLDLVFFDTTSTYVEGDAGAFDLLEYGHSKDHRPDRLQVMIGILMSRDGIPIAHHVFPGNTPDTDAFIEAVRDLKKRFTIQRVIVVGDRGMMGKRTLELLEELELHYILGVRMRNIKAGPELAASPEPYTFLKDNLKVKEVLHQEKRYIVCLNEEEAKRDRLVREQIEMKLRSKLEHGSIKDLIGHSEYKKYINVTAEAATMNTDKLKQAAVFDGLYILQTNTELPTEEVATAYRDLWQIERAFRNLKSTLDVRPVYHWKERRISGHIMLCFLALVIQIRFQKLLENCASEYGYTEVIRALRKVHAVKLKLKDQDHLVRTEIHGAAAMAFRAVGLRIPER

SEQ ID NO: 2061 - protein, 522 aa, Desulfitobacterium hafniense
MFARIKTAYNRDGSPRRYLQLVESRREEGKVRQKVLCNLGRVEDLQNGKLDDLIRSLAKFSDTLAVVDAAEDLFADWSKEFGPSMVFRRLWENLGLHTILDGLFNERDLSIDVQEAIFCMVLNRLTEPTSKLGVSDWKDSVYRPEFESLKLHHFYKAIDFLDENKDTLEEQLFFHHTNLFTQQLDLVFFDTTSTYVEGDAGAFDLLEYGHSKDHRPDRLQVMIGLLMSRDGIPIAHHVFPGNTSDTDAFIEAVSDLKKRFTIQRVIVVGDRGMMGKRTLELLEELQLHYILGVRMRNVKAGPELATSPEPYVFTKDNLKVKEVLHQGKRYIVCLNEEEAKRDQWVREQIEVKLRSKLEHGSIKDLIGHSEYKKYLNVSAEAATINTDKLKQAAVFDGLYILQTNTELPTEEVATAYRDLWQIERAFRNLKSTLDLRPVYHWKERRISGHIMLCFLALVVQIRFQKLLENCASEYGYTEVIRALRKVHAVKLKLKDQDHLVRTEIHGAAAMAFRAVGLRVPER

SEQ ID NO: 2062 - protein, 522 aa, Desulfitobacterium hafniense
MFARIKTAYNRDGSPRRYLQLVESRREEGKVRQKVLCNLGRVEDLQNGKLDDLIRSLAKFSDTLAVVDAAEDLFADWSKEFGPSMVFRRLWENLGLHKIFAGLFNERDLSIDVQEAIFCMVLNRLTEPTSKLGVSDWKDSVYRPEFESLKLHHFYRAIDFLDENKDTLEEQLFFHHTNLFTQQLDLVFFDTTSTYVQGDAGAFDLLEYGHSKDHRPDRLQVMIGILMSRDGIPIAHHVFPGNTPDTDAFIEAVSDLKKRFTIQRVIVVGDRGMMGKRTLELLEELQLHYILGVRMRNIKAGPELAASAQPYPFVKDNLKVKEVLHQEKRYIVCLNEEEAKRDQLVREHIEMKLRSKLEHGGIKDLIGHSEYKKYINVTAEAATINTDKLKQAAVFDGLYILQTNTELPTEEVATAYRDLWQIERAFRNLKSTLDLRPVYHWKERRISGHIMLCFLALVIQIRFQKLLENCASEYGYTEVIRALRKVHAVKLKLKDQDHLVRTEIHGAAAMAFKAVGLRIPER

SEQ ID NO: 2063 - protein, 522 aa, Desulfitobacterium hafniense
MFARIKTAYNRDGSPRRYLQIVESRREEGKVRQKVLCNLGRVEDLQNGKLDDLIRSLAKFSDKLAVVDAAEDLFADWSKEYGPSMVFNRLWDNLGLHKILDGLFSERELSIDVREAIFCMVLNRLTEPTSKLGVSDWKDSVYRPDFETLKLHHFYKAIDFLDENKDTIEEQLFFHHTNLFTQQLDLVFFDTTSTYVEGDAGAFDLLEYGHSKDHRPDRLQVMIGILMSRDGIPIAHHVFPGNTPDTDAFIEAVSDLKKRFNIQRVIVVGDRGMMGKRTLELLEELQLQYILGVRMRNIKAGPDLANSPEPYAFIKDNLKVKEVVHQEKRYIVCLNEEEAKRDQLVREQIEIKLRSKLEHGSIKDLIGNSEYKKYINVTAEAATINTDKLKQAAVFDGLYILQTNTELPTEEVATAYRDLWQIERAFRNLKSTLDLRPVYHWKERRISGHIMLCFLALVVQIKFQKLLESCGSEYGYTEVIRALRKVHAVKLKIKDQDHLVRTEIHGAAAMAFKAVGLRIPER

SEQ ID NO: 2064 - protein, 433 aa, Desulfitobacterium hafniense
LWDNLGLHKILDGLFSERELSIDVREAIFWMVLNRLTEPTSKLGVSDWKDSVYRPDFETLKLHHFYKAIDFLDENKDTIEEQLFFHHTNLFTQQLDLVFFDTTSTYVEGDAGAFDLLEYGHSKDHRPDRLQVMIGILMSRDGIPIAHHVFPGNTPDTDAFIEAVSDLKKRFNIQRVIVVGDRGMMGKRTLELLEELQLQYILGVRMRNIKAGPDLANSPEPYAFIKDNLKVKEVVHQEKRYIVCLNEEEAKRDQLVREQIEIKLRSKLEHGSIKDLIGNSEYKKYINVTAEAATINTDKLKQAAVFDGLYILQTNTELPTEEVATAYRDLWQIERAFRNLKSTLDLRPVYHWKERRISGHIMLCFLALVVQIKFQKLLESCGSEYGYTEVIRALRKVHAVKLKIKDQDHLVRTEIHGAAAMAFKAVGLRIPER

SEQ ID NO: 2065 - protein, 599 aa, Artificial
  Alicyclobacillus acidocaldarius mutated SEQ ID NO 2058
MILLFAQIVSTKKPDGKTYKYLHIVESYREGRTVKKRKVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGGHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAITKEALRDGKFLIRTNTDLPAADVVQSYKTLMGIERAFHQIKNFLDVGPIYHWNEQRVRGHIFVCVLAYLFEQEMQVLYRRQWAHDKAVAESLACVEEQAKVLAELESRWYTGEAIVRELRRWKAVRATFLDKEFVSVTKATDQAKAILTSLGIPTPNKTLSVTKVPSMTPDE

SEQ ID NO: 2066 - protein, 599 aa, Artificial
  Alicyclobacillus acidocaldarius mutated SEQ ID NO 2058
MILLFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGGHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAITKEALRDGKFLIRTNTDLPAADVVQSYKTLMGIERAFHQIKNFLDVGPIYHWNEQRVRGHIFVCVLAYLFEQEMQVLYRRQWAHDKAVAESLACVEEQAKVLAELESRWYTGEAIVRDLRRWKAVRATFLDKEFVSVTKATDQAKAILTSLGIPTPNKTLSVTKVPSMTPDE

SEQ ID NO: 2067 - protein, 599 aa, Artificial
  Alicyclobacillus acidocaldarius mutated SEQ ID NO 2058
MILLFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARITDLLNFRLSLVLYDLTSTHLHGHACPLGGHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAITKEALRDGKFLIRTNTDLPAADVVQSYKTLMGIERAFHQIKNFLDVGPIYHWNEQRVRGHIFVCVLAYLFEQEMQVLYRRQWAHDKAVAESLACVEEQAKVLAELESRWYTGEAIVRELRRWKAVRATFLDKEFVSVTKATDQAKAILTSLGIPTPNKTLSVTKVPSMTPDE

SEQ ID NO: 2068 - protein, 599 aa, Artificial
  Alicyclobacillus acidocaldarius mutated SEQ ID NO 2058
MILLFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGGHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHDLKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAITKEALRDGKFLIRTNTDLPAADVVQSYKTLMGIERAFHQIKNFLDVGPIYHWNEQRVRGHIFVCVLAYLFEQEMQVLYRRQWAHDKAVAESLACVEEQAKVLAELESRWYTGEAIVRELRRWKAVRATFLDKEFVSVTKATDQAKAILTSLGIPTPNKTLSVTKVPSMTPDE

SEQ ID NO: 2069 - protein, 599 aa, Artificial
  Alicyclobacillus acidocaldarius mutated SEQ ID NO 2058
MILLFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGGHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAITKEALRDGKFLIRTNTDLPAADVVQSYKTLMGIERAFHQIKNFLDVGPIYHWNEQRVRGHIFVCVLAYLFEQEMQVLYRKQWAHDKAVAESLACVEEQAKVLAELESRWYTGEAIVRELRRWKAVRATFLDKEFVSVTKATDQAKAILTSLGIPTPNKTLSVTKVPSMTPDE

SEQ ID NO: 2070 - DNA, 1800 bp, Artificial
  Alicyclobacillus acidocaldarius mutated SEQ ID NO 2059
gtgatcctcttgttcgcgcaaattgtatccacaaagaagcccgacggtaagacctacaagtatctccacatcgttgagtcctaccgtgaaggtcggacggtcaagaagcggaaagtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagggcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgccatcaccaaggaagcactgcgcgacggaaagttcctgattcgaaccaatacggatttgcctgcagccgacgtggtccaatcgtacaagacgttgatggggatcgaacgtgcgtttcaccaaatcaaaaacttcctggatgtcgggccgatctatcactggaatgagcagcgggttcgcgggcacatcttcgtctgcgtgctggcctacctcttcgagcaggagatgcaagtgctctatcgccgccaatgggcccacgacaaggcagtggcggaaagccttgcatgcgttgaagagcaggccaaggtgctagccgaactcgagtcgcggtggtacaccggcgaagccatcgtacgggagctgagacgctggaaagcggtgcgcgccacattcttggacaaggagttcgtcagtgtgaccaaagcgacggaccaggcgaaggccatcctcacgagcctgggcattccgacgccaaacaagaccttgtcggtgacgaaagtcccatccatgacgccggacgagtaa

SEQ ID NO: 2071 - DNA, 1800 bp, Artificial
  Alicyclobacillus acidocaldarius mutated SEQ ID NO 2059
gtgatcctcttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagggcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgccatcaccaaggaagcactgcgcgacggaaagttcctgattcgaaccaatacggatttgcctgcagccgacgtggtccaatcgtacaagacgttgatggggatcgaacgtgcgtttcaccaaatcaaaaacttcctggatgtcgggccgatctatcactggaatgagcagcgggttcgcgggcacatcttcgtctgcgtgctggcctacctcttcgagcaggagatgcaagtgctctatcgccgccaatgggcccacgacaaggcagtggcggaaagccttgcatgcgttgaagagcaggccaaggtgctagccgaactcgagtcgcggtggtacaccggcgaagccatcgtacgggatctgagacgctggaaagcggtgcgcgccacattcttggacaaggagttcgtcagtgtgaccaaagcgacggaccaggcgaaggccatcctcacgagcctgggcattccgacgccaaacaagaccttgtcggtgacgaaagtcccatccatgacgccggacgagtaa

SEQ ID NO: 2072 - DNA, 1800 bp, Artificial
  Alicyclobacillus acidocaldarius mutated SEQ ID NO 2059
gtgatcctcttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgaattacagacttgctgaacttcaggctctcgttggttctgtacgacttgaccagcactcatctccacgggcacgcctgtcccttaggagggcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgccatcaccaaggaagcactgcgcgacggaaagttcctgattcgaaccaatacggatttgcctgcagccgacgtggtccaatcgtacaagacgttgatggggatcgaacgtgcgtttcaccaaatcaaaaacttcctggatgtcgggccgatctatcactggaatgagcagcgggttcgcgggcacatcttcgtctgcgtgctggcctacctcttcgagcaggagatgcaagtgctctatcgccgccaatgggcccacgacaaggcagtggcggaaagccttgcatgcgttgaagagcaggccaaggtgctagccgaactcgagtcgcggtggtacaccggcgaagccatcgtacgggagctgagacgctggaaagcggtgcgcgccacattcttggacaaggagttcgtcagtgtgaccaaagcgacggaccaggcgaaggccatcctcacgagcctgggcattccgacgccaaacaagaccttgtcggtgacgaaagtcccatccatgacgccggacgagtaa

SEQ ID NO: 2073 - DNA, 1800 bp, Artificial
  Alicyclobacillus acidocaldarius mutated SEQ ID NO 2059
gtgatcctcttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagggcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgatctgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgccatcaccaaggaagcactgcgcgacggaaagttcctgattcgaaccaatacggatttgcctgcagccgacgtggtccaatcgtacaagacgttgatggggatcgaacgtgcgtttcaccaaatcaaaaacttcctggatgtcgggccgatctatcactggaatgagcagcgggttcgcgggcacatcttcgtctgcgtgctggcctacctcttcgagcaggagatgcaagtgctctatcgccgccaatgggcccacgacaaggcagtggcggaaagccttgcatgcgttgaagagcaggccaaggtgctagccgaactcgagtcgcggtggtacaccggcgaagccatcgtacgggagctgagacgctggaaagcggtgcgcgccacattcttggacaaggagttcgtcagtgtgaccaaagcgacggaccaggcgaaggccatcctcacgagcctgggcattccgacgccaaacaagaccttgtcggtgacgaaagtcccatccatgacgccggacgagtaa

SEQ ID NO: 2074 - DNA, 1800 bp, Artificial
  Alicyclobacillus acidocaldarius mutated SEQ ID NO 2059
gtgatcctcttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagggcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgccatcaccaaggaagcactgcgcgacggaaagttcctgattcgaaccaatacggatttgcctgcagccgacgtggtccaatcgtacaagacgttgatggggatcgaacgtgcgtttcaccaaatcaaaaacttcctggatgtcgggccgatctatcactggaatgagcagcgggttcgcgggcacatcttcgtctgcgtgctggcctacctcttcgagcaggagatgcaagtgctctatcgcaaacaatgggcccacgacaaggcagtggcggaaagccttgcatgcgttgaagagcaggccaaggtgctagccgaactcgagtcgcggtggtacaccggcgaagccatcgtacgggagctgagacgctggaaagcggtgcgcgccacattcttggacaaggagttcgtcagtgtgaccaaagcgacggaccaggcgaaggccatcctcacgagcctgggcattccgacgccaaacaagaccttgtcggtgacgaaagtcccatccatgacgccggacgagtaa

SEQ ID NO: 2075 - protein, 485 aa, Alicyclobacillus acidocaldarius
MTERHLALYVRVSTEEQAASGHSLREQEEQLVEYARSHGFPRYELYCDDGYSGKSLNRPAMERLRADIRAGCVLGVVTTRIDRLTRSVADFARLVDEMNLHGVFYRSTRQNFEISTAMGRLVAQMLSVIAEFEREMIAERVHENLLAMAQRGELATKPPFGYRLVNGRLTPDPREARWVREGARLLLTGASPRDVAMEFNALGVRTKTGRLWTDRTVRTLFSNPALAGVSVWNRRKTQGSRRTEREPTEWVCVEGAHEAILSREEFEALRGMLERRRALSPRSQGSKRPLAGIARCGFCGSAMYAGWQVSKRGHERQKRPIYRCGRYVTGGGCTPNQVDASALEMLVVEELLRRVRPELEPVVSAYRAHAASNELRTVQRKRRVALARLSRLAEAYASGVVSEEAFSREQVRLLRVLEACREAEAQAAALSTTDGWDAWVRELCARLAGDPHLERALFLTVVREVRVFRPKRSREVDVDLVLRLE

SEQ ID NO: 2076 - DNA, 1458 bp, Alicyclobacillus acidocaldarius
gtgaccgagcggcacctggcgctctacgtgcgggtttcgacggaggagcaggccgcgtcgggccacagcctgagggaacaagaggagcagctcgtcgaatatgcccggtcgcacggatttcctcggtacgaactgtattgcgacgacgggtactcggggaagtcgctcaaccgtccggcgatggagcgcctgcgcgccgacatccgggcgggatgcgtgctcggcgtggtgacgacgcgcatcgatcggctgacgcggagcgtcgcggacttcgcgcgccttgtcgacgagatgaacttgcatggcgttttttatcgctccacgaggcagaatttcgagatctcgacggcgatggggcgattggtggcgcagatgttgtccgtgatcgccgagtttgaacgcgagatgatcgcggagcgcgtgcacgaaaacctcctcgcgatggcgcagcgcggcgagcttgccacgaagccgccgttcggttatcggctggtcaacggtcgcttgacgccggatccgcgtgaggcccgatgggtgcgtgagggggcgcgccttctgttaaccggcgcgagcccgagggacgtcgccatggaattcaacgccctcggcgtgcggacgaagacggggcggctttggacggatcgcaccgtccgcacgctcttttccaacccggcgttggccggtgtctccgtttggaaccggcgcaagacgcagggcagtcggcgaaccgagcgcgaacccaccgagtgggtgtgcgtcgagggagcgcacgaggccattttgagccgcgaggaattcgaagccctgcgaggcatgctcgagcgacgccgcgcgctgtcgccgcgatcgcagggctcgaaacgcccgctcgccggcattgcgcgatgcggcttctgcggaagcgcgatgtacgcgggctggcaggtatcaaagcggggccatgagcgccaaaaacggcccatctatcgctgtgggcgatacgtcaccggtgggggctgcacgcccaatcaggtggacgccagcgcgctggagatgctggtggtggaagagcttcttcgccgcgttcggccggagctcgaaccggtggtgtcggcctatcgggcgcatgcggcgtcgaacgagttgcgcacggtgcagcggaagcgccgcgtcgccctggcgcgattgagccggctcgcggaagcctacgcgtcgggcgtggtgtccgaggaggcgttttcccgcgagcaggttcgtcttctgcgcgtgcttgaggcgtgtcgggaggcggaggcgcaagcggccgccctgtcgaccaccgacgggtgggacgcatgggtgagagagctgtgcgctcgattggctggcgatccgcatctggagcgcgccttgttcctgaccgtcgtgcgggaagtgcgggtgtttcgccccaagcggtctcgcgaggtggatgtcgacctcgtcctgcgcctcgagtga

SEQ ID NO: 2077 - protein, 412 aa, Geobacillus kaustophilus
ERSIALYCRVSTDEQAREGISLDEQQERLKAYCRAMGWSEEPLLFIDDGYSAKNLDRPELNRLLKEVKKGTISKILVTKLDRLSRRLLDLLKLIDMFQEHNVSFISISESFDTNTPSGRLTLQVLGAVAEFERERIRERVFENMLHAARQGKWLTQSPYGYRLQNKELVIYEPEAQIVRNVYDWYLNKGLGYYAIAKKLNEEGIPSRQKKEWSIRAIKLMLTNPVYKGTLFWNRMDSSKSKRVKKDDADWVVLEDACPAIIDQATWEQVQKRVNKKQMAPRAQTSPHLLGGLLKCGRCGSGMSIGWSGSAKNRYRVYRCSANKNKGTCTSKQYRADDVESWFKHGLLKLADSINSQMIPHLIQKAAENEESTIEQKIRTAKNRYKRKVEAYTAGLIELEDLNEEKKRMEQII

SEQ ID NO: 2078 - protein, 336 aa, Bacillus cereus
SSQFIALYCRVSTDDQAKEGVSLEEQQERLEAYCRAMGWGEDVVVYVEDGYSAKSTDRPHLKRLIEDVKAGEIKKIIVTKLDRMSRKLLDLLTLIDLFQEHDVSFVSISESFDTNTPSGRLTLQVLGAVAEFERERIRERVFENMYHAASKGKWLTQHPFGYRLENKELVTYENEAKIVRDIFIWYTQEGHGFYAIAKKLNLLGIPSRQNKQWSIRSVKLLLSNPVYKGTVVWNRKDRSKKKEQFKKEDEWVIQENAAPAIVTDELWNEAQKRMQTSTLAPRAQTSPHLLGGLLKCGKCGSGMSIGWSGSTKNRYRVYRCSANKNKGTCTSKQYKA

SEQ ID NO: 2079 - protein, 336 aa, Bacillus cereus
SSQFIALYCRVSTDDQAKEGVSLEEQQERLEAYCRAMGWGEDVVVYVEDGYSAKSTDRPHLKRLIEDVKAGEIKKIIVTKLDRMSRKLLDLLTLIDLFQEHDVSFVSISESFDTNTPSGRLTLQVLGAVAEFERERIRERVFENMYHAASKGKWLTQHPFGYRLENKELVIYENEAKIVRDIFIWYTQEGHGFYAIAKKLNLLGIPSRQNKQWSIRSVKLLLSNPVYKGTVVWNRKDRSKKKEQFKKEDEWVIQENAAPAIVTDELWNEAQKRMQTSTLAPRAQTSPHLLGGLLKCGKCGSGMSIGWSGSTKNRYRVYRCSANKNKGTCTSKQYKA

SEQ ID NO: 2080 - protein, 335 aa, Paenibacillus  JDR-2
RFVALYCRVSTDEQAREGVSLDEQVERLKAYCRAMGWSEQVQIYIDDGYSAKNLDRPELKRLLHAVKSGAVSRIMVTKLDRMSRRLLDLLNIIDLFQDHEVSFVSISESFDTNTPSGRLTLQVLGAVAEFERERIRERVFENMLHAATTGKWLTQSPYGYDLVDKSLVVNIVESQIVKRVYDMYLNEGLGFYSIAKRLNEEGVPSRHRKEWSIRAIKLMLTNPAYKGTLVWNRKDSSKTQRKDKDEAEWVSVEECLPVIIDQPMWDKVQQRINQPSNIAPRAKTSPHLLGGMLRCGNCGSGMSIGFSGSPNKRYRVYRCSANKNKGTCTSKQYRA

SEQ ID NO: 2081 - protein, 305 aa, Bacillus cereus
SKRKVAIYIRVSTEEQANEGFSLGAQEDYLKQYANTKGYEVYDIYIDDGYSGKDYNRPEIQRLFKDLYQEKFTGILVKSVDRISRRVSDVTKLIDDVLAPRKCYVLVSDNNLDSSTTGGTAFIQLLATFAEYERSMIVQRVKAGMSKRAELGYWNGGHVLGYDVKNKELKVNKEEAEVVRKIFHLRTEGKGYKSIALILNQQGFKTKRGRLFSIGTIKTILENPLYIGYCRWGRHKNWNVERRKGKTDEYKFVKGKHEPIVSEDLWKRVQGVNYAHKKSISKNRNFNGEFVLSGILRCPSCGAGM

SEQ ID NO: 2082 - protein, 485 aa, Artificial
  Alicyclobacillus acidocaldarius mutated SEQ ID NO 2075
MTERHLALYVRVSTEEQAASGHSLREQEEQLVEYARSHGFPRYELYCDDGYSGKSLNRPAMERLRADIRAGCVLGVVTTRIDRLTRSVADFARLVDEMNLHGVFYKSTRQNFEISTAMGRLVAQMLSVIAEFEREMIAERVHENLLAMAQRGELATKPPFGYRLVNGRLTPDPREARWVREGARLLLTGASPRDVAMEFNALGVRTKTGRLWTDRTVRTLFSNPALAGVSVWNRRKTQGSRRTEREPTEWVCVEGAHEAILSREEFEALRGMLERRRALSPRSQGSKRPLAGIARCGFCGSAMYAGWQVSKRGHERQKRPIYRCGRYVTGGGCTPNQVDASALEMLVVEELLRRVRPELEPVVSAYRAHAASNELRTVQRKRRVALARLSRLAEAYASGVVSEEAFSREQVRLLRVLEACREAEAQAAALSTTDGWDAWVRELCARLAGDPHLERALFLTVVREVRVFRPKRSREVDVDLVLRLE

SEQ ID NO: 2083 - protein, 485 aa, Artificial
  Alicyclobacillus acidocaldarius mutated SEQ ID NO 2075
MTERHLALYVRVSTEEQAASGHSLREQEEQLVEYARSHGFPRYELYCDDGYSGKSLNRPAMERLRADIRAGCVLGVVTTRIDRLTRSVADFARLVDEMNLHGVFYRSTRQNFEISTAMGRLVAQMLSVIAEFEREMIAERVHENLLAMAQRGELATKPPFGYRLVNGRLTPDPREARWVREGARLLLTGASPRDVAMEFNALGVRTKTGRLWTDRTVRTLFSNPALAGVSVWNRRKTQGSRRTEREPTEWVCVEGAHEAILSREEFEALRGMLEKRRALSPRSQGSKRPLAGIARCGFCGSAMYAGWQVSKRGHERQKRPIYRCGRYVTGGGCTPNQVDASALEMLVVEELLRRVRPELEPVVSAYRAHAASNELRTVQRKRRVALARLSRLAEAYASGVVSEEAFSREQVRLLRVLEACREAEAQAAALSTTDGWDAWVRELCARLAGDPHLERALFLTVVREVRVFRPKRSREVDVDLVLRLE

SEQ ID NO: 2084 - protein, 485 aa, Artificial
  Alicyclobacillus acidocaldarius mutated SEQ ID NO 2075
MTERHLALYVRVSTEEQAASGHSLREQEEQLVEYARSHGFPRYELYCDDGYSGKSLNRPAMERLRADIRAGCVLGVVTTRIDRLTRSVADFARLVDEMNLHGVFYRSTRQNFEISTAMGRLVAQMLSVIAEFEREMIAERVHENLLAMAQRGELATKPPFGYRLVNGRLTPDPREARWVREGARLLLTGASPRDVAMEFNALGVRTKTGRLWTDRTVRTLFSNPALAGVSVWNRRKTQGSRRTEREPTEWVCVEGAHEAILSREEFEALRGMLERRRALSPRSQGSKKPLAGIARCGFCGSAMYAGWQVSKRGHERQKRPIYRCGRYVTGGGCTPNQVDASALEMLVVEELLRRVRPELEPVVSAYRAHAASNELRTVQRKRRVALARLSRLAEAYASGVVSEEAFSREQVRLLRVLEACREAEAQAAALSTTDGWDAWVRELCARLAGDPHLERALFLTVVREVRVFRPKRSREVDVDLVLRLE

SEQ ID NO: 2085 - protein, 485 aa, Artificial
  Alicyclobacillus acidocaldarius mutated SEQ ID NO 2075
MTERHLALYVRVSTEEQAASGHSLREQEEQLVEYARSHGFPRYELYCDDGYSGKSLNRPAMERLRADIRAGCVLGVVTTRIDRLTRSVADFARLVDEMNLHGVFYRSTRQNFEISTAMGRLVAQMLSVIAEFEREMIAERVHENLLAMAQRGELATKPPFGYRLVNGRLTPEPREARWVREGARLLLTGASPRDVAMEFNALGVRTKTGRLWTDRTVRTLFSNPALAGVSVWNRRKTQGSRRTEREPTEWVCVEGAHEAILSREEFEALRGMLERRRALSPRSQGSKRPLAGIARCGFCGSAMYAGWQVSKRGHERQKRPIYRCGRYVTGGGCTPNQVDASALEMLVVEELLRRVRPELEPVVSAYRAHAASNELRTVQRKRRVALARLSRLAEAYASGVVSEEAFSREQVRLLRVLEACREAEAQAAALSTTDGWDAWVRELCARLAGDPHLERALFLTVVREVRVFRPKRSREVDVDLVLRLE

SEQ ID NO: 2086 - protein, 485 aa, Artificial
  Alicyclobacillus acidocaldarius mutated SEQ ID NO 2075
MTERHLALYVRVSTEEQAASGHSLREQEEQLVEYARSHGFPRYELYCDDGYSGKSLNRPAMERLRADIRAGCVLGVVTTRIDRLTRSVADFARLVDEMNLHGVFYRSTRQNFEISTAMGRLVAQMLSVIAEFEREMIAERVHENLLAMAQRGELATKPPFGYRLVNGRLTPDPREARWVREGARLLLTGASPRDVAMEFNALGVRTKTGRLWTDRTVRTLFSNPALAGVSVWNRRKTQGSRRTEREPTEWICVEGAHEAILSREEFEALRGMLERRRALSPRSQGSKRPLAGIARCGFCGSAMYAGWQVSKRGHERQKRPIYRCGRYVTGGGCTPNQVDASALEMLVVEELLRRVRPELEPVVSAYRAHAASNELRTVQRKRRVALARLSRLAEAYASGVVSEEAFSREQVRLLRVLEACREAEAQAAALSTTDGWDAWVRELCARLAGDPHLERALFLTVVREVRVFRPKRSREVDVDLVLRLE

SEQ ID NO: 2087 - DNA, 1458 bp, Artificial
  Alicyclobacillus acidocaldarius mutated SEQ ID NO 2076
gtgaccgagcggcacctggcgctctacgtgcgggtttcgacggaggagcaggccgcgtcgggccacagcctgagggaacaagaggagcagctcgtcgaatatgcccggtcgcacggatttcctcggtacgaactgtattgcgacgacgggtactcggggaagtcgctcaaccgtccggcgatggagcgcctgcgcgccgacatccgggcgggatgcgtgctcggcgtggtgacgacgcgcatcgatcggctgacgcggagcgtcgcggacttcgcgcgccttgtcgacgagatgaacttgcatggcgttttttataaatccacgaggcagaatttcgagatctcgacggcgatggggcgattggtggcgcagatgttgtccgtgatcgccgagtttgaacgcgagatgatcgcggagcgcgtgcacgaaaacctcctcgcgatggcgcagcgcggcgagcttgccacgaagccgccgttcggttatcggctggtcaacggtcgcttgacgccggatccgcgtgaggcccgatgggtgcgtgagggggcgcgccttctgttaaccggcgcgagcccgagggacgtcgccatggaattcaacgccctcggcgtgcggacgaagacggggcggctttggacggatcgcaccgtccgcacgctcttttccaacccggcgttggccggtgtctccgtttggaaccggcgcaagacgcagggcagtcggcgaaccgagcgcgaacccaccgagtgggtgtgcgtcgagggagcgcacgaggccattttgagccgcgaggaattcgaagccctgcgaggcatgctcgagcgacgccgcgcgctgtcgccgcgatcgcagggctcgaaacgcccgctcgccggcattgcgcgatgcggcttctgcggaagcgcgatgtacgcgggctggcaggtatcaaagcggggccatgagcgccaaaaacggcccatctatcgctgtgggcgatacgtcaccggtgggggctgcacgcccaatcaggtggacgccagcgcgctggagatgctggtggtggaagagcttcttcgccgcgttcggccggagctcgaaccggtggtgtcggcctatcgggcgcatgcggcgtcgaacgagttgcgcacggtgcagcggaagcgccgcgtcgccctggcgcgattgagccggctcgcggaagcctacgcgtcgggcgtggtgtccgaggaggcgttttcccgcgagcaggttcgtcttctgcgcgtgcttgaggcgtgtcgggaggcggaggcgcaagcggccgccctgtcgaccaccgacgggtgggacgcatgggtgagagagctgtgcgctcgattggctggcgatccgcatctggagcgcgccttgttcctgaccgtcgtgcgggaagtgcgggtgtttcgccccaagcggtctcgcgaggtggatgtcgacctcgtcctgcgcctcgagtga

SEQ ID NO: 2088 - DNA, 1458 bp, Artificial
  Alicyclobacillus acidocaldarius mutated SEQ ID NO 2076
gtgaccgagcggcacctggcgctctacgtgcgggtttcgacggaggagcaggccgcgtcgggccacagcctgagggaacaagaggagcagctcgtcgaatatgcccggtcgcacggatttcctcggtacgaactgtattgcgacgacgggtactcggggaagtcgctcaaccgtccggcgatggagcgcctgcgcgccgacatccgggcgggatgcgtgctcggcgtggtgacgacgcgcatcgatcggctgacgcggagcgtcgcggacttcgcgcgccttgtcgacgagatgaacttgcatggcgttttttatcgctccacgaggcagaatttcgagatctcgacggcgatggggcgattggtggcgcagatgttgtccgtgatcgccgagtttgaacgcgagatgatcgcggagcgcgtgcacgaaaacctcctcgcgatggcgcagcgcggcgagcttgccacgaagccgccgttcggttatcggctggtcaacggtcgcttgacgccggatccgcgtgaggcccgatgggtgcgtgagggggcgcgccttctgttaaccggcgcgagcccgagggacgtcgccatggaattcaacgccctcggcgtgcggacgaagacggggcggctttggacggatcgcaccgtccgcacgctcttttccaacccggcgttggccggtgtctccgtttggaaccggcgcaagacgcagggcagtcggcgaaccgagcgcgaacccaccgagtgggtgtgcgtcgagggagcgcacgaggccattttgagccgcgaggaattcgaagccctgcgaggcatgctcgagaaacgccgcgcgctgtcgccgcgatcgcagggctcgaaacgcccgctcgccggcattgcgcgatgcggcttctgcggaagcgcgatgtacgcgggctggcaggtatcaaagcggggccatgagcgccaaaaacggcccatctatcgctgtgggcgatacgtcaccggtgggggctgcacgcccaatcaggtggacgccagcgcgctggagatgctggtggtggaagagcttcttcgccgcgttcggccggagctcgaaccggtggtgtcggcctatcgggcgcatgcggcgtcgaacgagttgcgcacggtgcagcggaagcgccgcgtcgccctggcgcgattgagccggctcgcggaagcctacgcgtcgggcgtggtgtccgaggaggcgttttcccgcgagcaggttcgtcttctgcgcgtgcttgaggcgtgtcgggaggcggaggcgcaagcggccgccctgtcgaccaccgacgggtgggacgcatgggtgagagagctgtgcgctcgattggctggcgatccgcatctggagcgcgccttgttcctgaccgtcgtgcgggaagtgcgggtgtttcgccccaagcggtctcgcgaggtggatgtcgacctcgtcctgcgcctcgagtga

SEQ ID NO: 2089 - DNA, 1458 bp, Artificial
  Alicyclobacillus acidocaldarius mutated SEQ ID NO 2076
gtgaccgagcggcacctggcgctctacgtgcgggtttcgacggaggagcaggccgcgtcgggccacagcctgagggaacaagaggagcagctcgtcgaatatgcccggtcgcacggatttcctcggtacgaactgtattgcgacgacgggtactcggggaagtcgctcaaccgtccggcgatggagcgcctgcgcgccgacatccgggcgggatgcgtgctcggcgtggtgacgacgcgcatcgatcggctgacgcggagcgtcgcggacttcgcgcgccttgtcgacgagatgaacttgcatggcgttttttatcgctccacgaggcagaatttcgagatctcgacggcgatggggcgattggtggcgcagatgttgtccgtgatcgccgagtttgaacgcgagatgatcgcggagcgcgtgcacgaaaacctcctcgcgatggcgcagcgcggcgagcttgccacgaagccgccgttcggttatcggctggtcaacggtcgcttgacgccggatccgcgtgaggcccgatgggtgcgtgagggggcgcgccttctgttaaccggcgcgagcccgagggacgtcgccatggaattcaacgccctcggcgtgcggacgaagacggggcggctttggacggatcgcaccgtccgcacgctcttttccaacccggcgttggccggtgtctccgtttggaaccggcgcaagacgcagggcagtcggcgaaccgagcgcgaacccaccgagtgggtgtgcgtcgagggagcgcacgaggccattttgagccgcgaggaattcgaagccctgcgaggcatgctcgagcgacgccgcgcgctgtcgccgcgatcgcagggctcgaaaaaaccgctcgccggcattgcgcgatgcggcttctgcggaagcgcgatgtacgcgggctggcaggtatcaaagcggggccatgagcgccaaaaacggcccatctatcgctgtgggcgatacgtcaccggtgggggctgcacgcccaatcaggtggacgccagcgcgctggagatgctggtggtggaagagcttcttcgccgcgttcggccggagctcgaaccggtggtgtcggcctatcgggcgcatgcggcgtcgaacgagttgcgcacggtgcagcggaagcgccgcgtcgccctggcgcgattgagccggctcgcggaagcctacgcgtcgggcgtggtgtccgaggaggcgttttcccgcgagcaggttcgtcttctgcgcgtgcttgaggcgtgtcgggaggcggaggcgcaagcggccgccctgtcgaccaccgacgggtgggacgcatgggtgagagagctgtgcgctcgattggctggcgatccgcatctggagcgcgccttgttcctgaccgtcgtgcgggaagtgcgggtgtttcgccccaagcggtctcgcgaggtggatgtcgacctcgtcctgcgcctcgagtga

SEQ ID NO: 2090 - DNA, 1458 bp, Artificial
  Alicyclobacillus acidocaldarius mutated SEQ ID NO 2076
gtgaccgagcggcacctggcgctctacgtgcgggtttcgacggaggagcaggccgcgtcgggccacagcctgagggaacaagaggagcagctcgtcgaatatgcccggtcgcacggatttcctcggtacgaactgtattgcgacgacgggtactcggggaagtcgctcaaccgtccggcgatggagcgcctgcgcgccgacatccgggcgggatgcgtgctcggcgtggtgacgacgcgcatcgatcggctgacgcggagcgtcgcggacttcgcgcgccttgtcgacgagatgaacttgcatggcgttttttatcgctccacgaggcagaatttcgagatctcgacggcgatggggcgattggtggcgcagatgttgtccgtgatcgccgagtttgaacgcgagatgatcgcggagcgcgtgcacgaaaacctcctcgcgatggcgcagcgcggcgagcttgccacgaagccgccgttcggttatcggctggtcaacggtcgcttgacgccggaaccgcgtgaggcccgatgggtgcgtgagggggcgcgccttctgttaaccggcgcgagcccgagggacgtcgccatggaattcaacgccctcggcgtgcggacgaagacggggcggctttggacggatcgcaccgtccgcacgctcttttccaacccggcgttggccggtgtctccgtttggaaccggcgcaagacgcagggcagtcggcgaaccgagcgcgaacccaccgagtgggtgtgcgtcgagggagcgcacgaggccattttgagccgcgaggaattcgaagccctgcgaggcatgctcgagcgacgccgcgcgctgtcgccgcgatcgcagggctcgaaacgcccgctcgccggcattgcgcgatgcggcttctgcggaagcgcgatgtacgcgggctggcaggtatcaaagcggggccatgagcgccaaaaacggcccatctatcgctgtgggcgatacgtcaccggtgggggctgcacgcccaatcaggtggacgccagcgcgctggagatgctggtggtggaagagcttcttcgccgcgttcggccggagctcgaaccggtggtgtcggcctatcgggcgcatgcggcgtcgaacgagttgcgcacggtgcagcggaagcgccgcgtcgccctggcgcgattgagccggctcgcggaagcctacgcgtcgggcgtggtgtccgaggaggcgttttcccgcgagcaggttcgtcttctgcgcgtgcttgaggcgtgtcgggaggcggaggcgcaagcggccgccctgtcgaccaccgacgggtgggacgcatgggtgagagagctgtgcgctcgattggctggcgatccgcatctggagcgcgccttgttcctgaccgtcgtgcgggaagtgcgggtgtttcgccccaagcggtctcgcgaggtggatgtcgacctcgtcctgcgcctcgagtga

SEQ ID NO: 2091 - DNA, 1458 bp, Artificial
  Alicyclobacillus acidocaldarius mutated SEQ ID NO 2076
gtgaccgagcggcacctggcgctctacgtgcgggtttcgacggaggagcaggccgcgtcgggccacagcctgagggaacaagaggagcagctcgtcgaatatgcccggtcgcacggatttcctcggtacgaactgtattgcgacgacgggtactcggggaagtcgctcaaccgtccggcgatggagcgcctgcgcgccgacatccgggcgggatgcgtgctcggcgtggtgacgacgcgcatcgatcggctgacgcggagcgtcgcggacttcgcgcgccttgtcgacgagatgaacttgcatggcgttttttatcgctccacgaggcagaatttcgagatctcgacggcgatggggcgattggtggcgcagatgttgtccgtgatcgccgagtttgaacgcgagatgatcgcggagcgcgtgcacgaaaacctcctcgcgatggcgcagcgcggcgagcttgccacgaagccgccgttcggttatcggctggtcaacggtcgcttgacgccggatccgcgtgaggcccgatgggtgcgtgagggggcgcgccttctgttaaccggcgcgagcccgagggacgtcgccatggaattcaacgccctcggcgtgcggacgaagacggggcggctttggacggatcgcaccgtccgcacgctcttttccaacccggcgttggccggtgtctccgtttggaaccggcgcaagacgcagggcagtcggcgaaccgagcgcgaacccaccgagtggatttgcgtcgagggagcgcacgaggccattttgagccgcgaggaattcgaagccctgcgaggcatgctcgagcgacgccgcgcgctgtcgccgcgatcgcagggctcgaaacgcccgctcgccggcattgcgcgatgcggcttctgcggaagcgcgatgtacgcgggctggcaggtatcaaagcggggccatgagcgccaaaaacggcccatctatcgctgtgggcgatacgtcaccggtgggggctgcacgcccaatcaggtggacgccagcgcgctggagatgctggtggtggaagagcttcttcgccgcgttcggccggagctcgaaccggtggtgtcggcctatcgggcgcatgcggcgtcgaacgagttgcgcacggtgcagcggaagcgccgcgtcgccctggcgcgattgagccggctcgcggaagcctacgcgtcgggcgtggtgtccgaggaggcgttttcccgcgagcaggttcgtcttctgcgcgtgcttgaggcgtgtcgggaggcggaggcgcaagcggccgccctgtcgaccaccgacgggtgggacgcatgggtgagagagctgtgcgctcgattggctggcgatccgcatctggagcgcgccttgttcctgaccgtcgtgcgggaagtgcgggtgtttcgccccaagcggtctcgcgaggtggatgtcgacctcgtcctgcgcctcgagtga

SEQ ID NO: 2092 - protein, 678 aa, Alicyclobacillus acidocaldarius
MSLRSLSVRALPGVGPQKERALEALGIRTVDDLLHTYPFRYDERAEKPFSEWRDGDRVTARAVVEGPVQVRWRGSKSIMTARVRVDGQHPVVCLWFSQHYLRSKLSDGRFIVVTGKWNEALRRLVASETSFDAGTQAPSLVPVYRASKELSTKAIHQLILKALEQYAEEIQESLPYALVRKYRLWTHRDALFGMHRPKSLEDVRQARRRLVFEEFLLFQIQLQWLRAKREEPAGRAQPVPSDALTAFEALLPGPMTNAQRRACEDILRDLQRPVPMTRLIQGDVGSGKTWVALFACFAVHLARGQSALMAPTEILAEQHARLAHELLGSAGVRVELLTGSVTGRERDRVLAGLASGDVSLAVGTHALLSEGVEFRDLALLVTDEQHRFGVAQRARLREKGRAPDVLMLSATPIPRTLALAIYGDMDVSILNELPKGRKPVQTIAVPSKDDETVLRLIRRELARGHQAYIVAPAIEASERDDVASVTELYERVREHLAGFRVELLHGRMPSADKERMMRAFRDGDIHALVATTVIEVGIDVPNATVMAIYGAERFGLAQLHQLRGRVGRGPHPSYCLLIHDASSEAARARIETMLQTNDGFEIAERDLELRGPGELFGLRQSGLPEFALGDLARDYRIMEVAREEALALLRRDDFWYAPWAEGLRNALKEAMDKVSYRD

SEQ ID NO: 2093 - DNA, 2037 bp, Alicyclobacillus acidocaldarius
ttgtcgctcagatcgctgtccgtgcgcgcgctgccgggcgtgggtccgcagaaggagcgagcactcgaagcgctcggcattcgaacggtcgacgacttgctgcacacgtatccgtttcgatatgacgagcgagcggagaagccattttccgaatggcgcgatggcgatcgcgtcacggcgcgggctgtcgtcgaaggacctgtgcaagtcaggtggcgcggttccaagtccatcatgacggcgcgcgtgcgcgtggacggccaacatccggtcgtctgcctctggttttcgcaacattaccttcgctccaagctatccgacgggcggttcatcgtggtaacaggcaaatggaatgaagctctgcgccgcctggtcgccagcgagacatcgtttgacgccgggacacaggcgccctcgttggtaccggtataccgcgcgagcaaagaactctcgacgaaggccatccaccaactcatcctgaaggcgttggagcaatacgcggaagagatccaggagtcgctgccgtacgcgctcgtgcgcaagtatcggctttggacgcatcgagatgcgctcttcgggatgcatcggcccaaatcgctcgaggacgtccgtcaggcccggcggcggctggtgttcgaggagtttctcttgtttcaaattcagctccagtggcttcgcgcaaagcgcgaggagcccgcggggcgcgcgcagcccgtgccgagtgatgcgctgacggcgttcgaggccctcctgcccggtccgatgacgaacgcgcagcggcgcgcgtgcgaggacatcctgcgggatcttcagcgccccgtgcccatgacgcgcctgattcagggggacgtcggatcgggcaagacgtgggtggccctttttgcgtgctttgcggtccacctcgcgcgcggacagtccgcgctcatggcgcccaccgaaatcctcgccgagcagcacgcgaggctcgcgcacgagctgctcggctctgccggcgttcgcgtcgagcttttgacgggttcggtgacaggacgcgagcgcgatcgcgtgctggcgggcctcgcctccggggacgtgtcgcttgccgtcggcacgcacgcgcttctgtccgagggtgtcgagtttcgcgatctcgccctgctcgtcaccgatgagcagcatcgcttcggcgtcgcgcagcgcgcgaggctgcgtgagaagggccgcgccccggacgtgctcatgctgtcggcgacgccgattccgcggacgcttgcgctcgccatctacggcgacatggacgtgtccatcctgaacgagttgccgaagggccgaaagcccgttcagaccatcgccgtgccgtcgaaagacgacgagaccgttcttcgcctcatccgcagagagttggcgcggggacaccaggcctacatcgtcgcgccggccatcgaggcgtcggagcgagacgacgtggcgtccgtgacggagctttatgagcgcgtgcgcgaacacctggcgggatttcgcgtcgaactcctgcacgggcggatgccaagcgccgacaaggagcgcatgatgcgcgcgttccgcgacggcgacatccacgcgctcgtcgcgacgaccgtgatcgaggtcggcatcgacgtgcccaatgccaccgtgatggccatctatggcgcggagcggttcggtttggcgcaattgcatcagcttcgcgggcgagtcggacgagggccgcatccgagctactgcctgctcattcacgacgcatcgtccgaggcggcgcgcgcgcgaatcgagaccatgctgcagacgaacgacgggtttgagatcgcggagcgggacctggaattgcgcgggcctggggagttgttcggcctgaggcagagcggtcttcccgagttcgcgttgggcgatctcgcccgcgattatcggatcatggaggtcgcaagggaagaggcgctggcgctccttcggcgggacgatttttggtacgctccgtgggccgagggtctgcgcaacgcgctgaaggaggccatggacaaggtttcgtatcgagactga

SEQ ID NO: 2094 - protein, 663 aa, Geobacillus thermodenitrificans
VTAVKGIGEETAAALADLGITTVGELLNYAPYRYDDYEQKDLAAVRHEEKVTVEGKVHSAPLLTYYGKKKSRLSFRLLTGRYLITVVCFNRPYLKGKITLNETVTVIGKWDRHRQTINAYELRFGAAPEATGIEPVYSVRSPLTVKTMRRLIKAAFAQFGMHIPDLLPPALRRAYRLIDKQEAVRALHFPRSREELHQARRRLVYEEFLLYQLKMQALRKVMRDERRGIIHSFPEEQLASFLSGLPFSLTNAQRRVIREILDDMRAPRQMNRLLQGDVGSGKTVVAAVALYAAVLSGFQGALMVPTEILAEQHVRSLAELFADTGVTVELLTSSVKGKRRKELLAKLEDGTVDIVIGTHALIQEGVQFRQLGLVITDEQHRFGVEQRRVLREKGHAPDVLMMTATPIPRTLAITAFGDMDVSVLDEMPAGRKKVETYWVKHNQFARVLDFIEKELRRGHQAYVICPLIEESEKLDVQNAIDVHSQLVYYYRGKYEVGLMHGRLSADEKEAVMRAFSENRIHVLVSTTVVEVGVNVPNATVMVIYDAERFGLAQLHQLRGRVGRGDAQSYCILIADPKSEIGKERMHIMTETTDGFVLAEKDLELRGPGDFFGTKQSGLPEFQFGDPVHDYRILEVARRDAAKLVSSAAFWRDEAYAGLRAELE

SEQ ID NO: 2095 - protein, 669 aa, Paenibacillus  JDR-2
MTLEQYSVRQIKGVSAPKEEELHAFGVHTVADLLDYFPFRYEDYRIRELAEIKDGEKVTVQGTIRGNGILQRYGKNKSRLTCKIEVDHMLVTAVWFNRHFLQGQLTPGREIMLTGKWEQQRLQMTVSESEFADKSTGMVKSGTLQPVYSVGGGITQAWMRKTIKQALLQYGSMIEEVLPHELVERHGLMARRDAVQRIHDPEEVKEGLEARRRMVYEELFLFQLKLQAYRSLTRKRGDGIVHQVNGETIRNFAATLPFELTDGQKKVVNEIMSDMRQPAAMNRLLQGDVGSGKTVVAAIALYCTIKAGHQGALMVPTEILAEQHLRSLQKLFADTGIEVALLTGSLTEKKRRDVLAGLQMGMIDILVGTHALIQDDVFFRSLGLVVTDEQHRFGVNQRSILRRKGMNPDVLTMTATPIPRTLAITAFGDMDVSTIKERPHGRKPIKTYWVKHDMMERVLGFIRREVGEGRQAYVICPLIEESDKLDVQNAIDLYVQMQQAFPDLKVGLLHGRLSASEKDEVMRGFGANETQLLVATTVVEVGVDVPNATLIIIMDAERFGLSQLHQLRGRVGRGAHQSFCVLVADPKSENGRERMKVMTETNDGFEVSRRDLELRGPGDFFGTKQSGLPEFKIADMAAEYEMLELARDDAAELTGRDDFWTNPLFERMR

SEQ ID NO: 2096 - protein, 670 aa, Paenibacillus larvae
MDLNQIPVTRVSGVGPQKAEDLAALGIHTAAQLIAYFPFRYEDYRLRDLSEVKDGERITVQGNLIGAPVLQRYGRKSRLSCKVVIDHFFVTAVWFNRPFLKDKLASGKEIRLTGKWDARRKQLTVSESEFPGNDSLTGTLQPVYSLTGSLTQKSIRKMIQQALKQFGNLIQEVLPADFVKRYQLLPRKQAVALIHQPSGLEDGKQARRRMVYEELFFFQLKMHAFKAITRKRADGLAQQVDLPKIRSFVKSLPFELTPSQKQVVGEILHDMQQPYTMNRLLKGDVGAGKTVVAATALYATVTAGCQGALMVPTEILAEQHKKSLSRMFKPYGIETALLTGSSTDKKRREILAGVQMGLIQVLIGTHALIQEDVFFRKLGLVVTDEQHRFGVSQRSILRRKGMNPDVLSMTATPIPRTLAITAFGDLDVSTLREMPKGRKPIKTYWVHHDMLERVLGFIQKEAAGGRQAYVICPLIEESDKLDVQNAIDVHVQLQQHFPDLNIGLLHGRMTAAEKDDTMRSFKDGSIQVLVSTTVIEVGVDVPNATLMVVYDADRFGLSQLHQLRGRVGRGEHQSFCVLIADPKTEVGKERMQAMTETTDGFEIARRDLELRGPGDFFGTKQSGLPEFRIADLMCDFEIMEIARDDAADLVAKPEFWTAAEYVPLRQFLQK

SEQ ID NO: 2097 - protein, 663 aa, Geobacillus kaustophilus
VTAVKGIGEETAAALADIGIATVGELLAYAPYRYDDYEQKDLAAVRHEEKVTVEGKVYSAPLLTYYGKKKSRLSFRMLADRYLITVVCFNRPYLKEKIALNETVTVIGKWDRHRQTINAYELRFGPAPETTGIEPVYSVRSPLTVKTMRRLMKAAFEQFGEHIPDPLPPALRRAYRLVDKQEALRALHFPRTREELHQARRRLIYEEFLLYQLKMQALRRLMRDERRGVVHSFSEERLSSFLSGLPFVLTNAQRRVIGEILADMRSPRQMNRLLQGDVGSGKTVVAAVALYAAALSGFQGALMVPTEILAEQHARSLAELFADTDVTIALLTSSVKGKQRKAVLAELEEGTIDIVVGTHALIQEGVQFRRLGLVITDEQHRFGVEQRRVLREKGHAPDVLMMTATPIPRTLAITAFGDMDVSVLDEMPAGRKKVETYWVKHHQFSRVLDFIEKELRRGHQAYVICPLIEESDKLDVQNAIDVHSQLVHYYRGKYEIGLMHGRLSADEKERVMRAFSENRIHVLVSTTVVEVGVNVPNATVMVIYDAERFGLAQLHQLRGRVGRGDAQSYCILIADPKSEVGKERMRIMTETADGFVLAEKDLELRGPGDFFGTKQSGLPEFRYGDPVHDYRILEVARRDAAKLVSSAAFWRDEAYAGLRAELE

SEQ ID NO: 2098 - protein, 672 aa, Enterococcus faecalis
VSVLPGVGPKRAENLQELGIATIEDLLTYYPFRYDDIQEKDLSEIQDQEKVTLKGLVVSEAVVSRYGYKKSRLTFRMMQEHAVINVSFFNQPFLKDKVVLSEEIAVYGKWDAKRKSLNGMKILASKGDNEDFAPIYHVNKKVRQSTLVQLIRTAFEEYGSLVEEILPNDLLEKYRLMPRKEAMWAMHFPSNPEESHQAKRRVVFEEFFLFQLKMQGLKKQEKAEKNGLAIQYDVDRLKTFTQGLPFELTGAQKKVTNEICRDLRSPKHMQRLLQGDVGSGKTVVAAIALYATMTAGFQGALMVPTEILAQQHMESLQQLFDPLEVRTALLTGSTKTKERRLILEELANGEIDIVVGTHALIQQDVSFHQLGLVITDEQHRFGVNQRKILREKGLKPDVLFMTATPIPRTLAITAYGEMDVSIIDEMPAGRIPIETRWIRPPQLDTVLEWMEKELARGHQAYIICPLIEESEALDVKNATEIFEHMQSFYSPRYQVGLLHGKMKNQEKDDIMQEFKDNQLQLLVSTTVIEVGVNVPNATVMLIMDADRFGLAQLHQLRGRVGRGSSASYCILVANPKNEMGVERMKIMTETTNGFVLSERDLELRGPGEVFGARQSGVPQFAVGDIVTDFNILEVARQEASALWKVKEWWQYPAYQGLANRVKPQDEAAQFFD

SEQ ID NO: 2099 - protein, 678 aa, Artificial
  Alicyclobacillus acidocaldarius mutated SEQ ID NO 2092
MSLRSLSVRALPGVGPQKERALEALGIRTVDDLLHTYPFRYDERAEKPFSEWRDGDRVTARAVVEGPVQVRWRGSKSIMTARVRVDGQHPVVCLWFSQHYLRSKLSDGRFIVVTGKWNEALRRLVASETSFEAGTQAPSLVPVYRASKELSTKAIHQLILKALEQYAEEIQESLPYALVRKYRLWTHRDALFGMHRPKSLEDVRQARRRLVFEEFLLFQIQLQWLRAKREEPAGRAQPVPSDALTAFEALLPGPMTNAQRRACEDILRDLQRPVPMTRLIQGDVGSGKTWVALFACFAVHLARGQSALMAPTEILAEQHARLAHELLGSAGVRVELLTGSVTGRERDRVLAGLASGDVSLAVGTHALLSEGVEFRDLALLVTDEQHRFGVAQRARLREKGRAPDVLMLSATPIPRTLALAIYGDMDVSILNELPKGRKPVQTIAVPSKDDETVLRLIRRELARGHQAYIVAPAIEASERDDVASVTELYERVREHLAGFRVELLHGRMPSADKERMMRAFRDGDIHALVATTVIEVGIDVPNATVMAIYGAERFGLAQLHQLRGRVGRGPHPSYCLLIHDASSEAARARIETMLQTNDGFEIAERDLELRGPGELFGLRQSGLPEFALGDLARDYRIMEVAREEALALLRRDDFWYAPWAEGLRNALKEAMDKVSYRD

SEQ ID NO: 2100 - protein, 678 aa, Artificial
  Alicyclobacillus acidocaldarius mutated SEQ ID NO 2092
MSLRSLSVRALPGVGPQKEKALEALGIRTVDDLLHTYPFRYDERAEKPFSEWRDGDRVTARAVVEGPVQVRWRGSKSIMTARVRVDGQHPVVCLWFSQHYLRSKLSDGRFIVVTGKWNEALRRLVASETSFDAGTQAPSLVPVYRASKELSTKAIHQLILKALEQYAEEIQESLPYALVRKYRLWTHRDALFGMHRPKSLEDVRQARRRLVFEEFLLFQIQLQWLRAKREEPAGRAQPVPSDALTAFEALLPGPMTNAQRRACEDILRDLQRPVPMTRLIQGDVGSGKTWVALFACFAVHLARGQSALMAPTEILAEQHARLAHELLGSAGVRVELLTGSVTGRERDRVLAGLASGDVSLAVGTHALLSEGVEFRDLALLVTDEQHRFGVAQRARLREKGRAPDVLMLSATPIPRTLALAIYGDMDVSILNELPKGRKPVQTIAVPSKDDETVLRLIRRELARGHQAYIVAPAIEASERDDVASVTELYERVREHLAGFRVELLHGRMPSADKERMMRAFRDGDIHALVATTVIEVGIDVPNATVMAIYGAERFGLAQLHQLRGRVGRGPHPSYCLLIHDASSEAARARIETMLQTNDGFEIAERDLELRGPGELFGLRQSGLPEFALGDLARDYRIMEVAREEALALLRRDDFWYAPWAEGLRNALKEAMDKVSYRD

SEQ ID NO: 2101 - protein, 678 aa, Artificial
  Alicyclobacillus acidocaldarius mutated SEQ ID NO 2092
MSLRSLSVRALPGVGPQKERALEALGIRTVDDLLHTYPFRYDERAEKPFSEWRDGDRVTARAVVEGPVQVRWRGSKSIMTARVRVDGQHPVVCLWFSQHYLRSKLSDGRFIVVTGKWNEALRRLVASETSFDAGTQAPSLVPVYRASKELSTKAIHQLILKALEQYAEEIQESLPYALVRKYRLWTHRDALFGMHRPKSLEDVRQARRRLVFEEFLLFQIQLQWLRAKREEPAGRAQPVPSDALTAFEALLPGPMTNAQRRACEDILRDLQRPVPMTRLIQGDVGSGKTWVALFACFAVHLARGQSALMAPTEILAEQHARIAHELLGSAGVRVELLTGSVTGRERDRVLAGLASGDVSLAVGTHALLSEGVEFRDLALLVTDEQHRFGVAQRARLREKGRAPDVLMLSATPIPRTLALAIYGDMDVSILNELPKGRKPVQTIAVPSKDDETVLRLIRRELARGHQAYIVAPAIEASERDDVASVTELYERVREHLAGFRVELLHGRMPSADKERMMRAFRDGDIHALVATTVIEVGIDVPNATVMAIYGAERFGLAQLHQLRGRVGRGPHPSYCLLIHDASSEAARARIETMLQTNDGFEIAERDLELRGPGELFGLRQSGLPEFALGDLARDYRIMEVAREEALALLRRDDFWYAPWAEGLRNALKEAMDKVSYRD

SEQ ID NO: 2102 - protein, 678 aa, Artificial
  Alicyclobacillus acidocaldarius mutated SEQ ID NO 2092
MSLRSLSVRALPGVGPQKERALEALGIRTVDDLLHTYPFRYDERAEKPFSEWRDGDRVTARAVVEGPVQVRWRGSKSIMTARVRVDGQHPVVCLWFSQHYLRSKLSDGRFIVVTGKWNEALRRLVASETSFDAGTQAPSLIPVYRASKELSTKAIHQLILKALEQYAEEIQESLPYALVRKYRLWTHRDALFGMHRPKSLEDVRQARRRLVFEEFLLFQIQLQWLRAKREEPAGRAQPVPSDALTAFEALLPGPMTNAQRRACEDILRDLQRPVPMTRLIQGDVGSGKTWVALFACFAVHLARGQSALMAPTEILAEQHARLAHELLGSAGVRVELLTGSVTGRERDRVLAGLASGDVSLAVGTHALLSEGVEFRDLALLVTDEQHRFGVAQRARLREKGRAPDVLMLSATPIPRTLALAIYGDMDVSILNELPKGRKPVQTIAVPSKDDETVLRLIRRELARGHQAYIVAPAIEASERDDVASVTELYERVREHLAGFRVELLHGRMPSADKERMMRAFRDGDIHALVATTVIEVGIDVPNATVMAIYGAERFGLAQLHQLRGRVGRGPHPSYCLLIHDASSEAARARIETMLQTNDGFEIAERDLELRGPGELFGLRQSGLPEFALGDLARDYRIMEVAREEALALLRRDDFWYAPWAEGLRNALKEAMDKVSYRD

SEQ ID NO: 2103 - protein, 678 aa, Artificial
  Alicyclobacillus acidocaldarius mutated SEQ ID NO 2092
MSLRSLSVRALPGVGPQKERALEALGIRTVDDLLHTYPFRYDERAEKPFSEWRDGDRVTARAVVEGPVQVRWRGSKSIMTARVRVDGQHPVVCLWFSQHYLRSKLSDGRFIVVTGKWNEALRRLVASETSFDAGTQAPSLVPVYRASKELSTKAIHQLILKALEQYAEEIQESLPYALVRKYRLWTHRDALFGMHKPKSLEDVRQARRRLVFEEFLLFQIQLQWLRAKREEPAGRAQPVPSDALTAFEALLPGPMTNAQRRACEDILRDLQRPVPMTRLIQGDVGSGKTWVALFACFAVHLARGQSALMAPTEILAEQHARLAHELLGSAGVRVELLTGSVTGRERDRVLAGLASGDVSLAVGTHALLSEGVEFRDLALLVTDEQHRFGVAQRARLREKGRAPDVLMLSATPIPRTLALAIYGDMDVSILNELPKGRKPVQTIAVPSKDDETVLRLIRRELARGHQAYIVAPAIEASERDDVASVTELYERVREHLAGFRVELLHGRMPSADKERMMRAFRDGDIHALVATTVIEVGIDVPNATVMAIYGAERFGLAQLHQLRGRVGRGPHPSYCLLIHDASSEAARARIETMLQTNDGFEIAERDLELRGPGELFGLRQSGLPEFALGDLARDYRIMEVAREEALALLRRDDFWYAPWAEGLRNALKEAMDKVSYRD

SEQ ID NO: 2104 - DNA, 2037 bp, Artificial
  Alicyclobacillus acidocaldarius mutated SEQ ID NO 2093
ttgtcgctcagatcgctgtccgtgcgcgcgctgccgggcgtgggtccgcagaaggagcgagcactcgaagcgctcggcattcgaacggtcgacgacttgctgcacacgtatccgtttcgatatgacgagcgagcggagaagccattttccgaatggcgcgatggcgatcgcgtcacggcgcgggctgtcgtcgaaggacctgtgcaagtcaggtggcgcggttccaagtccatcatgacggcgcgcgtgcgcgtggacggccaacatccggtcgtctgcctctggttttcgcaacattaccttcgctccaagctatccgacgggcggttcatcgtggtaacaggcaaatggaatgaagctctgcgccgcctggtcgccagcgagacatcgtttgaagccgggacacaggcgccctcgttggtaccggtataccgcgcgagcaaagaactctcgacgaaggccatccaccaactcatcctgaaggcgttggagcaatacgcggaagagatccaggagtcgctgccgtacgcgctcgtgcgcaagtatcggctttggacgcatcgagatgcgctcttcgggatgcatcggcccaaatcgctcgaggacgtccgtcaggcccggcggcggctggtgttcgaggagtttctcttgtttcaaattcagctccagtggcttcgcgcaaagcgcgaggagcccgcggggcgcgcgcagcccgtgccgagtgatgcgctgacggcgttcgaggccctcctgcccggtccgatgacgaacgcgcagcggcgcgcgtgcgaggacatcctgcgggatcttcagcgccccgtgcccatgacgcgcctgattcagggggacgtcggatcgggcaagacgtgggtggccctttttgcgtgctttgcggtccacctcgcgcgcggacagtccgcgctcatggcgcccaccgaaatcctcgccgagcagcacgcgaggctcgcgcacgagctgctcggctctgccggcgttcgcgtcgagcttttgacgggttcggtgacaggacgcgagcgcgatcgcgtgctggcgggcctcgcctccggggacgtgtcgcttgccgtcggcacgcacgcgcttctgtccgagggtgtcgagtttcgcgatctcgccctgctcgtcaccgatgagcagcatcgcttcggcgtcgcgcagcgcgcgaggctgcgtgagaagggccgcgccccggacgtgctcatgctgtcggcgacgccgattccgcggacgcttgcgctcgccatctacggcgacatggacgtgtccatcctgaacgagttgccgaagggccgaaagcccgttcagaccatcgccgtgccgtcgaaagacgacgagaccgttcttcgcctcatccgcagagagttggcgcggggacaccaggcctacatcgtcgcgccggccatcgaggcgtcggagcgagacgacgtggcgtccgtgacggagctttatgagcgcgtgcgcgaacacctggcgggatttcgcgtcgaactcctgcacgggcggatgccaagcgccgacaaggagcgcatgatgcgcgcgttccgcgacggcgacatccacgcgctcgtcgcgacgaccgtgatcgaggtcggcatcgacgtgcccaatgccaccgtgatggccatctatggcgcggagcggttcggtttggcgcaattgcatcagcttcgcgggcgagtcggacgagggccgcatccgagctactgcctgctcattcacgacgcatcgtccgaggcggcgcgcgcgcgaatcgagaccatgctgcagacgaacgacgggtttgagatcgcggagcgggacctggaattgcgcgggcctggggagttgttcggcctgaggcagagcggtcttcccgagttcgcgttgggcgatctcgcccgcgattatcggatcatggaggtcgcaagggaagaggcgctggcgctccttcggcgggacgatttttggtacgctccgtgggccgagggtctgcgcaacgcgctgaaggaggccatggacaaggtttcgtatcgagactga

SEQ ID NO: 2105 - DNA, 2037 bp, Artificial
  Alicyclobacillus acidocaldarius mutated SEQ ID NO 2093
ttgtcgctcagatcgctgtccgtgcgcgcgctgccgggcgtgggtccgcagaaggagaaagcactcgaagcgctcggcattcgaacggtcgacgacttgctgcacacgtatccgtttcgatatgacgagcgagcggagaagccattttccgaatggcgcgatggcgatcgcgtcacggcgcgggctgtcgtcgaaggacctgtgcaagtcaggtggcgcggttccaagtccatcatgacggcgcgcgtgcgcgtggacggccaacatccggtcgtctgcctctggttttcgcaacattaccttcgctccaagctatccgacgggcggttcatcgtggtaacaggcaaatggaatgaagctctgcgccgcctggtcgccagcgagacatcgtttgacgccgggacacaggcgccctcgttggtaccggtataccgcgcgagcaaagaactctcgacgaaggccatccaccaactcatcctgaaggcgttggagcaatacgcggaagagatccaggagtcgctgccgtacgcgctcgtgcgcaagtatcggctttggacgcatcgagatgcgctcttcgggatgcatcggcccaaatcgctcgaggacgtccgtcaggcccggcggcggctggtgttcgaggagtttctcttgtttcaaattcagctccagtggcttcgcgcaaagcgcgaggagcccgcggggcgcgcgcagcccgtgccgagtgatgcgctgacggcgttcgaggccctcctgcccggtccgatgacgaacgcgcagcggcgcgcgtgcgaggacatcctgcgggatcttcagcgccccgtgcccatgacgcgcctgattcagggggacgtcggatcgggcaagacgtgggtggccctttttgcgtgctttgcggtccacctcgcgcgcggacagtccgcgctcatggcgcccaccgaaatcctcgccgagcagcacgcgaggctcgcgcacgagctgctcggctctgccggcgttcgcgtcgagcttttgacgggttcggtgacaggacgcgagcgcgatcgcgtgctggcgggcctcgcctccggggacgtgtcgcttgccgtcggcacgcacgcgcttctgtccgagggtgtcgagtttcgcgatctcgccctgctcgtcaccgatgagcagcatcgcttcggcgtcgcgcagcgcgcgaggctgcgtgagaagggccgcgccccggacgtgctcatgctgtcggcgacgccgattccgcggacgcttgcgctcgccatctacggcgacatggacgtgtccatcctgaacgagttgccgaagggccgaaagcccgttcagaccatcgccgtgccgtcgaaagacgacgagaccgttcttcgcctcatccgcagagagttggcgcggggacaccaggcctacatcgtcgcgccggccatcgaggcgtcggagcgagacgacgtggcgtccgtgacggagctttatgagcgcgtgcgcgaacacctggcgggatttcgcgtcgaactcctgcacgggcggatgccaagcgccgacaaggagcgcatgatgcgcgcgttccgcgacggcgacatccacgcgctcgtcgcgacgaccgtgatcgaggtcggcatcgacgtgcccaatgccaccgtgatggccatctatggcgcggagcggttcggtttggcgcaattgcatcagcttcgcgggcgagtcggacgagggccgcatccgagctactgcctgctcattcacgacgcatcgtccgaggcggcgcgcgcgcgaatcgagaccatgctgcagacgaacgacgggtttgagatcgcggagcgggacctggaattgcgcgggcctggggagttgttcggcctgaggcagagcggtcttcccgagttcgcgttgggcgatctcgcccgcgattatcggatcatggaggtcgcaagggaagaggcgctggcgctccttcggcgggacgatttttggtacgctccgtgggccgagggtctgcgcaacgcgctgaaggaggccatggacaaggtttcgtatcgagactga

SEQ ID NO: 2106 - DNA, 2037 bp, Artificial
  Alicyclobacillus acidocaldarius mutated SEQ ID NO 2093
ttgtcgctcagatcgctgtccgtgcgcgcgctgccgggcgtgggtccgcagaaggagcgagcactcgaagcgctcggcattcgaacggtcgacgacttgctgcacacgtatccgtttcgatatgacgagcgagcggagaagccattttccgaatggcgcgatggcgatcgcgtcacggcgcgggctgtcgtcgaaggacctgtgcaagtcaggtggcgcggttccaagtccatcatgacggcgcgcgtgcgcgtggacggccaacatccggtcgtctgcctctggttttcgcaacattaccttcgctccaagctatccgacgggcggttcatcgtggtaacaggcaaatggaatgaagctctgcgccgcctggtcgccagcgagacatcgtttgacgccgggacacaggcgccctcgttggtaccggtataccgcgcgagcaaagaactctcgacgaaggccatccaccaactcatcctgaaggcgttggagcaatacgcggaagagatccaggagtcgctgccgtacgcgctcgtgcgcaagtatcggctttggacgcatcgagatgcgctcttcgggatgcatcggcccaaatcgctcgaggacgtccgtcaggcccggcggcggctggtgttcgaggagtttctcttgtttcaaattcagctccagtggcttcgcgcaaagcgcgaggagcccgcggggcgcgcgcagcccgtgccgagtgatgcgctgacggcgttcgaggccctcctgcccggtccgatgacgaacgcgcagcggcgcgcgtgcgaggacatcctgcgggatcttcagcgccccgtgcccatgacgcgcctgattcagggggacgtcggatcgggcaagacgtgggtggccctttttgcgtgctttgcggtccacctcgcgcgcggacagtccgcgctcatggcgcccaccgaaatcctcgccgagcagcacgcgaggattgcgcacgagctgctcggctctgccggcgttcgcgtcgagcttttgacgggttcggtgacaggacgcgagcgcgatcgcgtgctggcgggcctcgcctccggggacgtgtcgcttgccgtcggcacgcacgcgcttctgtccgagggtgtcgagtttcgcgatctcgccctgctcgtcaccgatgagcagcatcgcttcggcgtcgcgcagcgcgcgaggctgcgtgagaagggccgcgccccggacgtgctcatgctgtcggcgacgccgattccgcggacgcttgcgctcgccatctacggcgacatggacgtgtccatcctgaacgagttgccgaagggccgaaagcccgttcagaccatcgccgtgccgtcgaaagacgacgagaccgttcttcgcctcatccgcagagagttggcgcggggacaccaggcctacatcgtcgcgccggccatcgaggcgtcggagcgagacgacgtggcgtccgtgacggagctttatgagcgcgtgcgcgaacacctggcgggatttcgcgtcgaactcctgcacgggcggatgccaagcgccgacaaggagcgcatgatgcgcgcgttccgcgacggcgacatccacgcgctcgtcgcgacgaccgtgatcgaggtcggcatcgacgtgcccaatgccaccgtgatggccatctatggcgcggagcggttcggtttggcgcaattgcatcagcttcgcgggcgagtcggacgagggccgcatccgagctactgcctgctcattcacgacgcatcgtccgaggcggcgcgcgcgcgaatcgagaccatgctgcagacgaacgacgggtttgagatcgcggagcgggacctggaattgcgcgggcctggggagttgttcggcctgaggcagagcggtcttcccgagttcgcgttgggcgatctcgcccgcgattatcggatcatggaggtcgcaagggaagaggcgctggcgctccttcggcgggacgatttttggtacgctccgtgggccgagggtctgcgcaacgcgctgaaggaggccatggacaaggtttcgtatcgagactga

SEQ ID NO: 2107 - DNA, 2037 bp, Artificial
  Alicyclobacillus acidocaldarius mutated SEQ ID NO 2093
ttgtcgctcagatcgctgtccgtgcgcgcgctgccgggcgtgggtccgcagaaggagcgagcactcgaagcgctcggcattcgaacggtcgacgacttgctgcacacgtatccgtttcgatatgacgagcgagcggagaagccattttccgaatggcgcgatggcgatcgcgtcacggcgcgggctgtcgtcgaaggacctgtgcaagtcaggtggcgcggttccaagtccatcatgacggcgcgcgtgcgcgtggacggccaacatccggtcgtctgcctctggttttcgcaacattaccttcgctccaagctatccgacgggcggttcatcgtggtaacaggcaaatggaatgaagctctgcgccgcctggtcgccagcgagacatcgtttgacgccgggacacaggcgccctcgttgattccggtataccgcgcgagcaaagaactctcgacgaaggccatccaccaactcatcctgaaggcgttggagcaatacgcggaagagatccaggagtcgctgccgtacgcgctcgtgcgcaagtatcggctttggacgcatcgagatgcgctcttcgggatgcatcggcccaaatcgctcgaggacgtccgtcaggcccggcggcggctggtgttcgaggagtttctcttgtttcaaattcagctccagtggcttcgcgcaaagcgcgaggagcccgcggggcgcgcgcagcccgtgccgagtgatgcgctgacggcgttcgaggccctcctgcccggtccgatgacgaacgcgcagcggcgcgcgtgcgaggacatcctgcgggatcttcagcgccccgtgcccatgacgcgcctgattcagggggacgtcggatcgggcaagacgtgggtggccctttttgcgtgctttgcggtccacctcgcgcgcggacagtccgcgctcatggcgcccaccgaaatcctcgccgagcagcacgcgaggctcgcgcacgagctgctcggctctgccggcgttcgcgtcgagcttttgacgggttcggtgacaggacgcgagcgcgatcgcgtgctggcgggcctcgcctccggggacgtgtcgcttgccgtcggcacgcacgcgcttctgtccgagggtgtcgagtttcgcgatctcgccctgctcgtcaccgatgagcagcatcgcttcggcgtcgcgcagcgcgcgaggctgcgtgagaagggccgcgccccggacgtgctcatgctgtcggcgacgccgattccgcggacgcttgcgctcgccatctacggcgacatggacgtgtccatcctgaacgagttgccgaagggccgaaagcccgttcagaccatcgccgtgccgtcgaaagacgacgagaccgttcttcgcctcatccgcagagagttggcgcggggacaccaggcctacatcgtcgcgccggccatcgaggcgtcggagcgagacgacgtggcgtccgtgacggagctttatgagcgcgtgcgcgaacacctggcgggatttcgcgtcgaactcctgcacgggcggatgccaagcgccgacaaggagcgcatgatgcgcgcgttccgcgacggcgacatccacgcgctcgtcgcgacgaccgtgatcgaggtcggcatcgacgtgcccaatgccaccgtgatggccatctatggcgcggagcggttcggtttggcgcaattgcatcagcttcgcgggcgagtcggacgagggccgcatccgagctactgcctgctcattcacgacgcatcgtccgaggcggcgcgcgcgcgaatcgagaccatgctgcagacgaacgacgggtttgagatcgcggagcgggacctggaattgcgcgggcctggggagttgttcggcctgaggcagagcggtcttcccgagttcgcgttgggcgatctcgcccgcgattatcggatcatggaggtcgcaagggaagaggcgctggcgctccttcggcgggacgatttttggtacgctccgtgggccgagggtctgcgcaacgcgctgaaggaggccatggacaaggtttcgtatcgagactga

SEQ ID NO: 2108 - DNA, 2037 bp, Artificial
  Alicyclobacillus acidocaldarius mutated SEQ ID NO 2093
ttgtcgctcagatcgctgtccgtgcgcgcgctgccgggcgtgggtccgcagaaggagcgagcactcgaagcgctcggcattcgaacggtcgacgacttgctgcacacgtatccgtttcgatatgacgagcgagcggagaagccattttccgaatggcgcgatggcgatcgcgtcacggcgcgggctgtcgtcgaaggacctgtgcaagtcaggtggcgcggttccaagtccatcatgacggcgcgcgtgcgcgtggacggccaacatccggtcgtctgcctctggttttcgcaacattaccttcgctccaagctatccgacgggcggttcatcgtggtaacaggcaaatggaatgaagctctgcgccgcctggtcgccagcgagacatcgtttgacgccgggacacaggcgccctcgttggtaccggtataccgcgcgagcaaagaactctcgacgaaggccatccaccaactcatcctgaaggcgttggagcaatacgcggaagagatccaggagtcgctgccgtacgcgctcgtgcgcaagtatcggctttggacgcatcgagatgcgctcttcgggatgcataaacccaaatcgctcgaggacgtccgtcaggcccggcggcggctggtgttcgaggagtttctcttgtttcaaattcagctccagtggcttcgcgcaaagcgcgaggagcccgcggggcgcgcgcagcccgtgccgagtgatgcgctgacggcgttcgaggccctcctgcccggtccgatgacgaacgcgcagcggcgcgcgtgcgaggacatcctgcgggatcttcagcgccccgtgcccatgacgcgcctgattcagggggacgtcggatcgggcaagacgtgggtggccctttttgcgtgctttgcggtccacctcgcgcgcggacagtccgcgctcatggcgcccaccgaaatcctcgccgagcagcacgcgaggctcgcgcacgagctgctcggctctgccggcgttcgcgtcgagcttttgacgggttcggtgacaggacgcgagcgcgatcgcgtgctggcgggcctcgcctccggggacgtgtcgcttgccgtcggcacgcacgcgcttctgtccgagggtgtcgagtttcgcgatctcgccctgctcgtcaccgatgagcagcatcgcttcggcgtcgcgcagcgcgcgaggctgcgtgagaagggccgcgccccggacgtgctcatgctgtcggcgacgccgattccgcggacgcttgcgctcgccatctacggcgacatggacgtgtccatcctgaacgagttgccgaagggccgaaagcccgttcagaccatcgccgtgccgtcgaaagacgacgagaccgttcttcgcctcatccgcagagagttggcgcggggacaccaggcctacatcgtcgcgccggccatcgaggcgtcggagcgagacgacgtggcgtccgtgacggagctttatgagcgcgtgcgcgaacacctggcgggatttcgcgtcgaactcctgcacgggcggatgccaagcgccgacaaggagcgcatgatgcgcgcgttccgcgacggcgacatccacgcgctcgtcgcgacgaccgtgatcgaggtcggcatcgacgtgcccaatgccaccgtgatggccatctatggcgcggagcggttcggtttggcgcaattgcatcagcttcgcgggcgagtcggacgagggccgcatccgagctactgcctgctcattcacgacgcatcgtccgaggcggcgcgcgcgcgaatcgagaccatgctgcagacgaacgacgggtttgagatcgcggagcgggacctggaattgcgcgggcctggggagttgttcggcctgaggcagagcggtcttcccgagttcgcgttgggcgatctcgcccgcgattatcggatcatggaggtcgcaagggaagaggcgctggcgctccttcggcgggacgatttttggtacgctccgtgggccgagggtctgcgcaacgcgctgaaggaggccatggacaaggtttcgtatcgagactga

SEQ ID NO: 2109 - protein, 573 aa, Alicyclobacillus acidocaldarius
MYIRVIRRKNKNGSVTGYVQLAHNFRDPNTGQPKAKVLYTFGREDEIDLEALRRLAQSIHRFVGDEFTAGRGQSEGIQTTLLDSRPMGGAYLLDELWRQLGLDEVLRERLADRKFKAAVERVIFAMVANRALAPSSKLAMEEWVDREVALPGMTELDVWQAYRAMDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHYIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPVYHRKDERIRSHVLLCWLALLLVRIAEVQIGRSWPDIRSHVQGNAPSDAFRRDRCAAHRNDRGAAGDPASLEDQGTAEDPEGRTSNTRAVDTTRVIHRSHESTSDMGLWDFV

SEQ ID NO: 2110 - DNA, 1722 bp, Alicyclobacillus acidocaldarius
atgtatatccgagtcattcgccgaaaaaacaagaacggttctgtcaccggttacgtgcagttggcccataactttcgcgatcccaacaccggccagcccaaggccaaggtcctctacaccttcggccgcgaagacgaaatcgacctcgaggccctccggcgccttgcccagagcatccatcgcttcgttggcgacgagtttaccgccggacgtggtcagtcggagggcatccaaaccacgctgctggatagccgtcctatgggaggggcgtatctgctagacgagctgtggcgacagcttggattggatgaggtcctgcgagagcggcttgccgaccggaagtttaaggcggctgtcgagcgtgtcatcttcgccatggtcgcgaatcgcgcgttggcgccaagcagcaagctggccatggaagaatgggtcgaccgtgaagtggctctccccgggatgaccgagttggacgtgtggcaggcataccgggcaatggactttctccatgatgtggcggaagacctgcaatacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctggcaacacagcggacatgagcgtggtcgaggaggtcaaacaggacctcatcggttggcggcttggtcgcgtgatcacggtcgtggatcgaggtttcgtctcagagagcaatttgcggatcctgcaacgcgccgggggtcactacatcgctggggagaagatgacctccgggaaaccagcggtggaagcggcgttggcgcgccctggacgttttcgtgagcttcgtcccaacctgaaagtgaaggaggtcgtggtgggagacggagaggcccgggtccgttacgtgttggcgttcaatcccgaggaagccaaacgcgatgaggcgcggcgggaggccatgttgcgcgagcttcggatggagttggaacgcctcaaagagcttcagggcgaagcgcacacgaaggcccactgtcggcttgcgagccatcccacgttcaagcgttatctgaaacaggaccgatgggggaacctgcgaattgacccggaggccgtgcggcaagcggctcatctggacgggaagtacctgatccgcacctccgatgacacgctgtcgacggaggatgtcgcactgggatacaagcagcttctgatggtggagtccgcgtttcggacgctgaagacgacgttggacatacgtcccgtgtatcaccggaaggacgagcggattcgttcgcatgtgctgctttgctggctggccttgttgttggtgcgcatcgccgaagttcaaatagggcgatcctggcccgatatccgctcccacgtgcaaggcaatgcacccagtgacgccttcaggcgggatcgctgtgcagcgcaccgaaacgaccgaggtgcagcgggagatcctgcgagccttgaggatcaaggaaccgccgaagatcctgaaggtagaacctcgaacacgagggctgtagacactacacgagttatccacaggtcccacgaatccacgtcggacatgggtttgtgggacttcgtatga

SEQ ID NO: 2111 - protein, 509 aa, Geobacillus kaustophilus
MYIRRVTRKNKDGTTVAYLQLAHNEWDPKAKYAKAKVIYSFGREDEVDRAVLERLAKSISRFLSPEQAWEVEKLTGEASDDFQFQSCKHLGGVWLLDQLWRQLGLGEILHSLFTSRHHQISLERLIFAMVANRALHPSSKLAMEEWVEKDVYIPHLPQVASHQLYRAMDELLAVQPELERQVFHAVADLLNLEVDLIYFDTTSSYFEVDPSETPEGESLRKQGFSKDKRPDLVQIVIGLAVTREGIPIRAWVWPGNTMDMTVIKQVKQDLIGWKLGRVISVMDRGFSSEENLRILQQAGGHYIVGENMRSGKAAVEEALSRRGRYHEVDENLHIKEIIVGDGEARQRYVLVYNPGEAERQRKERETLLESLKEELEGLRQLPNEAHHKATCRLRSHPSYGKYLRQLKDGTLRIDKQAVRDAEKYDGNYLIRTSDDTLSAEDVAIGYKQLVDIEQAFRTLKSTLELRPMYHRLEDRIRAHVLLSWLALLLVRIVEIRTHESWPKVRDECE

SEQ ID NO: 2112 - protein, 492 aa, Geobacillus kaustophilus
YLQLAHNEWDPKAKYAKAKVIYSFGREDEVDRAVLERLAKSISRFLSPEQAWEIETLTGEVSDDFQFQSSKRLGGAWLLDQLWRQLGLGEILHSLFASRHHQIPLERLIFAMVANRALHPSSKLAMEEWVEKDVHIPHLPQVASHQLYRAMDELLAVQPELERQVFHAVADLLNLEVDLIYFDTTSSYFEVDPSETPEGESLRKQGFSKDKRPDLVQIVIGLAVTREGVPIRAWVWPGNTMDMTVIKQVKQDLIGWKLGRVISVMDRGFSSEENLRILQQAGGHYIVGEKMRSGKAAVEEALNRRGRYQQVRENLHIKEIIVGDGEARQRYVLVYNPSEAERQRKEREKLLESLKEELEGLRQLPNEAHHKATCRLRSHPSYGKYLRQLKDGTLRIDKQAVREAEKYDGKYLIRTSDDTLSAEDVALGYKQLVDIEQAFRTLKSTLELRPMYHRLEDRIRAHVLLSWLALLLVRIVEIRTHESWPKVRDECE

SEQ ID NO: 2113 - protein, 492 aa, Geobacillus thermodenitrificans
YLQLAHNEWDPKAKYAKAKVIYSFGREDEVDRAVLERLAKSISRFLSPEQAWEIETLTGEVSDDFQFQSSKRLGGAWLLDQLWRQLGLGEILHSLFASRHHQIPLERLIFAMVANRALHPSSKLAMEEWVEKDVHIPHLPQGASHQLYRAMDELLAVQPELERQVFHAVADLLNLEVDLIYFDTTSSYFEVDPSETPEGESLRKQGFSKDKRPDLVQIVIGLAVTREGVPIRAWVWPGNTMDMTVIKQVKQDLIGWKLGRVISVMDRGFSSEENLRILQQAGGHYIVGEKMRSGKAAVEEALNRRGRYQQVRENLHIKEIIVGDGEARQRYVLVYNPSEAERQRKEREKLLESLKEELEGLRQLPNEAHHKATCRLRSHPSYGKYLRQLKDGTLRIDKQAVREAEKYDGKYLIRTSDDTLSAEDVALGYKQLVDIEQAFRTLKSTLELRPMYHRLEDRIRAHVLLSWLALLLVRIVEIRTHESWPKVRDECE

SEQ ID NO: 2114 - protein, 501 aa, Desulfatibacillum alkenivorans
MYIRTISRKNKDGSKVEYVQLAHNYRDPKSKQARAEVLYSFGRKDQLDMEAIRRLAKSVERFLAKTGDVETQCKLQFPGEDVRFVESRPMGGVFVLKKIWDRLRISECLDKALADRQYTAPIGDAVFAMVANRALAPDSKLAVEDWAAKDVHLELDQPLKVQHLYRAMDFLLENQEAIQKEVFWSTANLLNLEVDLVFFDTTSTYFERDEEDEEGLKRYGHSKDKRKDLPQVVVGLAVTKEGLPIRSWVFPGNTPDVNTVEQIQKEMNDWKLGRVVWAMDRGMTSEENRAILQRGGGNYILGEKLRGSNMSKAVLGSPGRFTTVRDNLEIKEVTAGDGACRRRYVIVRNPKQVKRDQATRERLIRRAEQEIEAIGDLTGKKHTKAACALLSHRSMGKYVRELKSGKLKINKAKITEEEKLDGKYLLSCSDDTLSPEEIALGYKQLLEVERAFRTLKSTLDLRPVYHRKDERIRSHVTLCWLALLLVRLIELETGMTWNQVR

SEQ ID NO: 2115 - protein, 397 aa, Geobacillus kaustophilus
VCSRHHQIPLERLIFAMVANRALHPSSKLAMEEWVEKDVHIPHLPQVASHQLYRAMDELLAVQPELERQVFHAVADLLNLEVDLIYFDTTSSYFEVDPSETPEGESLRKQGFSKDKRPDLVQIVIGLAVTREGVPIRAWVWPGNTMDMTVIKQVKQDLIGWKLGRVISVMDRGFSSEENLRILQQAGGHYIVGEKMRSGKAAVEEALNRRGRYQQVRENLHIKEIIVGDGEARQRYVLVYNPSEAERQRKEREKLLESLKEELEGLRQLPNEAHHKATCRLRSHPSYGKYLRQLKDGTLRIDKQAVREAEKYDGKYLIRTSDDTLSAEDVALGYKQLVDIEQAFRTLKSTLELRPMYHRLEDRIRAHVLLSWLALLLVRIVEIRTHESWPKVRDECE

SEQ ID NO: 2116 - protein, 573 aa, Artificial
  Alicyclobacillus acidocaldarius mutated SEQ ID NO 2109
MYIRVIRRKNKNGSVTGYVQLAHNFRDPNTGNPKAKVLYTFGREDEIDLEALRRLAQSIHRFVGDEFTAGRGQSEGIQTTLLDSRPMGGAYLLDELWRQLGLDEVLRERLADRKFKAAVERVIFAMVANRALAPSSKLAMEEWVDREVALPGMTELDVWQAYRAMDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHYIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPVYHRKDERIRSHVLLCWLALLLVRIAEVQIGRSWPDIRSHVQGNAPSDAFRRDRCAAHRNDRGAAGDPASLEDQGTAEDPEGRTSNTRAVDTTRVIHRSHESTSDMGLWDFV

SEQ ID NO: 2117 - protein, 573 aa, Artificial
  Alicyclobacillus acidocaldarius mutated SEQ ID NO 2109
MYIRVIRRKNKNGSVTGYVQLAHNFRDPNTGQPKAKVLYTFGREDEIDLEALRRLAQSIHRFVGDEFTAGRGQSEGIQTTLLDSRPMGGAYLLDELWRQLGLDEVLRERLADRKFKAAVERVIFAMVANRALAPSSKLAMEEWVDREVALPGMTELDVWQAYRAMDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHYIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPVYHRKDERIRSHVLLCWLALLLVRIAEVQIGRSWPDIRSHVQGNAPSDAFRRDRCAAHRNDRGAAGDPASLEDQGTAEDPEGRTSNTRAVDTTRVLHRSHESTSDMGLWDFV

SEQ ID NO: 2118 - protein, 573 aa, Artificial
  Alicyclobacillus acidocaldarius mutated SEQ ID NO 2109
MYIRVIRRKNKNGSVTGYVQLAHNFRDPNTGQPKAKVLYTFGREDEIDLEALRRLAQSIHRFVGDEFTAGRGQSEGIQTTLLDSRPMGGAYLLDELWRQLGLDEVLRERLADRKFKAAVERVIFAMVANRALAPSSKLAMEEWVDREVALPGMTELDVWQAYRAMDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHYIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHIDGKYLIRTSDDTLSTEDVALGYKQLLMVESAFRTLKTTLDIRPVYHRKDERIRSHVLLCWLALLLVRIAEVQIGRSWPDIRSHVQGNAPSDAFRRDRCAAHRNDRGAAGDPASLEDQGTAEDPEGRTSNTRAVDTTRVIHRSHESTSDMGLWDFV

SEQ ID NO: 2119 - protein, 573 aa, Artificial
  Alicyclobacillus acidocaldarius mutated SEQ ID NO 2109
MYIRVIRRKNKNGSVTGYVQLAHNFRDPQTGQPKAKVLYTFGREDEIDLEALRRLAQSIHRFVGDEFTAGRGQSEGIQTTLLDSRPMGGAYLLDELWRQLGLDEVLRERLADRKFKAAVERVIFAMVANRALAPSSKLAMEEWVDREVALPGMTELDVWQAYRAMDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHYIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPVYHRKDERIRSHVLLCWLALLLVRIAEVQIGRSWPDIRSHVQGNAPSDAFRRDRCAAHRNDRGAAGDPASLEDQGTAEDPEGRTSNTRAVDTTRVIHRSHESTSDMGLWDFV

SEQ ID NO: 2120 - protein, 573 aa, Artificial
  Alicyclobacillus acidocaldarius mutated SEQ ID NO 2109
MYIRVIRRKNKNGSVTGYVQLAHNFRDPNTGQPKAKVLYTFGREDEIDLEALRRLAQSIHRFVGDEFTAGRGQSEGIQTTLLDSRPMGGAYLLDELWRQLGLDEVIRERLADRKFKAAVERVIFAMVANRALAPSSKLAMEEWVDREVALPGMTELDVWQAYRAMDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHYIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPVYHRKDERIRSHVLLCWLALLLVRIAEVQIGRSWPDIRSHVQGNAPSDAFRRDRCAAHRNDRGAAGDPASLEDQGTAEDPEGRTSNTRAVDTTRVIHRSHESTSDMGLWDFV

SEQ ID NO: 2121 - DNA, 1722 bp, Artificial
  Alicyclobacillus acidocaldarius mutated SEQ ID NO 2110
atgtatatccgagtcattcgccgaaaaaacaagaacggttctgtcaccggttacgtgcagttggcccataactttcgcgatcccaacaccggcaatcccaaggccaaggtcctctacaccttcggccgcgaagacgaaatcgacctcgaggccctccggcgccttgcccagagcatccatcgcttcgttggcgacgagtttaccgccggacgtggtcagtcggagggcatccaaaccacgctgctggatagccgtcctatgggaggggcgtatctgctagacgagctgtggcgacagcttggattggatgaggtcctgcgagagcggcttgccgaccggaagtttaaggcggctgtcgagcgtgtcatcttcgccatggtcgcgaatcgcgcgttggcgccaagcagcaagctggccatggaagaatgggtcgaccgtgaagtggctctccccgggatgaccgagttggacgtgtggcaggcataccgggcaatggactttctccatgatgtggcggaagacctgcaatacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctggcaacacagcggacatgagcgtggtcgaggaggtcaaacaggacctcatcggttggcggcttggtcgcgtgatcacggtcgtggatcgaggtttcgtctcagagagcaatttgcggatcctgcaacgcgccgggggtcactacatcgctggggagaagatgacctccgggaaaccagcggtggaagcggcgttggcgcgccctggacgttttcgtgagcttcgtcccaacctgaaagtgaaggaggtcgtggtgggagacggagaggcccgggtccgttacgtgttggcgttcaatcccgaggaagccaaacgcgatgaggcgcggcgggaggccatgttgcgcgagcttcggatggagttggaacgcctcaaagagcttcagggcgaagcgcacacgaaggcccactgtcggcttgcgagccatcccacgttcaagcgttatctgaaacaggaccgatgggggaacctgcgaattgacccggaggccgtgcggcaagcggctcatctggacgggaagtacctgatccgcacctccgatgacacgctgtcgacggaggatgtcgcactgggatacaagcagcttctgatggtggagtccgcgtttcggacgctgaagacgacgttggacatacgtcccgtgtatcaccggaaggacgagcggattcgttcgcatgtgctgctttgctggctggccttgttgttggtgcgcatcgccgaagttcaaatagggcgatcctggcccgatatccgctcccacgtgcaaggcaatgcacccagtgacgccttcaggcgggatcgctgtgcagcgcaccgaaacgaccgaggtgcagcgggagatcctgcgagccttgaggatcaaggaaccgccgaagatcctgaaggtagaacctcgaacacgagggctgtagacactacacgagttatccacaggtcccacgaatccacgtcggacatgggtttgtgggacttcgtatga

SEQ ID NO: 2122 - DNA, 1722 bp, Artificial
  Alicyclobacillus acidocaldarius mutated SEQ ID NO 2110
atgtatatccgagtcattcgccgaaaaaacaagaacggttctgtcaccggttacgtgcagttggcccataactttcgcgatcccaacaccggccagcccaaggccaaggtcctctacaccttcggccgcgaagacgaaatcgacctcgaggccctccggcgccttgcccagagcatccatcgcttcgttggcgacgagtttaccgccggacgtggtcagtcggagggcatccaaaccacgctgctggatagccgtcctatgggaggggcgtatctgctagacgagctgtggcgacagcttggattggatgaggtcctgcgagagcggcttgccgaccggaagtttaaggcggctgtcgagcgtgtcatcttcgccatggtcgcgaatcgcgcgttggcgccaagcagcaagctggccatggaagaatgggtcgaccgtgaagtggctctccccgggatgaccgagttggacgtgtggcaggcataccgggcaatggactttctccatgatgtggcggaagacctgcaatacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctggcaacacagcggacatgagcgtggtcgaggaggtcaaacaggacctcatcggttggcggcttggtcgcgtgatcacggtcgtggatcgaggtttcgtctcagagagcaatttgcggatcctgcaacgcgccgggggtcactacatcgctggggagaagatgacctccgggaaaccagcggtggaagcggcgttggcgcgccctggacgttttcgtgagcttcgtcccaacctgaaagtgaaggaggtcgtggtgggagacggagaggcccgggtccgttacgtgttggcgttcaatcccgaggaagccaaacgcgatgaggcgcggcgggaggccatgttgcgcgagcttcggatggagttggaacgcctcaaagagcttcagggcgaagcgcacacgaaggcccactgtcggcttgcgagccatcccacgttcaagcgttatctgaaacaggaccgatgggggaacctgcgaattgacccggaggccgtgcggcaagcggctcatctggacgggaagtacctgatccgcacctccgatgacacgctgtcgacggaggatgtcgcactgggatacaagcagcttctgatggtggagtccgcgtttcggacgctgaagacgacgttggacatacgtcccgtgtatcaccggaaggacgagcggattcgttcgcatgtgctgctttgctggctggccttgttgttggtgcgcatcgccgaagttcaaatagggcgatcctggcccgatatccgctcccacgtgcaaggcaatgcacccagtgacgccttcaggcgggatcgctgtgcagcgcaccgaaacgaccgaggtgcagcgggagatcctgcgagccttgaggatcaaggaaccgccgaagatcctgaaggtagaacctcgaacacgagggctgtagacactacacgagttttacacaggtcccacgaatccacgtcggacatgggtttgtgggacttcgtatga

SEQ ID NO: 2123 - DNA, 1722 bp, Artificial
  Alicyclobacillus acidocaldarius mutated SEQ ID NO 2110
atgtatatccgagtcattcgccgaaaaaacaagaacggttctgtcaccggttacgtgcagttggcccataactttcgcgatcccaacaccggccagcccaaggccaaggtcctctacaccttcggccgcgaagacgaaatcgacctcgaggccctccggcgccttgcccagagcatccatcgcttcgttggcgacgagtttaccgccggacgtggtcagtcggagggcatccaaaccacgctgctggatagccgtcctatgggaggggcgtatctgctagacgagctgtggcgacagcttggattggatgaggtcctgcgagagcggcttgccgaccggaagtttaaggcggctgtcgagcgtgtcatcttcgccatggtcgcgaatcgcgcgttggcgccaagcagcaagctggccatggaagaatgggtcgaccgtgaagtggctctccccgggatgaccgagttggacgtgtggcaggcataccgggcaatggactttctccatgatgtggcggaagacctgcaatacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctggcaacacagcggacatgagcgtggtcgaggaggtcaaacaggacctcatcggttggcggcttggtcgcgtgatcacggtcgtggatcgaggtttcgtctcagagagcaatttgcggatcctgcaacgcgccgggggtcactacatcgctggggagaagatgacctccgggaaaccagcggtggaagcggcgttggcgcgccctggacgttttcgtgagcttcgtcccaacctgaaagtgaaggaggtcgtggtgggagacggagaggcccgggtccgttacgtgttggcgttcaatcccgaggaagccaaacgcgatgaggcgcggcgggaggccatgttgcgcgagcttcggatggagttggaacgcctcaaagagcttcagggcgaagcgcacacgaaggcccactgtcggcttgcgagccatcccacgttcaagcgttatctgaaacaggaccgatgggggaacctgcgaattgacccggaggccgtgcggcaagcggctcatattgacgggaagtacctgatccgcacctccgatgacacgctgtcgacggaggatgtcgcactgggatacaagcagcttctgatggtggagtccgcgtttcggacgctgaagacgacgttggacatacgtcccgtgtatcaccggaaggacgagcggattcgttcgcatgtgctgctttgctggctggccttgttgttggtgcgcatcgccgaagttcaaatagggcgatcctggcccgatatccgctcccacgtgcaaggcaatgcacccagtgacgccttcaggcgggatcgctgtgcagcgcaccgaaacgaccgaggtgcagcgggagatcctgcgagccttgaggatcaaggaaccgccgaagatcctgaaggtagaacctcgaacacgagggctgtagacactacacgagttatccacaggtcccacgaatccacgtcggacatgggtttgtgggacttcgtatga

SEQ ID NO: 2124 - DNA, 1722 bp, Artificial
  Alicyclobacillus acidocaldarius mutated SEQ ID NO 2110
atgtatatccgagtcattcgccgaaaaaacaagaacggttctgtcaccggttacgtgcagttggcccataactttcgcgatccccaaaccggccagcccaaggccaaggtcctctacaccttcggccgcgaagacgaaatcgacctcgaggccctccggcgccttgcccagagcatccatcgcttcgttggcgacgagtttaccgccggacgtggtcagtcggagggcatccaaaccacgctgctggatagccgtcctatgggaggggcgtatctgctagacgagctgtggcgacagcttggattggatgaggtcctgcgagagcggcttgccgaccggaagtttaaggcggctgtcgagcgtgtcatcttcgccatggtcgcgaatcgcgcgttggcgccaagcagcaagctggccatggaagaatgggtcgaccgtgaagtggctctccccgggatgaccgagttggacgtgtggcaggcataccgggcaatggactttctccatgatgtggcggaagacctgcaatacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctggcaacacagcggacatgagcgtggtcgaggaggtcaaacaggacctcatcggttggcggcttggtcgcgtgatcacggtcgtggatcgaggtttcgtctcagagagcaatttgcggatcctgcaacgcgccgggggtcactacatcgctggggagaagatgacctccgggaaaccagcggtggaagcggcgttggcgcgccctggacgttttcgtgagcttcgtcccaacctgaaagtgaaggaggtcgtggtgggagacggagaggcccgggtccgttacgtgttggcgttcaatcccgaggaagccaaacgcgatgaggcgcggcgggaggccatgttgcgcgagcttcggatggagttggaacgcctcaaagagcttcagggcgaagcgcacacgaaggcccactgtcggcttgcgagccatcccacgttcaagcgttatctgaaacaggaccgatgggggaacctgcgaattgacccggaggccgtgcggcaagcggctcatctggacgggaagtacctgatccgcacctccgatgacacgctgtcgacggaggatgtcgcactgggatacaagcagcttctgatggtggagtccgcgtttcggacgctgaagacgacgttggacatacgtcccgtgtatcaccggaaggacgagcggattcgttcgcatgtgctgctttgctggctggccttgttgttggtgcgcatcgccgaagttcaaatagggcgatcctggcccgatatccgctcccacgtgcaaggcaatgcacccagtgacgccttcaggcgggatcgctgtgcagcgcaccgaaacgaccgaggtgcagcgggagatcctgcgagccttgaggatcaaggaaccgccgaagatcctgaaggtagaacctcgaacacgagggctgtagacactacacgagttatccacaggtcccacgaatccacgtcggacatgggtttgtgggacttcgtatga

SEQ ID NO: 2125 - DNA, 1722 bp, Artificial
  Alicyclobacillus acidocaldarius mutated SEQ ID NO 2110
atgtatatccgagtcattcgccgaaaaaacaagaacggttctgtcaccggttacgtgcagttggcccataactttcgcgatcccaacaccggccagcccaaggccaaggtcctctacaccttcggccgcgaagacgaaatcgacctcgaggccctccggcgccttgcccagagcatccatcgcttcgttggcgacgagtttaccgccggacgtggtcagtcggagggcatccaaaccacgctgctggatagccgtcctatgggaggggcgtatctgctagacgagctgtggcgacagcttggattggatgaggtcattcgagagcggcttgccgaccggaagtttaaggcggctgtcgagcgtgtcatcttcgccatggtcgcgaatcgcgcgttggcgccaagcagcaagctggccatggaagaatgggtcgaccgtgaagtggctctccccgggatgaccgagttggacgtgtggcaggcataccgggcaatggactttctccatgatgtggcggaagacctgcaatacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctggcaacacagcggacatgagcgtggtcgaggaggtcaaacaggacctcatcggttggcggcttggtcgcgtgatcacggtcgtggatcgaggtttcgtctcagagagcaatttgcggatcctgcaacgcgccgggggtcactacatcgctggggagaagatgacctccgggaaaccagcggtggaagcggcgttggcgcgccctggacgttttcgtgagcttcgtcccaacctgaaagtgaaggaggtcgtggtgggagacggagaggcccgggtccgttacgtgttggcgttcaatcccgaggaagccaaacgcgatgaggcgcggcgggaggccatgttgcgcgagcttcggatggagttggaacgcctcaaagagcttcagggcgaagcgcacacgaaggcccactgtcggcttgcgagccatcccacgttcaagcgttatctgaaacaggaccgatgggggaacctgcgaattgacccggaggccgtgcggcaagcggctcatctggacgggaagtacctgatccgcacctccgatgacacgctgtcgacggaggatgtcgcactgggatacaagcagcttctgatggtggagtccgcgtttcggacgctgaagacgacgttggacatacgtcccgtgtatcaccggaaggacgagcggattcgttcgcatgtgctgctttgctggctggccttgttgttggtgcgcatcgccgaagttcaaatagggcgatcctggcccgatatccgctcccacgtgcaaggcaatgcacccagtgacgccttcaggcgggatcgctgtgcagcgcaccgaaacgaccgaggtgcagcgggagatcctgcgagccttgaggatcaaggaaccgccgaagatcctgaaggtagaacctcgaacacgagggctgtagacactacacgagttatccacaggtcccacgaatccacgtcggacatgggtttgtgggacttcgtatga

SEQ ID NO: 2126 - protein, 378 aa, Alicyclobacillus acidocaldarius
MREVNGMELTRTIRVRLEPTPEQASALARTVEANRQALDYVSRIAFERKIRNRVALHRAAYRTIRTRFGLRAQMACTVCRVVAGVYKSMKSNGNEDTPAEFKRAKPVFQWNKDYVLRNGVAHITTIDGRLRIPFRVEPPYRRYLQDGWTFGAAELVRKRHGWYLHVSVSKSVPDHADDFDAVIGVDQGMRFLVTASCGDQVMFIRGGRVKQTRLRYVRLRASLQRKGTRSAKRRLKAIGRRESRFMTDVNHQIAKAVVRFAQAQGQRPLIVLEDLTGSNLSVRFRLKDRYWRMSWAFRQLTDFIRYKAEEAGIAVMFIDPTGTSETCPKCGHCETANRSRKRHEFRCKKCGYRCNDDLAASRVIAQKGLECLRQSQSA

SEQ ID NO: 2127 - DNA, 1137 bp, Alicyclobacillus acidocaldarius
gtgagggaggtgaatggcatggagctcacccgcaccatccgtgttcggcttgaaccgacgccggaacaagcttctgcactggctcgcaccgtcgaggccaatcgacaggcccttgactacgtgagccgcatcgcttttgagcgcaagatccgaaaccgtgtcgccttgcaccgcgccgcgtaccgaaccattcgcacccgattcggtctgcgtgcgcagatggcctgcacggtgtgccgcgtcgtcgcgggcgtctacaagagcatgaagtcgaacgggaatgaggacacgcccgcggagttcaaacgagcgaagcccgtgttccagtggaacaaggactacgtgctgcgaaacggcgtggcgcacatcacgacgatcgacggtcggctgcggatccctttccgcgtggagcctccataccggcggtacttgcaggacggctggaccttcggtgcagccgaactggttcggaagcgacacggctggtatctgcacgtgtccgtctccaagtcggtaccggatcacgccgacgatttcgacgccgtgatcggcgttgaccagggcatgcgcttccttgtgaccgcttcctgcggggatcaggtgatgttcattcgcggtggcagggtcaagcagacccgtctccgctacgtccgtctgcgcgcgtctcttcagcgcaaaggcactcgctcggccaagcgccgtctgaaggccattggccgaagagaatcccgtttcatgacggacgtcaatcaccagattgccaaggccgtagtccgcttcgcacaagcccaaggtcaacgcccgctcattgtgctcgaagacctcacaggcagcaacttgtccgtccggttccggcttaaggaccgatactggcgcatgagctgggcgtttcggcagttgacggacttcatccgctacaaggcggaagaagccgggatcgccgttatgttcatcgatccgacgggtacaagcgagacctgcccgaagtgcgggcactgcgaaaccgcgaatcgaagccgcaagcgtcacgaattccgttgcaagaagtgcggctaccgttgcaatgacgacttagccgcaagccgcgtgatcgctcaaaaaggcctggaatgcttgcggcagagccagagcgcatga

SEQ ID NO: 2128 - protein, 363 aa, Geobacillus kaustophilus; identical to SEQ ID NO: 2043

SEQ ID NO: 2129 - protein, 363 aa, Geobacillus kaustophilus; identical to SEQ ID NO: 2044

SEQ ID NO: 2130 - protein, 362 aa, Bacillus selenitireducens; identical to SEQ ID NO: 2046

SEQ ID NO: 2131 - protein, 367 aa, Clostridium botulinum Bf; identical to SEQ ID NO: 2045

SEQ ID NO: 2132 - protein, 360 aa, Bacillus cereus; identical to SEQ ID NO: 2047

SEQ ID NO: 2133 - protein, 378 aa, Artificial
  Alicyclobacillus acidocaldarius mutated SEQ ID NO 2126
MREVNGMELTRTIRVRLEPTPEQASALARTVEANRQALDYVSRIAFERKIRNRVALHRAAYRTIRTRFGLRAQMACTVCRVVAGVYKSMKSNGNEDTPAEFKRAKPVFQWNKDYVLRNGVAHITTIDGRLRIPFRVEPPYRRYLQDGWTFGAAELVRKRHGWYLHVSVSKSVPDHADDFDAVIGVDQGMRFLVTASCGDQVMFIRGGRVKQTRLRYVRLRASLQRKGTRSAKRRLKAIGRRESRFMTDVNHQIAKAVVRFAQAQGQKPLIVLEDLTGSNLSVRFRLKDRYWRMSWAFRQLTDFIRYKAEEAGIAVMFIDPTGTSETCPKCGHCETANRSRKRHEFRCKKCGYRCNDDLAASRVIAQKGLECLRQSQSA

SEQ ID NO: 2134 - protein, 378 aa, Artificial
  Alicyclobacillus acidocaldarius mutated SEQ ID NO 2126
MREVNGMELTRTIRVRLEPTPEQASALARTVEANRQALDYVSRIAFERKIRNRVALHRAAYRTIRTRFGLRAQMACTVCRVVAGVYKSMKSNGNEDTPAEFKRAKPVFQWNKDYVLRNGVAHITTIDGRLRIPFRVEPPYRRYLQDGWTFGAAELVRKRHGWYLHVSVSKSVPDHADDFDAVIGVDQGMRFLVTASCGDQVMFLRGGRVKQTRLRYVRLRASLQRKGTRSAKRRLKAIGRRESRFMTDVNHQIAKAVVRFAQAQGQRPLIVLEDLTGSNLSVRFRLKDRYWRMSWAFRQLTDFIRYKAEEAGIAVMFIDPTGTSETCPKCGHCETANRSRKRHEFRCKKCGYRCNDDLAASRVIAQKGLECLRQSQSA

SEQ ID NO: 2135 - protein, 378 aa, Artificial
  Alicyclobacillus acidocaldarius mutated SEQ ID NO 2126
MREVNGMELTRTIRVRLEPTPEQASALARTVEANRQALDYVSRIAFERKIRNRVALHRAAYRTIRTRFGLRAQMACTVCRVVAGVYKSMKSNGNEDTPAEFKRAKPVFQWNKDYVLRNGVAHITTIDGRLRIPFRVEPPYRRYLQDGWTFGAAELVRKRHGWYLHVSVSKSVPDHADDFDAVIGVDQGMRFLVTASCGDQVMFIRGGRVKQTRLRYVRLRASLQRKGTRSAKRRLKAIGRRESRFMTDVNHQIAKAVVRFAQAQGQRPLIVLEDLTGSNLSVRFRLKDRYWRMSWAFRQLTDFIRYKAEEAGIAVMFIDPTGTSETCPKCGHCETANRSRKRHEFRCKKCGYRCNDDLAASRVIAQKGLECLRNSQSA

SEQ ID NO: 2136 - protein, 378 aa, Artificial
  Alicyclobacillus acidocaldarius mutated SEQ ID NO 2126
MREVNGMELTRTIRVRLEPTPEQASALARTVEANRQALDYVSRIAFERKIRNRVALHRAAYRTIRTRFGLRAQMACTVCRVVAGVYKSMKSNGNEDTPAEFKKAKPVFQWNKDYVLRNGVAHITTIDGRLRIPFRVEPPYRRYLQDGWTFGAAELVRKRHGWYLHVSVSKSVPDHADDFDAVIGVDQGMRFLVTASCGDQVMFIRGGRVKQTRLRYVRLRASLQRKGTRSAKRRLKAIGRRESRFMTDVNHQIAKAVVRFAQAQGQRPLIVLEDLTGSNLSVRFRLKDRYWRMSWAFRQLTDFIRYKAEEAGIAVMFIDPTGTSETCPKCGHCETANRSRKRHEFRCKKCGYRCNDDLAASRVIAQKGLECLRQSQSA

SEQ ID NO: 2137 - protein, 378 aa, Artificial
  Alicyclobacillus acidocaldarius mutated SEQ ID NO 2126
MREVNGMELTRTIRVRLEPTPEQASALARTVEANRQALDYVSRIAFERKIRNRVALHRAAYRTIRTRFGLRAQMACTVCRVVAGVYKSMKSNGNEDTPAEFKRAKPVFQWNKDYVLRNGVAHITTIDGRLRIPFRVEPPYRRYLNDGWTFGAAELVRKRHGWYLHVSVSKSVPDHADDFDAVIGVDQGMRFLVTASCGDQVMFIRGGRVKQTRLRYVRLRASLQRKGTRSAKRRLKAIGRRESRFMTDVNHQIAKAVVRFAQAQGQRPLIVLEDLTGSNLSVRFRLKDRYWRMSWAFRQLTDFIRYKAEEAGIAVMFIDPTGTSETCPKCGHCETANRSRKRHEFRCKKCGYRCNDDLAASRVIAQKGLECLRQSQSA

SEQ ID NO: 2138 - DNA, 1137 bp, Artificial
  Alicyclobacillus acidocaldarius mutated SEQ ID NO 2127
gtgagggaggtgaatggcatggagctcacccgcaccatccgtgttcggcttgaaccgacgccggaacaagcttctgcactggctcgcaccgtcgaggccaatcgacaggcccttgactacgtgagccgcatcgcttttgagcgcaagatccgaaaccgtgtcgccttgcaccgcgccgcgtaccgaaccattcgcacccgattcggtctgcgtgcgcagatggcctgcacggtgtgccgcgtcgtcgcgggcgtctacaagagcatgaagtcgaacgggaatgaggacacgcccgcggagttcaaacgagcgaagcccgtgttccagtggaacaaggactacgtgctgcgaaacggcgtggcgcacatcacgacgatcgacggtcggctgcggatccctttccgcgtggagcctccataccggcggtacttgcaggacggctggaccttcggtgcagccgaactggttcggaagcgacacggctggtatctgcacgtgtccgtctccaagtcggtaccggatcacgccgacgatttcgacgccgtgatcggcgttgaccagggcatgcgcttccttgtgaccgcttcctgcggggatcaggtgatgttcattcgcggtggcagggtcaagcagacccgtctccgctacgtccgtctgcgcgcgtctcttcagcgcaaaggcactcgctcggccaagcgccgtctgaaggccattggccgaagagaatcccgtttcatgacggacgtcaatcaccagattgccaaggccgtagtccgcttcgcacaagcccaaggtcaaaaaccgctcattgtgctcgaagacctcacaggcagcaacttgtccgtccggttccggcttaaggaccgatactggcgcatgagctgggcgtttcggcagttgacggacttcatccgctacaaggcggaagaagccgggatcgccgttatgttcatcgatccgacgggtacaagcgagacctgcccgaagtgcgggcactgcgaaaccgcgaatcgaagccgcaagcgtcacgaattccgttgcaagaagtgcggctaccgttgcaatgacgacttagccgcaagccgcgtgatcgctcaaaaaggcctggaatgcttgcggcagagccagagcgcatga

SEQ ID NO: 2139 - DNA, 1137 bp, Artificial
  Alicyclobacillus acidocaldarius mutated SEQ ID NO 2127
gtgagggaggtgaatggcatggagctcacccgcaccatccgtgttcggcttgaaccgacgccggaacaagcttctgcactggctcgcaccgtcgaggccaatcgacaggcccttgactacgtgagccgcatcgcttttgagcgcaagatccgaaaccgtgtcgccttgcaccgcgccgcgtaccgaaccattcgcacccgattcggtctgcgtgcgcagatggcctgcacggtgtgccgcgtcgtcgcgggcgtctacaagagcatgaagtcgaacgggaatgaggacacgcccgcggagttcaaacgagcgaagcccgtgttccagtggaacaaggactacgtgctgcgaaacggcgtggcgcacatcacgacgatcgacggtcggctgcggatccctttccgcgtggagcctccataccggcggtacttgcaggacggctggaccttcggtgcagccgaactggttcggaagcgacacggctggtatctgcacgtgtccgtctccaagtcggtaccggatcacgccgacgatttcgacgccgtgatcggcgttgaccagggcatgcgcttccttgtgaccgcttcctgcggggatcaggtgatgttcttacgcggtggcagggtcaagcagacccgtctccgctacgtccgtctgcgcgcgtctcttcagcgcaaaggcactcgctcggccaagcgccgtctgaaggccattggccgaagagaatcccgtttcatgacggacgtcaatcaccagattgccaaggccgtagtccgcttcgcacaagcccaaggtcaacgcccgctcattgtgctcgaagacctcacaggcagcaacttgtccgtccggttccggcttaaggaccgatactggcgcatgagctgggcgtttcggcagttgacggacttcatccgctacaaggcggaagaagccgggatcgccgttatgttcatcgatccgacgggtacaagcgagacctgcccgaagtgcgggcactgcgaaaccgcgaatcgaagccgcaagcgtcacgaattccgttgcaagaagtgcggctaccgttgcaatgacgacttagccgcaagccgcgtgatcgctcaaaaaggcctggaatgcttgcggcagagccagagcgcatga

SEQ ID NO: 2140 - DNA, 1137 bp, Artificial
  Alicyclobacillus acidocaldarius mutated SEQ ID NO 2127
gtgagggaggtgaatggcatggagctcacccgcaccatccgtgttcggcttgaaccgacgccggaacaagcttctgcactggctcgcaccgtcgaggccaatcgacaggcccttgactacgtgagccgcatcgcttttgagcgcaagatccgaaaccgtgtcgccttgcaccgcgccgcgtaccgaaccattcgcacccgattcggtctgcgtgcgcagatggcctgcacggtgtgccgcgtcgtcgcgggcgtctacaagagcatgaagtcgaacgggaatgaggacacgcccgcggagttcaaacgagcgaagcccgtgttccagtggaacaaggactacgtgctgcgaaacggcgtggcgcacatcacgacgatcgacggtcggctgcggatccctttccgcgtggagcctccataccggcggtacttgcaggacggctggaccttcggtgcagccgaactggttcggaagcgacacggctggtatctgcacgtgtccgtctccaagtcggtaccggatcacgccgacgatttcgacgccgtgatcggcgttgaccagggcatgcgcttccttgtgaccgcttcctgcggggatcaggtgatgttcattcgcggtggcagggtcaagcagacccgtctccgctacgtccgtctgcgcgcgtctcttcagcgcaaaggcactcgctcggccaagcgccgtctgaaggccattggccgaagagaatcccgtttcatgacggacgtcaatcaccagattgccaaggccgtagtccgcttcgcacaagcccaaggtcaacgcccgctcattgtgctcgaagacctcacaggcagcaacttgtccgtccggttccggcttaaggaccgatactggcgcatgagctgggcgtttcggcagttgacggacttcatccgctacaaggcggaagaagccgggatcgccgttatgttcatcgatccgacgggtacaagcgagacctgcccgaagtgcgggcactgcgaaaccgcgaatcgaagccgcaagcgtcacgaattccgttgcaagaagtgcggctaccgttgcaatgacgacttagccgcaagccgcgtgatcgctcaaaaaggcctggaatgcttgcggaatagccagagcgcatga

SEQ ID NO: 2141 - DNA, 1137 bp, Artificial
  Alicyclobacillus acidocaldarius mutated SEQ ID NO 2127
gtgagggaggtgaatggcatggagctcacccgcaccatccgtgttcggcttgaaccgacgccggaacaagcttctgcactggctcgcaccgtcgaggccaatcgacaggcccttgactacgtgagccgcatcgcttttgagcgcaagatccgaaaccgtgtcgccttgcaccgcgccgcgtaccgaaccattcgcacccgattcggtctgcgtgcgcagatggcctgcacggtgtgccgcgtcgtcgcgggcgtctacaagagcatgaagtcgaacgggaatgaggacacgcccgcggagttcaaaaaagcgaagcccgtgttccagtggaacaaggactacgtgctgcgaaacggcgtggcgcacatcacgacgatcgacggtcggctgcggatccctttccgcgtggagcctccataccggcggtacttgcaggacggctggaccttcggtgcagccgaactggttcggaagcgacacggctggtatctgcacgtgtccgtctccaagtcggtaccggatcacgccgacgatttcgacgccgtgatcggcgttgaccagggcatgcgcttccttgtgaccgcttcctgcggggatcaggtgatgttcattcgcggtggcagggtcaagcagacccgtctccgctacgtccgtctgcgcgcgtctcttcagcgcaaaggcactcgctcggccaagcgccgtctgaaggccattggccgaagagaatcccgtttcatgacggacgtcaatcaccagattgccaaggccgtagtccgcttcgcacaagcccaaggtcaacgcccgctcattgtgctcgaagacctcacaggcagcaacttgtccgtccggttccggcttaaggaccgatactggcgcatgagctgggcgtttcggcagttgacggacttcatccgctacaaggcggaagaagccgggatcgccgttatgttcatcgatccgacgggtacaagcgagacctgcccgaagtgcgggcactgcgaaaccgcgaatcgaagccgcaagcgtcacgaattccgttgcaagaagtgcggctaccgttgcaatgacgacttagccgcaagccgcgtgatcgctcaaaaaggcctggaatgcttgcggcagagccagagcgcatga

SEQ ID NO: 2142 - DNA, 1137 bp, Artificial
  Alicyclobacillus acidocaldarius mutated SEQ ID NO 2127
gtgagggaggtgaatggcatggagctcacccgcaccatccgtgttcggcttgaaccgacgccggaacaagcttctgcactggctcgcaccgtcgaggccaatcgacaggcccttgactacgtgagccgcatcgcttttgagcgcaagatccgaaaccgtgtcgccttgcaccgcgccgcgtaccgaaccattcgcacccgattcggtctgcgtgcgcagatggcctgcacggtgtgccgcgtcgtcgcgggcgtctacaagagcatgaagtcgaacgggaatgaggacacgcccgcggagttcaaacgagcgaagcccgtgttccagtggaacaaggactacgtgctgcgaaacggcgtggcgcacatcacgacgatcgacggtcggctgcggatccctttccgcgtggagcctccataccggcggtacttgaatgacggctggaccttcggtgcagccgaactggttcggaagcgacacggctggtatctgcacgtgtccgtctccaagtcggtaccggatcacgccgacgatttcgacgccgtgatcggcgttgaccagggcatgcgcttccttgtgaccgcttcctgcggggatcaggtgatgttcattcgcggtggcagggtcaagcagacccgtctccgctacgtccgtctgcgcgcgtctcttcagcgcaaaggcactcgctcggccaagcgccgtctgaaggccattggccgaagagaatcccgtttcatgacggacgtcaatcaccagattgccaaggccgtagtccgcttcgcacaagcccaaggtcaacgcccgctcattgtgctcgaagacctcacaggcagcaacttgtccgtccggttccggcttaaggaccgatactggcgcatgagctgggcgtttcggcagttgacggacttcatccgctacaaggcggaagaagccgggatcgccgttatgttcatcgatccgacgggtacaagcgagacctgcccgaagtgcgggcactgcgaaaccgcgaatcgaagccgcaagcgtcacgaattccgttgcaagaagtgcggctaccgttgcaatgacgacttagccgcaagccgcgtgatcgctcaaaaaggcctggaatgcttgcggcagagccagagcgcatga

SEQ ID NO: 2143 - protein, 267 aa, Alicyclobacillus acidocaldarius
MVYVLRSGLAHITTFDGRLRIPYHVEPPYLRYLQDGWTFGAAELVQKRHRWYLHVSVSKTAPDPVGDFDAVIGIDQGMRFLITASCGNQVMFIRGGKVKQTRLRYVRLRASLQRKGTRSAKRRLKAIGRRESRFMADVNHQIAKAVIRFAQTQGQRPLIVLEDLTGSNLSVRFRLKDQYWRMSWSFRQLADFIRYKAEEAGIAVMLVDPAGTSETCPKCGHCEPANRSRKRHEFRCKRCGYRCNDDLAASRVIAQKGLECLRQSQSA

SEQ ID NO: 2144 - DNA, 804 bp, Alicyclobacillus acidocaldarius
atggtgtatgtgctgcgaagcggcttggcgcacatcacgacgttcgacggtcggctacggatcccttaccatgtcgagcctccttacctgcggtacttgcaggacggttggacgttcggcgcagccgaactggtgcagaaacggcaccgatggtacttgcacgtgtccgtgtcgaagacagcgccggatcccgtcggcgattttgacgccgtgatcggcatcgaccagggcatgcggtttctcatcacggcttcctgcggcaatcaggtgatgttcattcgcggcggcaaggtcaaacagacccgtctccgctacgtccgcctgcgcgcgtccttgcagcgcaaaggcactcgctcggccaaacgacgtctgaaagcgattggtcgaagagaatcccgtttcatggcggacgtcaatcaccaaattgccaaggccgtgatccgattcgcgcaaacccaaggccagcgcccgctgattgtgctggaagacctcacgggcagcaacttgtctgtccggttccggctcaaagaccaatactggcgcatgagctggtcgttccgacaattggcggacttcatccgctacaaggcggaggaagccgggatcgccgtcatgcttgttgatcctgcgggcacaagcgagacctgcccgaagtgcgggcactgcgagcctgccaaccggagccgcaagcggcacgaattccgctgcaagaggtgcggctaccgttgcaacgacgacctggccgcaagccgcgtgatcgcccaaaagggcttggaatgcttgcggcagagccagagcgcatga

SEQ ID NO: 2145 - protein, 256 aa, Geobacillus kaustophilus
YSIVQGLFSVNTLEGRIKVPFEPKGMEPYFDGSWTFGTAKLVYKHNKFFLHIPMTKTIPTVDEHNIRQVVGVDVGVNFLAAAYDSQGKTTFFNGRKIKHMRAKYKRMRKTLQQKGTASARRKLKTIGQRENRWMTDVNHAVTKALVRQYGERTLFVLEDLTGIREKTERVRIHDRYETVSWAFYQFRQLLEYKARLHGSKVMVVAPHYTSLTCPKCGHTEKANRNKRTHTFCCRTCGYTSNDDRIGAMNLQRKGIE

SEQ ID NO: 2146 - protein, 256 aa, Geobacillus kaustophilus
YSIVQGLFSVNTLEGRIKVSFEPKGMEPYFDGSWTFGTAKLVYKHNKFFLHIPMTKTIPTVDEHNIRQVVGVDVGVNFLAVAYDSQGKTIFFNGRKIKHMRAKYKRMRKTLQQKGTASARRKLKTIGQRENRWMTDVNHAVTKALVRQYGERTLFVLEDLTGIREKTERVRIHDRYETVSWAFYQFRQMLEYKARLHGSKVIVVAPHYTSLTCPKCGHTEKANRKKRTHTFCCRTCGYTSNDDRIGAMNLQRKGIE

SEQ ID NO: 2147 - protein, 255 aa, Bacillus selenitireducens
YSLTKGLFSVNTLEGRIKVPFYTEGLEPYFDGTWTFGTAKLVHKYGKWFLHIPVSKDVQEANLDNINQVVGIDMGVNFTATTYDSNGQTRFFNGKQIKHKRAKYKQMRKELQQKQTPSARRKLKKIGQRENRWMQNINYCISKALVEQYGKDTLFVMEDLTGVRNATEKVRVKDRYQTVSWSFNDLRQKIAYKAQKTGALGIAVDPGYTSQTCPKCGHTEKANRNKKTHTFCCQTCQYTSNDDRIGAMNLQRKGI

SEQ ID NO: 2148 - protein, 248 aa, Clostridium botulinum
INTIAKRIKVHFKVNNYFKKYLTKEWSFGSLEIVERENSYYAHITVSKEVQEKPLNEFKNIIGIDLGQNFIATFYDSKGKIKFFKGRYLKDMRAKYTRLRKQLQRKGTYNAHKKIVTINQREQRTMTYINHKISKEIVEYAKQNNAIIAMENLTGINLSCKVKKDNRYYRVSWAFNQLQQFIEYKAVQAGLKVIYINPKYTSQTCPICGHIHKDNRNKKLHIFKCRACGCTLNDDLIGAKNIQHKGYD

SEQ ID NO: 2149 - protein, 261 aa, Clostridium kluyveri
YSLNKNIFSINSLQGRLKIPYQSKGMEKYFDGSYSFGTAKLVYKFNKYFLHIPVTKDYPQTTPFEINKIVGIDLGINFLATTYDSFGKATFYQGRHIKAKRGHYKILRKQLQECGSKSAKRRIKSIGSRENRYVSDINHQITKSLVDKYGTNTLFVLEDLTNVRTATEKVTINNRYVSVSWAFYQFRQLLEYKAQMNGSIVMAVNPKYTSQTCPKCGHIEKANRDKKNHIFKCKNCSYQSNDDRIGAINLWRKGIEYIEQS

SEQ ID NO: 2150 - protein, 267 aa, Artificial
  Alicyclobacillus acidocaldarius mutated SEQ ID NO 2143
MVYVLRSGLAHITTFDGRLRIPYHVEPPYLRYLQDGWTFGAAELVQKRHRWYLHVSVSKTAPDPVGDFDAVIGIDQGMRFLITASCGNQVMFIRGGKVKQTRLRYVRLRASLQRKGTRSAKRRLKAIGRRESRFMADVNHQIAKAVIRFAQTQGQRPLIVLEDLTGSNLSVRFRLKDQYWRMSWSFRQLADFIRYKAEEAGIAVMLVDPAGTSETCPKCGHCEPANRSRKRHEFRCKRCGYRCNDDLAASRVIAQKGLECLRNSQSA

SEQ ID NO: 2151 - protein, 267 aa, Artificial
  Alicyclobacillus acidocaldarius mutated SEQ ID NO 2143
MVYVLRSGLAHITTFDGRLRIPYHVEPPYLRYLQDGWTFGAAELVQKRHRWYLHVSVSKTAPDPVGDFDAVIGIDQGMRFLITASCGNQVMFIRGGKVKQTRLRYVRLRASLQRKGTRSAKRRLKAIGRRESRFMADVNHQIAKAVIRFANTQGQRPLIVLEDLTGSNLSVRFRLKDQYWRMSWSFRQLADFIRYKAEEAGIAVMLVDPAGTSETCPKCGHCEPANRSRKRHEFRCKRCGYRCNDDLAASRVIAQKGLECLRQSQSA

SEQ ID NO: 2152 - protein, 267 aa, Artificial
  Alicyclobacillus acidocaldarius mutated SEQ ID NO 2143
MVYVLRSGLAHITTFDGRLRIPYHVEPPYLRYLQDGWTFGAAELVQKRHRWYLHVSVSKTAPDPVGDFDAVIGIDQGMRFLITASCGQQVMFIRGGKVKQTRLRYVRLRASLQRKGTRSAKRRLKAIGRRESRFMADVNHQIAKAVIRFAQTQGQRPLIVLEDLTGSNLSVRFRLKDQYWRMSWSFRQLADFIRYKAEEAGIAVMLVDPAGTSETCPKCGHCEPANRSRKRHEFRCKRCGYRCNDDLAASRVIAQKGLECLRQSQSA

SEQ ID NO: 2153 - protein, 267 aa, Artificial
  Alicyclobacillus acidocaldarius mutated SEQ ID NO 2143
MVYVLRSGLAHITTFDGRLRIPYHVEPPYLRYLQDGWTFGAAELVQKRHRWYLHVSVSKTAPDPVGDFDAVIGIDQGMRFLLTASCGNQVMFIRGGKVKQTRLRYVRLRASLQRKGTRSAKRRLKAIGRRESRFMADVNHQIAKAVIRFAQTQGQRPLIVLEDLTGSNLSVRFRLKDQYWRMSWSFRQLADFIRYKAEEAGIAVMLVDPAGTSETCPKCGHCEPANRSRKRHEFRCKRCGYRCNDDLAASRVIAQKGLECLRQSQSA

SEQ ID NO: 2154 - protein, 267 aa, Artificial
  Alicyclobacillus acidocaldarius mutated SEQ ID NO 2143
MVYVLRSGLAHITTFDGRLRIPYHVEPPYLRYLQDGWTFGAAELVQKRHRWYLHVSVSKTAPDPVGDFDAVIGIDQGMRFLITASCGNQVMFIRGGKVKQTRLRYVRLRASLQRKGTRSAKRRLKAIGRRESRFMADVNHQIAKAVIRFAQTQGQRPLIVLEDLTGSNLSIRFRLKDQYWRMSWSFRQLADFIRYKAEEAGIAVMLVDPAGTSETCPKCGHCEPANRSRKRHEFRCKRCGYRCNDDLAASRVIAQKGLECLRQSQSA

SEQ ID NO: 2155 - DNA, 804 bp, Artificial
  Alicyclobacillus acidocaldarius mutated SEQ ID NO 2144
atggtgtatgtgctgcgaagcggcttggcgcacatcacgacgttcgacggtcggctacggatcccttaccatgtcgagcctccttacctgcggtacttgcaggacggttggacgttcggcgcagccgaactggtgcagaaacggcaccgatggtacttgcacgtgtccgtgtcgaagacagcgccggatcccgtcggcgattttgacgccgtgatcggcatcgaccagggcatgcggtttctcatcacggcttcctgcggcaatcaggtgatgttcattcgcggcggcaaggtcaaacagacccgtctccgctacgtccgcctgcgcgcgtccttgcagcgcaaaggcactcgctcggccaaacgacgtctgaaagcgattggtcgaagagaatcccgtttcatggcggacgtcaatcaccaaattgccaaggccgtgatccgattcgcgcaaacccaaggccagcgcccgctgattgtgctggaagacctcacgggcagcaacttgtctgtccggttccggctcaaagaccaatactggcgcatgagctggtcgttccgacaattggcggacttcatccgctacaaggcggaggaagccgggatcgccgtcatgcttgttgatcctgcgggcacaagcgagacctgcccgaagtgcgggcactgcgagcctgccaaccggagccgcaagcggcacgaattccgctgcaagaggtgcggctaccgttgcaacgacgacctggccgcaagccgcgtgatcgcccaaaagggcttggaatgcttgcggaatagccagagcgcatga

SEQ ID NO: 2156 - DNA, 804 bp, Artificial
  Alicyclobacillus acidocaldarius mutated SEQ ID NO 2144
atggtgtatgtgctgcgaagcggcttggcgcacatcacgacgttcgacggtcggctacggatcccttaccatgtcgagcctccttacctgcggtacttgcaggacggttggacgttcggcgcagccgaactggtgcagaaacggcaccgatggtacttgcacgtgtccgtgtcgaagacagcgccggatcccgtcggcgattttgacgccgtgatcggcatcgaccagggcatgcggtttctcatcacggcttcctgcggcaatcaggtgatgttcattcgcggcggcaaggtcaaacagacccgtctccgctacgtccgcctgcgcgcgtccttgcagcgcaaaggcactcgctcggccaaacgacgtctgaaagcgattggtcgaagagaatcccgtttcatggcggacgtcaatcaccaaattgccaaggccgtgatccgattcgcgaatacccaaggccagcgcccgctgattgtgctggaagacctcacgggcagcaacttgtctgtccggttccggctcaaagaccaatactggcgcatgagctggtcgttccgacaattggcggacttcatccgctacaaggcggaggaagccgggatcgccgtcatgcttgttgatcctgcgggcacaagcgagacctgcccgaagtgcgggcactgcgagcctgccaaccggagccgcaagcggcacgaattccgctgcaagaggtgcggctaccgttgcaacgacgacctggccgcaagccgcgtgatcgcccaaaagggcttggaatgcttgcggcagagccagagcgcatga

SEQ ID NO: 2157 - DNA, 804 bp, Artificial
  Alicyclobacillus acidocaldarius mutated SEQ ID NO 2144
atggtgtatgtgctgcgaagcggcttggcgcacatcacgacgttcgacggtcggctacggatcccttaccatgtcgagcctccttacctgcggtacttgcaggacggttggacgttcggcgcagccgaactggtgcagaaacggcaccgatggtacttgcacgtgtccgtgtcgaagacagcgccggatcccgtcggcgattttgacgccgtgatcggcatcgaccagggcatgcggtttctcatcacggcttcctgcggccaacaggtgatgttcattcgcggcggcaaggtcaaacagacccgtctccgctacgtccgcctgcgcgcgtccttgcagcgcaaaggcactcgctcggccaaacgacgtctgaaagcgattggtcgaagagaatcccgtttcatggcggacgtcaatcaccaaattgccaaggccgtgatccgattcgcgcaaacccaaggccagcgcccgctgattgtgctggaagacctcacgggcagcaacttgtctgtccggttccggctcaaagaccaatactggcgcatgagctggtcgttccgacaattggcggacttcatccgctacaaggcggaggaagccgggatcgccgtcatgcttgttgatcctgcgggcacaagcgagacctgcccgaagtgcgggcactgcgagcctgccaaccggagccgcaagcggcacgaattccgctgcaagaggtgcggctaccgttgcaacgacgacctggccgcaagccgcgtgatcgcccaaaagggcttggaatgcttgcggcagagccagagcgcatga

SEQ ID NO: 2158 - DNA, 804 bp, Artificial
  Alicyclobacillus acidocaldarius mutated SEQ ID NO 2144
atggtgtatgtgctgcgaagcggcttggcgcacatcacgacgttcgacggtcggctacggatcccttaccatgtcgagcctccttacctgcggtacttgcaggacggttggacgttcggcgcagccgaactggtgcagaaacggcaccgatggtacttgcacgtgtccgtgtcgaagacagcgccggatcccgtcggcgattttgacgccgtgatcggcatcgaccagggcatgcggtttctcttaacggcttcctgcggcaatcaggtgatgttcattcgcggcggcaaggtcaaacagacccgtctccgctacgtccgcctgcgcgcgtccttgcagcgcaaaggcactcgctcggccaaacgacgtctgaaagcgattggtcgaagagaatcccgtttcatggcggacgtcaatcaccaaattgccaaggccgtgatccgattcgcgcaaacccaaggccagcgcccgctgattgtgctggaagacctcacgggcagcaacttgtctgtccggttccggctcaaagaccaatactggcgcatgagctggtcgttccgacaattggcggacttcatccgctacaaggcggaggaagccgggatcgccgtcatgcttgttgatcctgcgggcacaagcgagacctgcccgaagtgcgggcactgcgagcctgccaaccggagccgcaagcggcacgaattccgctgcaagaggtgcggctaccgttgcaacgacgacctggccgcaagccgcgtgatcgcccaaaagggcttggaatgcttgcggcagagccagagcgcatga

SEQ ID NO: 2159 - DNA, 804 bp, Artificial
  Alicyclobacillus acidocaldarius mutated SEQ ID NO 2144
atggtgtatgtgctgcgaagcggcttggcgcacatcacgacgttcgacggtcggctacggatcccttaccatgtcgagcctccttacctgcggtacttgcaggacggttggacgttcggcgcagccgaactggtgcagaaacggcaccgatggtacttgcacgtgtccgtgtcgaagacagcgccggatcccgtcggcgattttgacgccgtgatcggcatcgaccagggcatgcggtttctcatcacggcttcctgcggcaatcaggtgatgttcattcgcggcggcaaggtcaaacagacccgtctccgctacgtccgcctgcgcgcgtccttgcagcgcaaaggcactcgctcggccaaacgacgtctgaaagcgattggtcgaagagaatcccgtttcatggcggacgtcaatcaccaaattgccaaggccgtgatccgattcgcgcaaacccaaggccagcgcccgctgattgtgctggaagacctcacgggcagcaacttgtctattcggttccggctcaaagaccaatactggcgcatgagctggtcgttccgacaattggcggacttcatccgctacaaggcggaggaagccgggatcgccgtcatgcttgttgatcctgcgggcacaagcgagacctgcccgaagtgcgggcactgcgagcctgccaaccggagccgcaagcggcacgaattccgctgcaagaggtgcggctaccgttgcaacgacgacctggccgcaagccgcgtgatcgcccaaaagggcttggaatgcttgcggcagagccagagcgcatga

SEQ ID NO: 2160 - protein, 310 aa, Alicyclobacillus acidocaldarius
MVRDSQHPDQLQSMVTAFFMEYHIGKLLRQSNITKQAGIPVLEVFRLLFALVFHQRSLKRVLEQLAMNQFGKDTVYRFLNSPRHNWRRFLLLLSSAVVRRTARLTSEDRADVFIVDDSLFSRSRSKKVELLAKVYDHVLRSNLLTEQPASIPSGDYYFDGMVYSPAGVNRPYAHPDKGYYGISPYVTWHRVGNQDLHCQIDYYDSQSILEAPAWAVGSGVGALVGGMVTDGNLTGSVIGAIIGGALGAYYGAQVERLADENGCIWFTIDNNPPIVNLGTWWAPEWYMDVRYIELGPWATTNFYYYLGGVY

SEQ ID NO: 2161 - DNA, 933 bp, Alicyclobacillus acidocaldarius
atggtacgtgattctcagcacccagatcaactccagtccatggtaacggcgttcttcatggaataccatatcggcaaactgctcaggcagtccaacatcactaagcaggccggtatccctgtactggaggtatttcgacttctgtttgcgctagtcttccatcagcgcagtctgaaacgtgtgctggaacaactcgctatgaaccaatttggcaaggatacggtgtatcggtttttaaactctccccggcacaactggcggcggtttctgctgttgctcagttctgctgttgtacgtcgtaccgctcgactcacctccgaagatcgggcggatgtgttcatcgtcgatgattcactgttcagccgcagtcgcagcaagaaggtggaactgctggccaaggtctatgaccacgtcttacggagcaacctgcttacggagcaacctgcttcaattccttctggtgattactactttgatggtatggtctattctccagcgggtgttaatagaccgtacgcccatccagacaaagggtattatggtatatccccatacgtcacctggcaccgagtaggaaaccaagatttacattgtcaaattgattattatgattctcaatccatattggaagctcctgcttgggctgtaggcagtggggttggtgcactagttgggggtatggtaactgatggaaaccttactggttccgtgatcggcgctatcattggcggagcccttggcgcatattacggtgcacaggttgaacgtttagcggacgaaaatgggtgtatttggttcactatagacaacaatccgcctatcgtcaacctgggtacttggtgggcgcctgaatggtatatggatgtccgctatattgaattggggccttgggcaaccaccaatttctattactacttaggaggtgtatactga

SEQ ID NO: 2162 - protein, 139 aa, Desulfitobacterium hafniense
MLQHNSLPEQHQNQLSLIFSSLKLSQLLRAAGIRKSYGVSSFVVFQIIFQLVFQGRNLFRLLEGSRAESLPGKDVVYRFLNDSRYNWRRFYQLLSLKMVGRFEKLTSAQRIRVFIVDDSVMERERSKKVELLARVFDHV

SEQ ID NO: 2163 - protein, 139 aa, Desulfitobacterium hafniense; identical to SEQ ID NO: 2162

SEQ ID NO: 2164 - protein, 139 aa, Desulfitobacterium hafniense; identical to SEQ ID NO: 2162

SEQ ID NO: 2165 - protein, 139 aa, Desulfitobacterium hafniense; identical to SEQ ID NO: 2162

SEQ ID NO: 2166 - protein, 131 aa, Pelotomaculum thermopropionicum
QFYSRVDNFLSRHEIGKILRRSNFQKEKGFSCLELFKFIFLLVFKGKNLYRTLQSEAEPGRPEKDTIYRFLNSFRYNWRKFLLILSSSVINETIEPLTSRNWKNVLVLDDSLYSRNRSKAVELLARVKDHV

SEQ ID NO: 2167 - protein, 310 aa, Artificial
  Alicyclobacillus acidocaldarius mutated SEQ ID NO 2160
MVRDSQHPDQLQSMVTAFFMEYHIGKLLRQSNITKQAGIPVLEVFRLLFALVFHQRSLKRVLEQLAMNQFGKDTVYRFLNSPRHNWRRFLLLLSSAVVRRTARLTSEDRADVFIVDDSLFSRSRSKKVELLAKVYDHVLRSNLLTEQPASIPSGDYYFDGMVYSPAGVNRPYAHPDKGYYGISPYVTWHRVGNQDLHCQIDYYDSQSILEAPAWAVGSGVGALVGGMVTDGNLTGSVIGAIIGGALGAYYGAQVERLADENGCIWFTIDNNPPIVNLGTWWAPEWYMDVRYIEIGPWATTNFYYYLGGVY

SEQ ID NO: 2168 - protein, 310 aa, Artificial
  Alicyclobacillus acidocaldarius mutated SEQ ID NO 2160
MVRDSQHPDQLQSMVTAFFMEYHIGKLLRQSNITKQAGIPVLEVFRLLFALVFHQRSLKRVLEQLAMNQFGKDTVYRFLNSPRHNWRRFLLLLSSAVVRRTARLTSEDRADVFIVDDSLFSRSRSKKVELLAKVYDHVLRSNLLTEQPASIPSGDYYFDGMVYSPAGVNRPYAHPDKGYYGISPYVTWHRVGNQDLHCQIDYYDSQSILEAPAWAVGSGVGALVGGMVTDGNLTGSVIGAIIGGALGAYYGAQVERLADENGCIWFTIDNNPPIVNLGTWWAPEWYMDVRYIDLGPWATTNFYYYLGGVY

SEQ ID NO: 2169 - protein, 310 aa, Artificial
  Alicyclobacillus acidocaldarius mutated SEQ ID NO 2160
MVRDSQHPDQLQSMVTAFFMEYHIGKLLRQSNITKQAGIPVLEVFRLLFALVFHQRSLKRVLEQLAMNQFGKDTVYRFLNSPRHNWRRFLLLLSSAVVRRTARLTSEDRADVFIVDDSLFSRSRSKKVELLAKVYDHVLRSNLLTEQPASIPSGDYYFDGMVYSPAGINRPYAHPDKGYYGISPYVTWHRVGNQDLHCQIDYYDSQSILEAPAWAVGSGVGALVGGMVTDGNLTGSVIGAIIGGALGAYYGAQVERLADENGCIWFTIDNNPPIVNLGTWWAPEWYMDVRYIELGPWATTNFYYYLGGVY

SEQ ID NO: 2170 - protein, 310 aa, Artificial
  Alicyclobacillus acidocaldarius mutated SEQ ID NO 2160
MVRDSQHPDQLQSMVTAFFMEYHIGKLLRQSNITKQAGIPVLEVFRLLFALVFHQRSLKRVLEQLAMNQFGKDTVYRFLNSPRHNWRRFLLLLSSAVVRRTARLTSEDRADVFIVDDSLFSRSRSKKVELLAKVYDHVLRSNLLTEQPASIPSGDYYFDGMVYSPAGVNRPYAHPDKGYYGISPYVTWHRVGNQDLHCQIDYYDSQSILEAPAWAVGSGVGALVGGMVTDGNLTGSVIGAIIGGALGAYYGAQVERLADENGCIWFTIDNNPPIVNLGTWWAPEWYMDVRYLELGPWATTNFYYYLGGVY

SEQ ID NO: 2171 - protein, 310 aa, Artificial
  Alicyclobacillus acidocaldarius mutated SEQ ID NO 2160
MVRDSQHPDQLQSMVTAFFMEYHIGKLLRQSNITKQAGIPVLEVFRLLFALVFHQRSLKRVLEQLAMNQFGKDTVYRFLNSPRHNWRRFLLLLSSAVVRRTARLTSEDRADVFIVDDSLFSRSRSKKVELLAKVYDHVLRSNLITEQPASIPSGDYYFDGMVYSPAGVNRPYAHPDKGYYGISPYVTWHRVGNQDLHCQIDYYDSQSILEAPAWAVGSGVGALVGGMVTDGNLTGSVIGAIIGGALGAYYGAQVERLADENGCIWFTIDNNPPIVNLGTWWAPEWYMDVRYIELGPWATTNFYYYLGGVY

SEQ ID NO: 2172 - DNA, 933 bp, Artificial
  Alicyclobacillus acidocaldarius mutated SEQ ID NO 2161
atggtacgtgattctcagcacccagatcaactccagtccatggtaacggcgttcttcatggaataccatatcggcaaactgctcaggcagtccaacatcactaagcaggccggtatccctgtactggaggtatttcgacttctgtttgcgctagtcttccatcagcgcagtctgaaacgtgtgctggaacaactcgctatgaaccaatttggcaaggatacggtgtatcggtttttaaactctccccggcacaactggcggcggtttctgctgttgctcagttctgctgttgtacgtcgtaccgctcgactcacctccgaagatcgggcggatgtgttcatcgtcgatgattcactgttcagccgcagtcgcagcaagaaggtggaactgctggccaaggtctatgaccacgtcttacggagcaacctgcttacggagcaacctgcttcaattccttctggtgattactactttgatggtatggtctattctccagcgggtgttaatagaccgtacgcccatccagacaaagggtattatggtatatccccatacgtcacctggcaccgagtaggaaaccaagatttacattgtcaaattgattattatgattctcaatccatattggaagctcctgcttgggctgtaggcagtggggttggtgcactagttgggggtatggtaactgatggaaaccttactggttccgtgatcggcgctatcattggcggagcccttggcgcatattacggtgcacaggttgaacgtttagcggacgaaaatgggtgtatttggttcactatagacaacaatccgcctatcgtcaacctgggtacttggtgggcgcctgaatggtatatggatgtccgctatattgaaattgggccttgggcaaccaccaatttctattactacttaggaggtgtatactga

SEQ ID NO: 2173 - DNA, 933 bp, Artificial
  Alicyclobacillus acidocaldarius mutated SEQ ID NO 2161
atggtacgtgattctcagcacccagatcaactccagtccatggtaacggcgttcttcatggaataccatatcggcaaactgctcaggcagtccaacatcactaagcaggccggtatccctgtactggaggtatttcgacttctgtttgcgctagtcttccatcagcgcagtctgaaacgtgtgctggaacaactcgctatgaaccaatttggcaaggatacggtgtatcggtttttaaactctccccggcacaactggcggcggtttctgctgttgctcagttctgctgttgtacgtcgtaccgctcgactcacctccgaagatcgggcggatgtgttcatcgtcgatgattcactgttcagccgcagtcgcagcaagaaggtggaactgctggccaaggtctatgaccacgtcttacggagcaacctgcttacggagcaacctgcttcaattccttctggtgattactactttgatggtatggtctattctccagcgggtgttaatagaccgtacgcccatccagacaaagggtattatggtatatccccatacgtcacctggcaccgagtaggaaaccaagatttacattgtcaaattgattattatgattctcaatccatattggaagctcctgcttgggctgtaggcagtggggttggtgcactagttgggggtatggtaactgatggaaaccttactggttccgtgatcggcgctatcattggcggagcccttggcgcatattacggtgcacaggttgaacgtttagcggacgaaaatgggtgtatttggttcactatagacaacaatccgcctatcgtcaacctgggtacttggtgggcgcctgaatggtatatggatgtccgctatattgatttggggccttgggcaaccaccaatttctattactacttaggaggtgtatactga

SEQ ID NO: 2174 - DNA, 933 bp, Artificial
  Alicyclobacillus acidocaldarius mutated SEQ ID NO 2161
atggtacgtgattctcagcacccagatcaactccagtccatggtaacggcgttcttcatggaataccatatcggcaaactgctcaggcagtccaacatcactaagcaggccggtatccctgtactggaggtatttcgacttctgtttgcgctagtcttccatcagcgcagtctgaaacgtgtgctggaacaactcgctatgaaccaatttggcaaggatacggtgtatcggtttttaaactctccccggcacaactggcggcggtttctgctgttgctcagttctgctgttgtacgtcgtaccgctcgactcacctccgaagatcgggcggatgtgttcatcgtcgatgattcactgttcagccgcagtcgcagcaagaaggtggaactgctggccaaggtctatgaccacgtcttacggagcaacctgcttacggagcaacctgcttcaattccttctggtgattactactttgatggtatggtctattctccagcgggtattaatagaccgtacgcccatccagacaaagggtattatggtatatccccatacgtcacctggcaccgagtaggaaaccaagatttacattgtcaaattgattattatgattctcaatccatattggaagctcctgcttgggctgtaggcagtggggttggtgcactagttgggggtatggtaactgatggaaaccttactggttccgtgatcggcgctatcattggcggagcccttggcgcatattacggtgcacaggttgaacgtttagcggacgaaaatgggtgtatttggttcactatagacaacaatccgcctatcgtcaacctgggtacttggtgggcgcctgaatggtatatggatgtccgctatattgaattggggccttgggcaaccaccaatttctattactacttaggaggtgtatactga

SEQ ID NO: 2175 - DNA, 933 bp, Artificial
  Alicyclobacillus acidocaldarius mutated SEQ ID NO 2161
atggtacgtgattctcagcacccagatcaactccagtccatggtaacggcgttcttcatggaataccatatcggcaaactgctcaggcagtccaacatcactaagcaggccggtatccctgtactggaggtatttcgacttctgtttgcgctagtcttccatcagcgcagtctgaaacgtgtgctggaacaactcgctatgaaccaatttggcaaggatacggtgtatcggtttttaaactctccccggcacaactggcggcggtttctgctgttgctcagttctgctgttgtacgtcgtaccgctcgactcacctccgaagatcgggcggatgtgttcatcgtcgatgattcactgttcagccgcagtcgcagcaagaaggtggaactgctggccaaggtctatgaccacgtcttacggagcaacctgcttacggagcaacctgcttcaattccttctggtgattactactttgatggtatggtctattctccagcgggtgttaatagaccgtacgcccatccagacaaagggtattatggtatatccccatacgtcacctggcaccgagtaggaaaccaagatttacattgtcaaattgattattatgattctcaatccatattggaagctcctgcttgggctgtaggcagtggggttggtgcactagttgggggtatggtaactgatggaaaccttactggttccgtgatcggcgctatcattggcggagcccttggcgcatattacggtgcacaggttgaacgtttagcggacgaaaatgggtgtatttggttcactatagacaacaatccgcctatcgtcaacctgggtacttggtgggcgcctgaatggtatatggatgtccgctatttagaattggggccttgggcaaccaccaatttctattactacttaggaggtgtatactga

SEQ ID NO: 2176 - DNA, 933 bp, Artificial
  Alicyclobacillus acidocaldarius mutated SEQ ID NO 2161
atggtacgtgattctcagcacccagatcaactccagtccatggtaacggcgttcttcatggaataccatatcggcaaactgctcaggcagtccaacatcactaagcaggccggtatccctgtactggaggtatttcgacttctgtttgcgctagtcttccatcagcgcagtctgaaacgtgtgctggaacaactcgctatgaaccaatttggcaaggatacggtgtatcggtttttaaactctccccggcacaactggcggcggtttctgctgttgctcagttctgctgttgtacgtcgtaccgctcgactcacctccgaagatcgggcggatgtgttcatcgtcgatgattcactgttcagccgcagtcgcagcaagaaggtggaactgctggccaaggtctatgaccacgtcttacggagcaacctgattacggagcaacctgcttcaattccttctggtgattactactttgatggtatggtctattctccagcgggtgttaatagaccgtacgcccatccagacaaagggtattatggtatatccccatacgtcacctggcaccgagtaggaaaccaagatttacattgtcaaattgattattatgattctcaatccatattggaagctcctgcttgggctgtaggcagtggggttggtgcactagttgggggtatggtaactgatggaaaccttactggttccgtgatcggcgctatcattggcggagcccttggcgcatattacggtgcacaggttgaacgtttagcggacgaaaatgggtgtatttggttcactatagacaacaatccgcctatcgtcaacctgggtacttggtgggcgcctgaatggtatatggatgtccgctatattgaattggggccttgggcaaccaccaatttctattactacttaggaggtgtatactga

SEQ ID NO: 2177 - protein, 388 aa, Alicyclobacillus acidocaldarius
MDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHCIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRSWPDIRSHMQAMHQVTKSTPDGIVVQRTETTEVQWEILRALRITEPPRILRMEPRTRGL

SEQ ID NO: 2178 - DNA, 1167 bp, Alicyclobacillus acidocaldarius
atggactttctccatgatgtggcggaagacctgcagtacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctgggaacacggcggatatgagcgtggtcgaggaggtcaaacaggacctcatcggttggcggcttggtcgcgtgatcacggtcgtggatcgaggtttcgtctcagagagcaatttgcggatcctgcaacgcgccggcggtcactgcatcgctggggagaagatgacctccgggaaaccagcggtggaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacctgatccgcacctccgacgacacgctgtcgacggaagatgtcgcgctgggatacaagcaactcctgatggtggagtccgcgtttcgcacactgaagacgacgttggacatccgtcccatgtatcaccggaaggacgagcggatccgttcgcatgtgctgctttgctggctggccttgttgctggtgcgcatcgccgaagtccaaacagggcgctcctggcccgacatccgctcccacatgcaagcgatgcaccaggtgaccaagagcaccccagatgggatcgtcgtgcagcgcacagaaacgaccgaggtacagtgggaaatcctgcgagcgctacggatcacggagccaccaagaattctgcgcatggaacctcgaacacgagggctgtag

SEQ ID NO: 2179 - protein, 388 aa, Geobacillus thermodenitrificans
MDELLAVQPELERQVFHAVADLLNLEVDLIYFDTTSSYFEVDPSETPEGESLRKQGFSKDKRPDLVQIVIGLAVTREGVPIRAWVWPGNTMDMTVIKQVKQDLIGWKLGRVISVMDRGFSSEENLRILQQAGGHYIVGEKMRSGKAAVEEALNRRGRYQQVRENLHIKEIIVGDGEARQRYVLVYNPSEAERQRKEREKLLESLKEELEGLRQLPNEAHHKATCRLRSHPSYGKYLRQLKDGTLRIDKQAVREAEKYDGKYLIRTSDDTLSAEDVALGYKQLVDIEQAFRTLKSTLELRPMYHRLEDRIRAHVLLSWLALLLVRIVEIRTHESWPKVRDECERLMLGHFSSKNGDLYQRTELTAKQALFLAALGLEPPPKILGIHPRT

SEQ ID NO: 2180 - protein, 388 aa, Geobacillus kaustophilus; identical to SEQ ID NO: 2179

SEQ ID NO: 2181 - protein, 388 aa, Geobacillus kaustophilus; identical to SEQ ID NO: 2179

SEQ ID NO: 2182 - protein, 387 aa, Geobacillus kaustophilus
MDELLAVQPELERQVFHAVADLLNLEVDLIYFDTTSSYFEVDPSETPEGESLRKQGFSKDKRPDLVQIVIGLAVTREGIPIRAWVWPGNTMDMTVIKQVKQDLIGWKLGRVISVMDRGFSSEENLRILQQAGGHYIVGENMRSGKAAVEEALSRRGRYHEVDENLHIKEIIVGDGEARQRYVLVYNPGEAERQRKERETLLESLKEELEGLRQLPNEAHHKATCRLRSHPSYGKYLRQLKDGTLRIDKQAVRDAEKYDGNYLIRTSDDTLSAEDVAIGYKQLVDIEQAFRTLKSTLELRPMYHRLEDRIRAHVLLSWLALLLVRIVEIRTHESWPKVRDECERLMLGHFSSKNGDLYQRTELTAKQAQLFAALGLEPPPKILGIHPR

SEQ ID NO: 2183 - protein, 388 aa, Bacillus selenitireducens
MDELLSVQKQLEDRVFDHVSNLLNLEVDLLYFDTTSSYFEVASDETPEEDDFRLQGYSKDKRSDLVQVVIGLAVTREGIPIKVWTWPGNTMDMNVVEEVKKDLMGWRLGRVVKVMDRGFSSEKNLRILQRGAGHYIIGERMRSGKKDVEEALSKRGRFHKVRENLHVKESIVGDGEARKRYVIAFNPDEAIRDREKRQEIVRSVEEQLHHLKQLPNEAHHKQACALRAHKVYGKYIRQLKDGTLKLNKQAVRDAEKYDGKYLIRTSDDTLSIEDVALGYKQLLQVEDAFRTMKTTLVLRPMYHRLEDRIRAHVIISWLALLLVRMIELDTNESWNTVRRNIQRLQAGHFTTSDGDLYRTTTPTAKQKEIFRNTGTEIPPEILAIRPKS

SEQ ID NO: 2184 - protein, 388 aa, Artificial
  Alicyclobacillus acidocaldarius mutated SEQ ID NO 2177
MDFLHDVAEDLQYEVFRRVSDLLNLDVDLLFFDTTSTYFETDDESDDSLRRKGYSKDHRPDLPQVVIGLAVTRDGIPVRCWTWPGNTADMSVVEEVKQDLIGWRLGRVITVVDRGFVSESNLRILQRAGGHCIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRSWPDIRSHMQAMHQVTKSTPDGIVVQRTETTEVQWEILRALRITEPPRILRMEPRTRGL

SEQ ID NO: 2185 - protein, 388 aa, Artificial
  Alicyclobacillus acidocaldarius mutated SEQ ID NO 2177
MDFLHDVAEDLQYEVFRRVSDLLNLDVDLLFFDTTSTYFETEDESDDSLRKKGYSKDHRPDLPQVVIGLAVTRDGIPVRCWTWPGNTADMSVVEEVKQDLIGWRLGRVITVVDRGFVSESNLRILQRAGGHCIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRSWPDIRSHMQAMHQVTKSTPDGIVVQRTETTEVQWEILRALRITEPPRILRMEPRTRGL

SEQ ID NO: 2186 - protein, 388 aa, Artificial
  Alicyclobacillus acidocaldarius mutated SEQ ID NO 2177
MDFLHDVAEDLQYEVFRKVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHCIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRSWPDIRSHMQAMHQVTKSTPDGIVVQRTETTEVQWEILRALRITEPPRILRMEPRTRGL

SEQ ID NO: 2187 - protein, 388 aa, Artificial
  Alicyclobacillus acidocaldarius mutated SEQ ID NO 2177
MDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHCIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRSWPDIRSHMQAMHQVTKSTPDGIVVQRTETTEIQWEILRALRITEPPRILRMEPRTRGL

SEQ ID NO: 2188 - protein, 388 aa, Artificial
  Alicyclobacillus acidocaldarius mutated SEQ ID NO 2177
MDFLHDVAEDLQYEVFRRVSDLLNLDVDLLFFDTTSTYFETEDESDDSLRRKGYSKDHRPDLPQVVIGLAVTRDGIPVRCWTWPGNTADMSVVEEVKQDLIGWRLGRVITVVDRGFVSESNLRILQRAGGHCIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRSWPDIRSHMQAMHQVTKSTPDGIVVQKTETTEVQWEILRALRITEPPRILRMEPRTRGL

SEQ ID NO: 2189 - DNA, 1167 bp, Artificial
  Alicyclobacillus acidocaldarius mutated SEQ ID NO 2178
atggactttctccatgatgtggcggaagacctgcagtacgaggtcttccggcgagtgagcgatctcttgaacctggacgtggaccttctgttctttgacacgacctccacgtacttcgagacggatgacgagtcggacgacagtctgcgacgcaaggggtattccaaagaccaccggcccgacttgcctcaggtggtgatcgggcttgcggtgacgcgggacggcatccccgtccgctgctggacgtggcctgggaacacggcggatatgagcgtggtcgaggaggtcaaacaggacctcatcggttggcggcttggtcgcgtgatcacggtcgtggatcgaggtttcgtctcagagagcaatttgcggatcctgcaacgcgccggcggtcactgcatcgctggggagaagatgacctccgggaaaccagcggtggaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacctgatccgcacctccgacgacacgctgtcgacggaagatgtcgcgctgggatacaagcaactcctgatggtggagtccgcgtttcgcacactgaagacgacgttggacatccgtcccatgtatcaccggaaggacgagcggatccgttcgcatgtgctgctttgctggctggccttgttgctggtgcgcatcgccgaagtccaaacagggcgctcctggcccgacatccgctcccacatgcaagcgatgcaccaggtgaccaagagcaccccagatgggatcgtcgtgcagcgcacagaaacgaccgaggtacagtgggaaatcctgcgagcgctacggatcacggagccaccaagaattctgcgcatggaacctcgaacacgagggctgtag

SEQ ID NO: 2190 - DNA, 1167 bp, Artificial
  Alicyclobacillus acidocaldarius mutated SEQ ID NO 2178
atggactttctccatgatgtggcggaagacctgcagtacgaggtcttccggcgagtgagcgatctcttgaacctggacgtggaccttctgttctttgacacgacctccacgtacttcgagacggaggacgagtcggacgacagtctgcgaaaaaaggggtattccaaagaccaccggcccgacttgcctcaggtggtgatcgggcttgcggtgacgcgggacggcatccccgtccgctgctggacgtggcctgggaacacggcggatatgagcgtggtcgaggaggtcaaacaggacctcatcggttggcggcttggtcgcgtgatcacggtcgtggatcgaggtttcgtctcagagagcaatttgcggatcctgcaacgcgccggcggtcactgcatcgctggggagaagatgacctccgggaaaccagcggtggaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacctgatccgcacctccgacgacacgctgtcgacggaagatgtcgcgctgggatacaagcaactcctgatggtggagtccgcgtttcgcacactgaagacgacgttggacatccgtcccatgtatcaccggaaggacgagcggatccgttcgcatgtgctgctttgctggctggccttgttgctggtgcgcatcgccgaagtccaaacagggcgctcctggcccgacatccgctcccacatgcaagcgatgcaccaggtgaccaagagcaccccagatgggatcgtcgtgcagcgcacagaaacgaccgaggtacagtgggaaatcctgcgagcgctacggatcacggagccaccaagaattctgcgcatggaacctcgaacacgagggctgtag

SEQ ID NO: 2191 - DNA, 1167 bp, Artificial
  Alicyclobacillus acidocaldarius mutated SEQ ID NO 2178
atggactttctccatgatgtggcggaagacctgcagtacgaggtcttccggaaagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctgggaacacggcggatatgagcgtggtcgaggaggtcaaacaggacctcatcggttggcggcttggtcgcgtgatcacggtcgtggatcgaggtttcgtctcagagagcaatttgcggatcctgcaacgcgccggcggtcactgcatcgctggggagaagatgacctccgggaaaccagcggtggaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacctgatccgcacctccgacgacacgctgtcgacggaagatgtcgcgctgggatacaagcaactcctgatggtggagtccgcgtttcgcacactgaagacgacgttggacatccgtcccatgtatcaccggaaggacgagcggatccgttcgcatgtgctgctttgctggctggccttgttgctggtgcgcatcgccgaagtccaaacagggcgctcctggcccgacatccgctcccacatgcaagcgatgcaccaggtgaccaagagcaccccagatgggatcgtcgtgcagcgcacagaaacgaccgaggtacagtgggaaatcctgcgagcgctacggatcacggagccaccaagaattctgcgcatggaacctcgaacacgagggctgtag

SEQ ID NO: 2192 - DNA, 1167 bp, Artificial
  Alicyclobacillus acidocaldarius mutated SEQ ID NO 2178
atggactttctccatgatgtggcggaagacctgcagtacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctgggaacacggcggatatgagcgtggtcgaggaggtcaaacaggacctcatcggttggcggcttggtcgcgtgatcacggtcgtggatcgaggtttcgtctcagagagcaatttgcggatcctgcaacgcgccggcggtcactgcatcgctggggagaagatgacctccgggaaaccagcggtggaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacctgatccgcacctccgacgacacgctgtcgacggaagatgtcgcgctgggatacaagcaactcctgatggtggagtccgcgtttcgcacactgaagacgacgttggacatccgtcccatgtatcaccggaaggacgagcggatccgttcgcatgtgctgctttgctggctggccttgttgctggtgcgcatcgccgaagtccaaacagggcgctcctggcccgacatccgctcccacatgcaagcgatgcaccaggtgaccaagagcaccccagatgggatcgtcgtgcagcgcacagaaacgaccgagattcagtgggaaatcctgcgagcgctacggatcacggagccaccaagaattctgcgcatggaacctcgaacacgagggctgtag

SEQ ID NO: 2193 - DNA, 1167 bp, Artificial
  Alicyclobacillus acidocaldarius mutated SEQ ID NO 2178
atggactttctccatgatgtggcggaagacctgcagtacgaggtcttccggcgagtgagcgatctcttgaacctggacgtggaccttctgttctttgacacgacctccacgtacttcgagacggaggacgagtcggacgacagtctgcgacgcaaggggtattccaaagaccaccggcccgacttgcctcaggtggtgatcgggcttgcggtgacgcgggacggcatccccgtccgctgctggacgtggcctgggaacacggcggatatgagcgtggtcgaggaggtcaaacaggacctcatcggttggcggcttggtcgcgtgatcacggtcgtggatcgaggtttcgtctcagagagcaatttgcggatcctgcaacgcgccggcggtcactgcatcgctggggagaagatgacctccgggaaaccagcggtggaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacctgatccgcacctccgacgacacgctgtcgacggaagatgtcgcgctgggatacaagcaactcctgatggtggagtccgcgtttcgcacactgaagacgacgttggacatccgtcccatgtatcaccggaaggacgagcggatccgttcgcatgtgctgctttgctggctggccttgttgctggtgcgcatcgccgaagtccaaacagggcgctcctggcccgacatccgctcccacatgcaagcgatgcaccaggtgaccaagagcaccccagatgggatcgtcgtgcagaaaacagaaacgaccgaggtacagtgggaaatcctgcgagcgctacggatcacggagccaccaagaattctgcgcatggaacctcgaacacgagggctgtag

SEQ ID NO: 2194 - protein, 421 aa, Alicyclobacillus acidocaldarius
MAPSSKLAMEEWVDREVALPGMTELDVWQAYRAMDFLHDVAEDLQYEVFRRVSDLLNLDVDLLFFDTTSTYFETEDEPEDGLRRKGYSKDHRPDLPQVVIRLAVTRDGIPVRCWTWPGNTADMSVVEEVKQDLIGWRLGRVITVVDRGFVSESNLRILQRAGGHYIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRTWADIRSHMQAMHRVTKSTPEGIVVQRTETTEVQREILRALRITEPPRILRMEPRTRGL

SEQ ID NO: 2195 - DNA, 1266 bp, Alicyclobacillus acidocaldarius
ttggcaccaagcagcaagctggccatggaagaatgggtcgaccgtgaagtggctctccccgggatgaccgagttggacgtgtggcaggcataccgggccatggactttctccatgatgtggcggaagacctgcaatatgaggtcttccggcgagtgagcgatctcttgaacctggacgtggaccttctgttctttgacacgacctccacgtacttcgaaacggaggacgagcccgaagacggactacggcgcaaaggatattcgaaagaccaccggcccgacttgcctcaggtggtgatcaggcttgcggtgacgcgggacggcatccccgtgcgctgctggacgtggcctggcaacacagcggacatgagcgtggtcgaggaggtcaaacaggacctcatcggttggcggcttggtcgcgtgatcacggtcgtggatcgaggtttcgtctcagagagcaatttgcggatcctgcaacgcgccggcggtcactacatcgctggggagaagatgacctccgggaaaccagcggtagaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcggcgggaggccatgttgcgcgagcttcggatggagttggaacgcctcaaggagcttcagggcgaagcgcacacgaaggcccactgtcggcttgcgagccatcccacgttcaagcgctatctgaaacaggaccgatgggggaacctgaggattgacccggaggccgtgcggcaagcggctcatctggacgggaagtacttgatccgcacctccgacgacacgctgtcgacggaagatgtcgcgctgggatacaagcaactcctgatggtggagtccgcgtttcgcacactgaagacgacgttggacatccgtcccatgtatcaccggaaggacgagcggatccgttcgcatgtgctgttgtgctggctggccttgttgttggtgcgcatcgcggaggtccaaactgggcggacatgggcagacatccgctctcacatgcaagcgatgcatcgggtcacgaagagcacgccggaagggatcgtcgtgcagcgcaccgaaacgaccgaggtgcagcgggagatcctgcgagccctgcggatcacggagccgccaagaattctgcggatggaacctcgaacacgagggctgtag

SEQ ID NO: 2196 - protein, 419 aa, Geobacillus kaustophilus
PSSKLAMEEWVEKDVHIPHLPQVASHQLYRAMDELLAVQPELERQVFHAVADLLNLEVDLIYFDTTSSYFEVDPSETPEGESLRKQGFSKDKRPDLVQIVIGLAVTREGVPIRAWVWPGNTMDMTVIKQVKQDLIGWKLGRVISVMDRGFSSEENLRILQQAGGHYIVGEKMRSGKAAVEEALNRRGRYQQVRENLHIKEIIVGDGEARQRYVLVYNPSEAERQRKEREKLLESLKEELEGLRQLPNEAHHKATCRLRSHPSYGKYLRQLKDGTLRIDKQAVREAEKYDGKYLIRTSDDTLSAEDVALGYKQLVDIEQAFRTLKSTLELRPMYHRLEDRIRAHVLLSWLALLLVRIVEIRTHESWPKVRDECERLMLGHFSSKNGDLYQRTELTAKQALFLAALGLEPPPKILGIHPRT

SEQ ID NO: 2197 - protein, 419 aa, Geobacillus kaustophilus; identical to SEQ ID NO: 2196

SEQ ID NO: 2198 - protein, 419 aa, Geobacillus thermodenitrificans
PSSKLAMEEWVEKDVHIPHLPQGASHQLYRAMDELLAVQPELERQVFHAVADLLNLEVDLIYFDTTSSYFEVDPSETPEGESLRKQGFSKDKRPDLVQIVIGLAVTREGVPIRAWVWPGNTMDMTVIKQVKQDLIGWKLGRVISVMDRGFSSEENLRILQQAGGHYIVGEKMRSGKAAVEEALNRRGRYQQVRENLHIKEIIVGDGEARQRYVLVYNPSEAERQRKEREKLLESLKEELEGLRQLPNEAHHKATCRLRSHPSYGKYLRQLKDGTLRIDKQAVREAEKYDGKYLIRTSDDTLSAEDVALGYKQLVDIEQAFRTLKSTLELRPMYHRLEDRIRAHVLLSWLALLLVRIVEIRTHESWPKVRDECERLMLGHFSSKNGDLYQRTELTAKQALFLAALGLEPPPKILGIHPRT

SEQ ID NO: 2199 - protein, 418 aa, Geobacillus kaustophilus
PSSKLAMEEWVEKDVYIPHLPQVASHQLYRAMDELLAVQPELERQVFHAVADLLNLEVDLIYFDTTSSYFEVDPSETPEGESLRKQGFSKDKRPDLVQIVIGLAVTREGIPIRAWVWPGNTMDMTVIKQVKQDLIGWKLGRVISVMDRGFSSEENLRILQQAGGHYIVGENMRSGKAAVEEALSRRGRYHEVDENLHIKEIIVGDGEARQRYVLVYNPGEAERQRKERETLLESLKEELEGLRQLPNEAHHKATCRLRSHPSYGKYLRQLKDGTLRIDKQAVRDAEKYDGNYLIRTSDDTLSAEDVAIGYKQLVDIEQAFRTLKSTLELRPMYHRLEDRIRAHVLLSWLALLLVRIVEIRTHESWPKVRDECERLMLGHFSSKNGDLYQRTELTAKQAQLFAALGLEPPPKILGIHPR

SEQ ID NO: 2200 - protein, 421 aa, Bacillus selenitireducens
LAPSSKLVMEEWLSEDVYLPDMPVFKSHQLYRSMDELLSVQKQLEDRVFDHVSNLLNLEVDLLYFDTTSSYFEVASDETPEEDDFRLQGYSKDKRSDLVQVVIGLAVTREGIPIKVWTWPGNTMDMNVVEEVKKDLMGWRLGRVVKVMDRGFSSEKNLRILQRGAGHYIIGERMRSGKKDVEEALSKRGRFHKVRENLHVKESIVGDGEARKRYVIAFNPDEAIRDREKRQEIVRSVEEQLHHLKQLPNEAHHKQACALRAHKVYGKYIRQLKDGTLKLNKQAVRDAEKYDGKYLIRTSDDTLSIEDVALGYKQLLQVEDAFRTMKTTLVLRPMYHRLEDRIRAHVIISWLALLLVRMIELDTNESWNTVRRNIQRLQAGHFTTSDGDLYRTTTPTAKQKEIFRNTGTEIPPEILAIRPKS

SEQ ID NO: 2201 - protein, 421 aa, Artificial
  Alicyclobacillus acidocaldarius mutated SEQ ID NO 2194
MAPSSKLAMEEWVDREVALPGMTELDVWQAYRAMDFLHDVAEDLQYEVFRRVSDLLNLDVDLLFFDTTSTYFETEDEPEDGLRRKGYSKDHRPDLPQVVIRLAVTRDGIPVRCWTWPGNTADMSVVEEVKQDLIGWRLGRVITVVDRGFVSESNLRILQRAGGHYIAGEKMTSGKPAVEAALARPGRFRELRPNLKVKEVVVGDGEARVRYVLAFNPEEAKRDEARREAMLRELRMELERLKELQGEAHTKAHCKLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRTWADIRSHMQAMHRVTKSTPEGIVVQRTETTEVQREILRALRITEPPRILRMEPRTRGL

SEQ ID NO: 2202 - protein, 421 aa, Artificial
  Alicyclobacillus acidocaldarius mutated SEQ ID NO 2194
MAPSSKLAMEEWVDREVALPGMTELDVWQAYRAMDFLHDVAEDLQYEVFRRVSDLLNLDVDLLFFDTTSTYFETEDEPEDGLRRKGYSKDHRPDLPQVVIRLAVTRDGIPVRCWTWPGNTADMSVVEEVKQDLIGWRLGRVITVVDRGFVSESNLRILQRAGGHYIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRTWADIRSHMQAMHRVTKSTPEGIVVQRTETTEVQREILRALRLTEPPRILRMEPRTRGL

SEQ ID NO: 2203 - protein, 421 aa, Artificial
  Alicyclobacillus acidocaldarius mutated SEQ ID NO 2194
MAPSSKLAMEEWVDREVALPGMTELDVWQAYRAMDFLHDVAEDLQYEVFRRVSDLLNLDVDLLFFDTTSTYFETEDEPEDGLRRKGYSKDHRPDLPQVVIRLAVTRDGIPVRCWTWPGNTADMSVVEEVKQDLIGWRLGRVITVVDRGFVSESNLRILQRAGGHYIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRTWADIRSHMQAMHRITKSTPEGIVVQRTETTEVQREILRALRITEPPRILRMEPRTRGL

SEQ ID NO: 2204 - protein, 421 aa, Artificial
  Alicyclobacillus acidocaldarius mutated SEQ ID NO 2194
MAPSSKLAMEEWVDREVALPGMTELDVWQAYRAMDFLHDVAEDLQYEVFRRVSDLLNLDVDLLFFDTTSTYFETEDEPEDGLRRKGYSKDHRPDLPQVVIRLAVTRDGIPVRCWTWPGNTADMSVVEEVKQDLIGWRLGRVITVVDRGFVSESNLRILQRAGGHYIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRTWADIRSHMQAMHRVTKSTPEGIVIQRTETTEVQREILRALRITEPPRILRMEPRTRGL

SEQ ID NO: 2205 - protein, 421 aa, Artificial
  Alicyclobacillus acidocaldarius mutated SEQ ID NO 2194
MAPSSKLAMEEWVDREVALPGMTELDVWQAYRAMDFLHDVADDLQYEVFRRVSDLLNLDVDLLFFDTTSTYFETEDEPEDGLRRKGYSKDHRPDLPQVVIRLAVTRDGIPVRCWTWPGNTADMSVVEEVKQDLIGWRLGRVITVVDRGFVSESNLRILQRAGGHYIAGEKMTSGKPAVEAALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRTWADIRSHMQAMHRVTKSTPEGIVVQRTETTEVQREILRALRITEPPRILRMEPRTRGL

SEQ ID NO: 2206 - DNA, 1266 bp, Artificial
  Alicyclobacillus acidocaldarius mutated SEQ ID NO 2195
ttggcaccaagcagcaagctggccatggaagaatgggtcgaccgtgaagtggctctccccgggatgaccgagttggacgtgtggcaggcataccgggccatggactttctccatgatgtggcggaagacctgcaatatgaggtcttccggcgagtgagcgatctcttgaacctggacgtggaccttctgttctttgacacgacctccacgtacttcgaaacggaggacgagcccgaagacggactacggcgcaaaggatattcgaaagaccaccggcccgacttgcctcaggtggtgatcaggcttgcggtgacgcgggacggcatccccgtgcgctgctggacgtggcctggcaacacagcggacatgagcgtggtcgaggaggtcaaacaggacctcatcggttggcggcttggtcgcgtgatcacggtcgtggatcgaggtttcgtctcagagagcaatttgcggatcctgcaacgcgccggcggtcactacatcgctggggagaagatgacctccgggaaaccagcggtagaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcggcgggaggccatgttgcgcgagcttcggatggagttggaacgcctcaaggagcttcagggcgaagcgcacacgaaggcccactgtaaacttgcgagccatcccacgttcaagcgctatctgaaacaggaccgatgggggaacctgaggattgacccggaggccgtgcggcaagcggctcatctggacgggaagtacttgatccgcacctccgacgacacgctgtcgacggaagatgtcgcgctgggatacaagcaactcctgatggtggagtccgcgtttcgcacactgaagacgacgttggacatccgtcccatgtatcaccggaaggacgagcggatccgttcgcatgtgctgttgtgctggctggccttgttgttggtgcgcatcgcggaggtccaaactgggcggacatgggcagacatccgctctcacatgcaagcgatgcatcgggtcacgaagagcacgccggaagggatcgtcgtgcagcgcaccgaaacgaccgaggtgcagcgggagatcctgcgagccctgcggatcacggagccgccaagaattctgcggatggaacctcgaacacgagggctgtag

SEQ ID NO: 2207 - DNA, 1266 bp, Artificial
  Alicyclobacillus acidocaldarius mutated SEQ ID NO 2195
ttggcaccaagcagcaagctggccatggaagaatgggtcgaccgtgaagtggctctccccgggatgaccgagttggacgtgtggcaggcataccgggccatggactttctccatgatgtggcggaagacctgcaatatgaggtcttccggcgagtgagcgatctcttgaacctggacgtggaccttctgttctttgacacgacctccacgtacttcgaaacggaggacgagcccgaagacggactacggcgcaaaggatattcgaaagaccaccggcccgacttgcctcaggtggtgatcaggcttgcggtgacgcgggacggcatccccgtgcgctgctggacgtggcctggcaacacagcggacatgagcgtggtcgaggaggtcaaacaggacctcatcggttggcggcttggtcgcgtgatcacggtcgtggatcgaggtttcgtctcagagagcaatttgcggatcctgcaacgcgccggcggtcactacatcgctggggagaagatgacctccgggaaaccagcggtagaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcggcgggaggccatgttgcgcgagcttcggatggagttggaacgcctcaaggagcttcagggcgaagcgcacacgaaggcccactgtcggcttgcgagccatcccacgttcaagcgctatctgaaacaggaccgatgggggaacctgaggattgacccggaggccgtgcggcaagcggctcatctggacgggaagtacttgatccgcacctccgacgacacgctgtcgacggaagatgtcgcgctgggatacaagcaactcctgatggtggagtccgcgtttcgcacactgaagacgacgttggacatccgtcccatgtatcaccggaaggacgagcggatccgttcgcatgtgctgttgtgctggctggccttgttgttggtgcgcatcgcggaggtccaaactgggcggacatgggcagacatccgctctcacatgcaagcgatgcatcgggtcacgaagagcacgccggaagggatcgtcgtgcagcgcaccgaaacgaccgaggtgcagcgggagatcctgcgagccctgcggttaacggagccgccaagaattctgcggatggaacctcgaacacgagggctgtag

SEQ ID NO: 2208 - DNA, 1266 bp, Artificial
  Alicyclobacillus acidocaldarius mutated SEQ ID NO 2195
ttggcaccaagcagcaagctggccatggaagaatgggtcgaccgtgaagtggctctccccgggatgaccgagttggacgtgtggcaggcataccgggccatggactttctccatgatgtggcggaagacctgcaatatgaggtcttccggcgagtgagcgatctcttgaacctggacgtggaccttctgttctttgacacgacctccacgtacttcgaaacggaggacgagcccgaagacggactacggcgcaaaggatattcgaaagaccaccggcccgacttgcctcaggtggtgatcaggcttgcggtgacgcgggacggcatccccgtgcgctgctggacgtggcctggcaacacagcggacatgagcgtggtcgaggaggtcaaacaggacctcatcggttggcggcttggtcgcgtgatcacggtcgtggatcgaggtttcgtctcagagagcaatttgcggatcctgcaacgcgccggcggtcactacatcgctggggagaagatgacctccgggaaaccagcggtagaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcggcgggaggccatgttgcgcgagcttcggatggagttggaacgcctcaaggagcttcagggcgaagcgcacacgaaggcccactgtcggcttgcgagccatcccacgttcaagcgctatctgaaacaggaccgatgggggaacctgaggattgacccggaggccgtgcggcaagcggctcatctggacgggaagtacttgatccgcacctccgacgacacgctgtcgacggaagatgtcgcgctgggatacaagcaactcctgatggtggagtccgcgtttcgcacactgaagacgacgttggacatccgtcccatgtatcaccggaaggacgagcggatccgttcgcatgtgctgttgtgctggctggccttgttgttggtgcgcatcgcggaggtccaaactgggcggacatgggcagacatccgctctcacatgcaagcgatgcatcggattacgaagagcacgccggaagggatcgtcgtgcagcgcaccgaaacgaccgaggtgcagcgggagatcctgcgagccctgcggatcacggagccgccaagaattctgcggatggaacctcgaacacgagggctgtag

SEQ ID NO: 2209 - DNA, 1266 bp, Artificial
  Alicyclobacillus acidocaldarius mutated SEQ ID NO 2195
ttggcaccaagcagcaagctggccatggaagaatgggtcgaccgtgaagtggctctccccgggatgaccgagttggacgtgtggcaggcataccgggccatggactttctccatgatgtggcggaagacctgcaatatgaggtcttccggcgagtgagcgatctcttgaacctggacgtggaccttctgttctttgacacgacctccacgtacttcgaaacggaggacgagcccgaagacggactacggcgcaaaggatattcgaaagaccaccggcccgacttgcctcaggtggtgatcaggcttgcggtgacgcgggacggcatccccgtgcgctgctggacgtggcctggcaacacagcggacatgagcgtggtcgaggaggtcaaacaggacctcatcggttggcggcttggtcgcgtgatcacggtcgtggatcgaggtttcgtctcagagagcaatttgcggatcctgcaacgcgccggcggtcactacatcgctggggagaagatgacctccgggaaaccagcggtagaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcggcgggaggccatgttgcgcgagcttcggatggagttggaacgcctcaaggagcttcagggcgaagcgcacacgaaggcccactgtcggcttgcgagccatcccacgttcaagcgctatctgaaacaggaccgatgggggaacctgaggattgacccggaggccgtgcggcaagcggctcatctggacgggaagtacttgatccgcacctccgacgacacgctgtcgacggaagatgtcgcgctgggatacaagcaactcctgatggtggagtccgcgtttcgcacactgaagacgacgttggacatccgtcccatgtatcaccggaaggacgagcggatccgttcgcatgtgctgttgtgctggctggccttgttgttggtgcgcatcgcggaggtccaaactgggcggacatgggcagacatccgctctcacatgcaagcgatgcatcgggtcacgaagagcacgccggaagggatcgtcattcagcgcaccgaaacgaccgaggtgcagcgggagatcctgcgagccctgcggatcacggagccgccaagaattctgcggatggaacctcgaacacgagggctgtag

SEQ ID NO: 2210 - DNA, 1266 bp, Artificial
  Alicyclobacillus acidocaldarius mutated SEQ ID NO 2195
ttggcaccaagcagcaagctggccatggaagaatgggtcgaccgtgaagtggctctccccgggatgaccgagttggacgtgtggcaggcataccgggccatggactttctccatgatgtggcggatgacctgcaatatgaggtcttccggcgagtgagcgatctcttgaacctggacgtggaccttctgttctttgacacgacctccacgtacttcgaaacggaggacgagcccgaagacggactacggcgcaaaggatattcgaaagaccaccggcccgacttgcctcaggtggtgatcaggcttgcggtgacgcgggacggcatccccgtgcgctgctggacgtggcctggcaacacagcggacatgagcgtggtcgaggaggtcaaacaggacctcatcggttggcggcttggtcgcgtgatcacggtcgtggatcgaggtttcgtctcagagagcaatttgcggatcctgcaacgcgccggcggtcactacatcgctggggagaagatgacctccgggaaaccagcggtagaagcggcgttggcgcgccctggacgttttcgtgagcttcgtcctaacctgaaagtgaaggaggtcgtggtgggagacggagaggcccgggtccgttacgtgttggcgttcaatcccgaggaagccaaacgcgatgaggcgcggcgggaggccatgttgcgcgagcttcggatggagttggaacgcctcaaggagcttcagggcgaagcgcacacgaaggcccactgtcggcttgcgagccatcccacgttcaagcgctatctgaaacaggaccgatgggggaacctgaggattgacccggaggccgtgcggcaagcggctcatctggacgggaagtacttgatccgcacctccgacgacacgctgtcgacggaagatgtcgcgctgggatacaagcaactcctgatggtggagtccgcgtttcgcacactgaagacgacgttggacatccgtcccatgtatcaccggaaggacgagcggatccgttcgcatgtgctgttgtgctggctggccttgttgttggtgcgcatcgcggaggtccaaactgggcggacatgggcagacatccgctctcacatgcaagcgatgcatcgggtcacgaagagcacgccggaagggatcgtcgtgcagcgcaccgaaacgaccgaggtgcagcgggagatcctgcgagccctgcggatcacggagccgccaagaattctgcggatggaacctcgaacacgagggctgtag

SEQ ID NO: 2211 - protein, 178 aa, Alicyclobacillus acidocaldarius
MVSDAHAGLRQAISEVLTGATWQRCKVHTIRNVLSQVPKREQSMVASIIRSIFTQPTQEAAREQLRRVVAELRGRFPKAMDILEAAEEDVLAFMALPIEHWRQICSTNPLERLNREMRRRMDVVGIFPNRASVVRLAGAILQEQHEEWLVSRRYFSLESMAKLKPNRPLLAAEAMLQK

SEQ ID NO: 2212 - DNA, 537 bp, Alicyclobacillus acidocaldarius
gtggtgagcgatgcgcacgcaggcttgcgccaggccatttcggaagtgctgacgggcgcgacgtggcaacgctgcaaagtgcacacgattcggaacgtgttgagccaagtcccgaagagggagcagtcgatggtggcctcgatcatccggtcaatcttcacccagcccacgcaagaagcggcccgcgagcagcttcgccgagtggtcgcggaactccgggggcgtttcccgaaggcgatggacattttggaggcagcagaggaggacgtgctggcctttatggcgctacctatcgagcactggcggcagatctgctcgaccaacccgctcgagcggctcaatcgagagatgcgtcggcggatggacgtcgtggggattttcccgaatcgagcatcggtagtgcgcctcgctggagcgattttgcaagagcagcacgaagaatggctggtgtcgcggcgatatttcagcctggagtcgatggcgaaactcaagcccaaccgtccgctcctcgcagccgaggcgatgttgcaaaaataa

SEQ ID NO: 2213 - protein, 179 aa, Clostridium thermocellum
VISDAHEGLKAAIKKILTGSAWQRCRVHFMRNVLSQVPKHYQGMVSSIIRTIFAQNDQESAREQLRHVVDELKNRFPKAMKILEEAEEEILAYMAFPREHWAQIHSTNPLERLNREIRRRTDVVCIFPNREAVIRLVGAMLMEQNDEWKVGRRYFSLESMSKITSINEFTLTPVALLHK

SEQ ID NO: 2214 - protein, 179 aa, Clostridium thermocellum
VISDAHEGLKAAIKKILTGSAWQRCRVHFMRNVLSQVPKHYQGMVSSIIRTIFAQNDQESAREQLRHVVDELKNRFPKAMKILEEAEEEILAYMAFPREHWAQIHSTNPLERLNREIRRRTDVVCIFPNRKAVIRLVGAMLMEQNDEWKVGRRYFSLESMSKITSINEFTLTPVALLHK

SEQ ID NO: 2215 - protein, 179 aa, Clostridium thermocellum
VISDAHEGLKAAIKKILTGSAWQRCRVHFMRNVLSQVPKHYQGMVSSIIRTIFAQNDQESAREQLRHVVDELKKRFPKAMKILEEAEEEILAYMAFPREHWAQIHSTNPLERLNREIRRRTDVVCIFPNREAVIRLVGAMLMEQNDEWKVGRRYFSLESMSKITSINEFTLTPVALLHK

SEQ ID NO: 2216 - protein, 170 aa, Symbiobacterium thermophilum
VISDAHEGLRQAIAEVLQGAAWQRCRVHFMRNLLGYVPKPAQSMVAALVRTVFAQPDIEAAREQLDRVVASLGRRYPKVAALLSEAAEDVLAYMAFPREHWQKIHSTNPLERLMREIGRRVDVVGIFPNAAAALRLIGAVLQEQEDEWRVQRRYLSMQSMAKLALTPSEP

SEQ ID NO: 2217 - protein, 163 aa, Symbiobacterium thermophilum
ISDSHVGLQEAIRTVLSGASWQRCRVHFMRNLLSYVPKHWQSMVAAAVRTIFAQPDQQAARRQLAVVADNLRPQFPRAAQLLEEAEDDILAYMAFPTEHWRQLHSTNPLERLNREIGRRTDVVGIFPNREAVIRLAGAVLIEQQDEWTAAPRRYFSQASMAKL

SEQ ID NO: 2218 - protein, 178 aa, Artificial
  Alicyclobacillus acidocaldarius mutated SEQ ID NO 2211
MVSDAHAGLRQAISEVLTGATWQRCKVHTIRNVLSQVPKREQSMVASIIRSIFTQPTQEAAREQLRRVVAELRGRFPKAMDILEAAEEDVLAFMALPIEHWRQICSTNPLERLNREMRRRMDVVGIFPNRASVVRLAGAILQEQHEEWLVSRRYFSLESMAKLKPQRPLLAAEAMLQK

SEQ ID NO: 2219 - protein, 178 aa, Artificial
  Alicyclobacillus acidocaldarius mutated SEQ ID NO 2211
MVSDAHAGLRNAISEVLTGATWQRCKVHTIRNVLSQVPKREQSMVASIIRSIFTQPTQEAAREQLRRVVAELRGRFPKAMDILEAAEEDVLAFMALPIEHWRQICSTNPLERLNREMRRRMDVVGIFPNRASVVRLAGAILQEQHEEWLVSRRYFSLESMAKLKPNRPLLAAEAMLQK

SEQ ID NO: 2220 - protein, 178 aa, Artificial
  Alicyclobacillus acidocaldarius mutated SEQ ID NO 2211
MVSDAHAGLRQAISEVLTGATWQRCKVHTIRNVLSQVPKREQSMVASIIRSIFTQPTQEAAREQLRRVVAELRGRFPKAMEILEAAEEDVLAFMALPIEHWRQICSTNPLERLNREMRRRMDVVGIFPNRASVVRLAGAILQEQHEEWLVSRRYFSLESMAKLKPNRPLLAAEAMLQK

SEQ ID NO: 2221 - protein, 178 aa, Artificial
  Alicyclobacillus acidocaldarius mutated SEQ ID NO 2211
MVSDAHAGLRQAISEVLTGATWQRCKVHTIRNVLSQVPKREQSMVASIIRSIFTQPTQEAAREQLRRVVAELRGRFPKAMDILEAAEEDVLAFMALPIEHWRQICSTNPLERLNREMRRRMDVVGIFPNRASVVRLAGAILQEQHEEWLVSRRYFSIESMAKLKPNRPLLAAEAMLQK

SEQ ID NO: 2222 - protein, 178 aa, Artificial
  Alicyclobacillus acidocaldarius mutated SEQ ID NO 2211
MVSDAHAGLRQAISEVLTGATWQRCKVHTIRNVLSQVPKREQSMVASIIRSIFTQPTQEAAREQLRRVVAELRGRFPKAMDILEAAEEDVLAFMALPIEHWRQICSTNPLERLNREMRRRMDVVGIFPNRASVVRLAGAILQEQHEEWLVSRRYFSLESMAKLKPNKPLLAAEAMLQK

SEQ ID NO: 2223 - DNA, 537 bp, Artificial
  Alicyclobacillus acidocaldarius mutated SEQ ID NO 2212
gtggtgagcgatgcgcacgcaggcttgcgccaggccatttcggaagtgctgacgggcgcgacgtggcaacgctgcaaagtgcacacgattcggaacgtgttgagccaagtcccgaagagggagcagtcgatggtggcctcgatcatccggtcaatcttcacccagcccacgcaagaagcggcccgcgagcagcttcgccgagtggtcgcggaactccgggggcgtttcccgaaggcgatggacattttggaggcagcagaggaggacgtgctggcctttatggcgctacctatcgagcactggcggcagatctgctcgaccaacccgctcgagcggctcaatcgagagatgcgtcggcggatggacgtcgtggggattttcccgaatcgagcatcggtagtgcgcctcgctggagcgattttgcaagagcagcacgaagaatggctggtgtcgcggcgatatttcagcctggagtcgatggcgaaactcaagccccaacgtccgctcctcgcagccgaggcgatgttgcaaaaataa

SEQ ID NO: 2224 - DNA, 537 bp, Artificial
  Alicyclobacillus acidocaldarius mutated SEQ ID NO 2212
gtggtgagcgatgcgcacgcaggcttgcgcaatgccatttcggaagtgctgacgggcgcgacgtggcaacgctgcaaagtgcacacgattcggaacgtgttgagccaagtcccgaagagggagcagtcgatggtggcctcgatcatccggtcaatcttcacccagcccacgcaagaagcggcccgcgagcagcttcgccgagtggtcgcggaactccgggggcgtttcccgaaggcgatggacattttggaggcagcagaggaggacgtgctggcctttatggcgctacctatcgagcactggcggcagatctgctcgaccaacccgctcgagcggctcaatcgagagatgcgtcggcggatggacgtcgtggggattttcccgaatcgagcatcggtagtgcgcctcgctggagcgattttgcaagagcagcacgaagaatggctggtgtcgcggcgatatttcagcctggagtcgatggcgaaactcaagcccaaccgtccgctcctcgcagccgaggcgatgttgcaaaaataa

SEQ ID NO: 2225 - DNA, 537 bp, Artificial
  Alicyclobacillus acidocaldarius mutated SEQ ID NO 2212
gtggtgagcgatgcgcacgcaggcttgcgccaggccatttcggaagtgctgacgggcgcgacgtggcaacgctgcaaagtgcacacgattcggaacgtgttgagccaagtcccgaagagggagcagtcgatggtggcctcgatcatccggtcaatcttcacccagcccacgcaagaagcggcccgcgagcagcttcgccgagtggtcgcggaactccgggggcgtttcccgaaggcgatggaaattttggaggcagcagaggaggacgtgctggcctttatggcgctacctatcgagcactggcggcagatctgctcgaccaacccgctcgagcggctcaatcgagagatgcgtcggcggatggacgtcgtggggattttcccgaatcgagcatcggtagtgcgcctcgctggagcgattttgcaagagcagcacgaagaatggctggtgtcgcggcgatatttcagcctggagtcgatggcgaaactcaagcccaaccgtccgctcctcgcagccgaggcgatgttgcaaaaataa

SEQ ID NO: 2226 - DNA, 537 bp, Artificial
  Alicyclobacillus acidocaldarius mutated SEQ ID NO 2212
gtggtgagcgatgcgcacgcaggcttgcgccaggccatttcggaagtgctgacgggcgcgacgtggcaacgctgcaaagtgcacacgattcggaacgtgttgagccaagtcccgaagagggagcagtcgatggtggcctcgatcatccggtcaatcttcacccagcccacgcaagaagcggcccgcgagcagcttcgccgagtggtcgcggaactccgggggcgtttcccgaaggcgatggacattttggaggcagcagaggaggacgtgctggcctttatggcgctacctatcgagcactggcggcagatctgctcgaccaacccgctcgagcggctcaatcgagagatgcgtcggcggatggacgtcgtggggattttcccgaatcgagcatcggtagtgcgcctcgctggagcgattttgcaagagcagcacgaagaatggctggtgtcgcggcgatatttcagcattgagtcgatggcgaaactcaagcccaaccgtccgctcctcgcagccgaggcgatgttgcaaaaataa

SEQ ID NO: 2227 - DNA, 537 bp, Artificial
  Alicyclobacillus acidocaldarius mutated SEQ ID NO 2212
gtggtgagcgatgcgcacgcaggcttgcgccaggccatttcggaagtgctgacgggcgcgacgtggcaacgctgcaaagtgcacacgattcggaacgtgttgagccaagtcccgaagagggagcagtcgatggtggcctcgatcatccggtcaatcttcacccagcccacgcaagaagcggcccgcgagcagcttcgccgagtggtcgcggaactccgggggcgtttcccgaaggcgatggacattttggaggcagcagaggaggacgtgctggcctttatggcgctacctatcgagcactggcggcagatctgctcgaccaacccgctcgagcggctcaatcgagagatgcgtcggcggatggacgtcgtggggattttcccgaatcgagcatcggtagtgcgcctcgctggagcgattttgcaagagcagcacgaagaatggctggtgtcgcggcgatatttcagcctggagtcgatggcgaaactcaagcccaacaaaccgctcctcgcagccgaggcgatgttgcaaaaataa

SEQ ID NO: 2228 - protein, 103 aa, Alicyclobacillus acidocaldarius
MRIPQDHRPQFLKIIGMNSPPPCRIVAPVIRSWEVPVMREDERMEIRQLYEAGVSISELARRFGYDRKTIRNALNSSLERSRAQERRVGSERKVPSWSPTRIT

SEQ ID NO: 2229 - DNA, 312 bp, Alicyclobacillus acidocaldarius
atgagaattccccaagatcatcggcctcaattcctcaaaatcatcgggatgaattccccacccccatgtcgaatcgtggcacctgtcatccgttcatgggaggtgcccgtcatgagggaggacgagaggatggagatcaggcaactctacgaggcaggcgtcagcatctcggagctggccagaagatttggctatgaccgaaagaccattcgcaacgcactgaattcatcgctggagagaagcagggcgcaagagcgtcgcgtggggagcgaaagaaaggttccaagctggagccctacaaggattacgtga

SEQ ID NO: 2230 - protein, 51 aa, Symbiobacterium thermophilum
MLRSGETLEIRQMYAGGLSISEIARRTGRDRKTIRKWLRTNTMPKPAKRKR

SEQ ID NO: 2231 - protein, 61 aa, Methanosarcina mazei
MLKTEEWLLIRDLYSQGFSISEIAKQTGFDRKTVRKYLRLKTLPEPQKRSGRKSKLDPFKP

SEQ ID NO: 2232 - protein, 42 aa, Geobacillus stearothermophilus
IKEMYERGMSISDIARELGIDRKTVRKYIHSPNPPSKSKRKQ

SEQ ID NO: 2233 - protein, 42 aa, Geobacillus stearothermophilus; identical to SEQ ID NO: 2232

SEQ ID NO: 2234 - protein, 38 aa, Methanosarcina acetivorans
MLKTEEWLSIRDLYSQGFSISEISRRTGYARETVRKYL

SEQ ID NO: 2235 - protein, 103 aa, Artificial
  Alicyclobacillus acidocaldarius mutated SEQ ID NO 2228
MRIPQDHRPQFLKIIGMNSPPPCRIVAPVIRSWEVPVMREDERMEIRQLYEAGVSISELARRFGYDRKTIRNALNSSLERSRAQERRVGSERKVPSWSPTKIT

SEQ ID NO: 2236 - protein, 103 aa, Artificial
  Alicyclobacillus acidocaldarius mutated SEQ ID NO 2228
MRIPQDHRPQFLKIIGMNSPPPCRIVAPVIRSWEVPVMREDERMDIRQLYEAGVSISELARRFGYDRKTIRNALNSSLERSRAQERRVGSERKVPSWSPTRIT

SEQ ID NO: 2237 - protein, 103 aa, Artificial
  Alicyclobacillus acidocaldarius mutated SEQ ID NO 2228
MRIPQDHRPQFLKIIGMNSPPPCRIVAPVIRSWEVPVMREDERMEIRQLYEAGVSISELARRFGYDRKTIRNALNSSLERSRAQERRVGSERKVPSWSPTRLT

SEQ ID NO: 2238 - protein, 103 aa, Artificial
  Alicyclobacillus acidocaldarius mutated SEQ ID NO 2228
MKIPQDHRPQFLKIIGMNSPPPCRIVAPVIRSWEVPVMREDERMEIRQLYEAGVSISELARRFGYDRKTIRNALNSSLERSRAQERRVGSERKVPSWSPTRIT

SEQ ID NO: 2239 - protein, 103 aa, Artificial
  Alicyclobacillus acidocaldarius mutated SEQ ID NO 2228
MRIPQDHRPQFLKIIGMNSPPPCRIVAPVIRSWEVPVMREDERMEIRQLYEAGVSISELARRFGYDRKTIRNALNSSLERSRAQERRVGSDRKVPSWSPTRIT

SEQ ID NO: 2240 - DNA, 312 bp, Artificial
  Alicyclobacillus acidocaldarius mutated SEQ ID NO 2229
atgagaattccccaagatcatcggcctcaattcctcaaaatcatcgggatgaattccccacccccatgtcgaatcgtggcacctgtcatccgttcatgggaggtgcccgtcatgagggaggacgagaggatggagatcaggcaactctacgaggcaggcgtcagcatctcggagctggccagaagatttggctatgaccgaaagaccattcgcaacgcactgaattcatcgctggagagaagcagggcgcaagagcgtcgcgtggggagcgaaagaaaggttccaagctggagccctacaaaaattacgtga

SEQ ID NO: 2241 - DNA, 312 bp, Artificial
  Alicyclobacillus acidocaldarius mutated SEQ ID NO 2229
atgagaattccccaagatcatcggcctcaattcctcaaaatcatcgggatgaattccccacccccatgtcgaatcgtggcacctgtcatccgttcatgggaggtgcccgtcatgagggaggacgagaggatggatatcaggcaactctacgaggcaggcgtcagcatctcggagctggccagaagatttggctatgaccgaaagaccattcgcaacgcactgaattcatcgctggagagaagcagggcgcaagagcgtcgcgtggggagcgaaagaaaggttccaagctggagccctacaaggattacgtga

SEQ ID NO: 2242 - DNA, 312 bp, Artificial
  Alicyclobacillus acidocaldarius mutated SEQ ID NO 2229
atgagaattccccaagatcatcggcctcaattcctcaaaatcatcgggatgaattccccacccccatgtcgaatcgtggcacctgtcatccgttcatgggaggtgcccgtcatgagggaggacgagaggatggagatcaggcaactctacgaggcaggcgtcagcatctcggagctggccagaagatttggctatgaccgaaagaccattcgcaacgcactgaattcatcgctggagagaagcagggcgcaagagcgtcgcgtggggagcgaaagaaaggttccaagctggagccctacaaggttaacgtga

SEQ ID NO: 2243 - DNA, 312 bp, Artificial
  Alicyclobacillus acidocaldarius mutated SEQ ID NO 2229
atgaaaattccccaagatcatcggcctcaattcctcaaaatcatcgggatgaattccccacccccatgtcgaatcgtggcacctgtcatccgttcatgggaggtgcccgtcatgagggaggacgagaggatggagatcaggcaactctacgaggcaggcgtcagcatctcggagctggccagaagatttggctatgaccgaaagaccattcgcaacgcactgaattcatcgctggagagaagcagggcgcaagagcgtcgcgtggggagcgaaagaaaggttccaagctggagccctacaaggattacgtga

SEQ ID NO: 2244 - DNA, 312 bp, Artificial
  Alicyclobacillus acidocaldarius mutated SEQ ID NO 2229
atgagaattccccaagatcatcggcctcaattcctcaaaatcatcgggatgaattccccacccccatgtcgaatcgtggcacctgtcatccgttcatgggaggtgcccgtcatgagggaggacgagaggatggagatcaggcaactctacgaggcaggcgtcagcatctcggagctggccagaagatttggctatgaccgaaagaccattcgcaacgcactgaattcatcgctggagagaagcagggcgcaagagcgtcgcgtggggagcgatagaaaggttccaagctggagccctacaaggattacgtga

SEQ ID NO: 2245 - protein, 169 aa, Alicyclobacillus acidocaldarius
MKQRMQLGVLNAERILREIREQGYTGGITVLREFMKPLRPVVSAKATERYESDPGEQAQIDLGAFPYYDSHGQRRTIWAFAMVLAYSRMLYVEFIKAADQLHILQALRNALEFFGGVPRVMLSDNCSPLVVANDGQGHVDCNRLISILPSSTDSCPRHVGLAGAAPRAR

SEQ ID NO: 2246 - DNA, 510 bp, Alicyclobacillus acidocaldarius
gtgaagcagcgtatgcaacttggtgttctcaacgctgaacgaattctgcgagagattcgggagcagggctataccggcggtatcaccgtcctacgtgagttcatgaagccacttcgcccggtggtctctgccaaggccacggaacgctatgagtcggatcctggtgaacaagcccagatcgatttgggggccttcccctactacgattcgcacggtcagcgacgaacgatttgggccttcgccatggtactcgcctactcccgcatgctctacgttgagtttatcaaagcggcagaccagctgcacatccttcaggcccttcgcaacgccctagagttctttggcggtgtgccgcgcgtcatgctcagcgacaactgttcacctttggtggtcgccaatgacggtcaaggccatgtcgactgcaaccggcttatctcgattttgccaagttctacggattcgtgcccaaggcatgtcggcctcgccggagccgcaccaagggcaaggtag

SEQ ID NO: 2247 - protein, 139 aa, Deinococcus geothermalis
LKGRIEQGVLSAVVLFREVQERGYQGQYTVVKDFVRPFRRTQVSAARVTTRFETAPGEQAQVDFGRYSYLNLEGQTRSIWAFVMVLGWSRALYVEFIRKADTASFIRCHLNAFAYFGGMTQSILYDNTKQVVLERDETG

SEQ ID NO: 2248 - protein, 132 aa, Symbiobacterium thermophilum
EQMQKGVTSASKMLYLLQQRGFKGKIRIVRAFMAPYRPMAKAAATVRFETPPGKQAQVDWADFGYIEVDGRRLKLYCFIMVLAYSRAMYLEFVTATDMKTFMRCHINAFKFFGGVPHEILYDNVKTVVKDRD

SEQ ID NO: 2249 - protein, 132 aa, Carboxydothermus hydrogenoformans
IQELMNLGIFNCEVIYERIKEEGYTGGRTILRDYVRQFRPPKQVPAVCRYETKPGQQAQVDWGEYTYIDEETGEIRKLYVFVMVLGYSRAIYVEFTNRCDVRTFIRCLIHGFEYFGGVTDIVLTDRMKTVIL

SEQ ID NO: 2250 - protein, 132 aa, Carboxydothermus hydrogenoformans
IQELMNLGIFNCEVIYERIKEEGYTGGRTILRDYVRQFRPPKQVPAVCRYETKPGQQAQVDWGEYTYIDEETGEIRKLYVFVMVLGYSRAIYVEFTNRCDVHTFIRCLIHGFEYFGGVTDIVLTDRMKTVIL

SEQ ID NO: 2251 - protein, 154 aa, Thermoanaerobacter tengcongensis
INMGIFNCEVIYERIKEEGYTGGKTILRDYVRQFRPSKHIQAVCRYETKSGEQAQVDWGEYNYIDQETGEVRKLYLFVMVLGYSRAMYVEFTNRCDVHTFNRCLIHGFEYFGGVTDVVLTDRMKTVIIGTDANKKPIWNAVFEDLAATLGFVPR

SEQ ID NO: 2252 - protein, 169 aa, Artificial
  Alicyclobacillus acidocaldarius mutated SEQ ID NO 2245
MKQRMQLGVLNAERILREIREQGYTGGITVLREFMKPLRPVVSAKATERYESEPGEQAQIDLGAFPYYDSHGQRRTIWAFAMVLAYSRMLYVEFIKAADQLHILQALRNALEFFGGVPRVMLSDNCSPLVVANDGQGHVDCNRLISILPSSTDSCPRHVGLAGAAPRAR

SEQ ID NO: 2253 - protein, 169 aa, Artificial
  Alicyclobacillus acidocaldarius mutated SEQ ID NO 2245
MKQRMQLGVLNAERILREIREQGYTGGITVLREFMKPLRPVVSARATERYESDPGEQAQIDLGAFPYYDSHGQRRTIWAFAMVLAYSRMLYVEFIKAADQLHILQALRNALEFFGGVPRVMLSDNCSPLVVANDGQGHVDCNRLISILPSSTDSCPRHVGLAGAAPRAR

SEQ ID NO: 2254 - protein, 169 aa, Artificial
  Alicyclobacillus acidocaldarius mutated SEQ ID NO 2245
MKQRMQLGVLNAERILREIREQGYTGGITVLREFMKPLRPVVSAKATERYESDPGEQAQIDLGAFPYYDSHGQKRTIWAFAMVLAYSRMLYVEFIKAADQLHILQALRNALEFFGGVPRVMLSDNCSPLVVANDGQGHVDCNRLISILPSSTDSCPRHVGLAGAAPRAR

SEQ ID NO: 2255 - protein, 169 aa, Artificial
  Alicyclobacillus acidocaldarius mutated SEQ ID NO 2245
MKQRMQLGVLNAEKILREIREQGYTGGITVLREFMKPLRPVVSAKATERYESDPGEQAQIDLGAFPYYDSHGQRRTIWAFAMVLAYSRMLYVEFIKAADQLHILQALRNALEFFGGVPRVMLSDNCSPLVVANDGQGHVDCNRLISILPSSTDSCPRHVGLAGAAPRAR

SEQ ID NO: 2256 - protein, 169 aa, Artificial
  Alicyclobacillus acidocaldarius mutated SEQ ID NO 2245
MKQRMQLGVINAERILREIREQGYTGGITVLREFMKPLRPVVSAKATERYESDPGEQAQIDLGAFPYYDSHGQRRTIWAFAMVLAYSRMLYVEFIKAADQLHILQALRNALEFFGGVPRVMLSDNCSPLVVANDGQGHVDCNRLISILPSSTDSCPRHVGLAGAAPRAR

SEQ ID NO: 2257 - DNA, 510 bp, Artificial
  Alicyclobacillus acidocaldarius mutated SEQ ID NO 2246
gtgaagcagcgtatgcaacttggtgttctcaacgctgaacgaattctgcgagagattcgggagcagggctataccggcggtatcaccgtcctacgtgagttcatgaagccacttcgcccggtggtctctgccaaggccacggaacgctatgagtcggaacctggtgaacaagcccagatcgatttgggggccttcccctactacgattcgcacggtcagcgacgaacgatttgggccttcgccatggtactcgcctactcccgcatgctctacgttgagtttatcaaagcggcagaccagctgcacatccttcaggcccttcgcaacgccctagagttctttggcggtgtgccgcgcgtcatgctcagcgacaactgttcacctttggtggtcgccaatgacggtcaaggccatgtcgactgcaaccggcttatctcgattttgccaagttctacggattcgtgcccaaggcatgtcggcctcgccggagccgcaccaagggcaaggtag

SEQ ID NO: 2258 - DNA, 510 bp, Artificial
  Alicyclobacillus acidocaldarius mutated SEQ ID NO 2246
gtgaagcagcgtatgcaacttggtgttctcaacgctgaacgaattctgcgagagattcgggagcagggctataccggcggtatcaccgtcctacgtgagttcatgaagccacttcgcccggtggtctctgcccgtgccacggaacgctatgagtcggatcctggtgaacaagcccagatcgatttgggggccttcccctactacgattcgcacggtcagcgacgaacgatttgggccttcgccatggtactcgcctactcccgcatgctctacgttgagtttatcaaagcggcagaccagctgcacatccttcaggcccttcgcaacgccctagagttctttggcggtgtgccgcgcgtcatgctcagcgacaactgttcacctttggtggtcgccaatgacggtcaaggccatgtcgactgcaaccggcttatctcgattttgccaagttctacggattcgtgcccaaggcatgtcggcctcgccggagccgcaccaagggcaaggtag

SEQ ID NO: 2259 - DNA, 510 bp, Artificial
  Alicyclobacillus acidocaldarius mutated SEQ ID NO 2246
gtgaagcagcgtatgcaacttggtgttctcaacgctgaacgaattctgcgagagattcgggagcagggctataccggcggtatcaccgtcctacgtgagttcatgaagccacttcgcccggtggtctctgccaaggccacggaacgctatgagtcggatcctggtgaacaagcccagatcgatttgggggccttcccctactacgattcgcacggtcagaaacgaacgatttgggccttcgccatggtactcgcctactcccgcatgctctacgttgagtttatcaaagcggcagaccagctgcacatccttcaggcccttcgcaacgccctagagttctttggcggtgtgccgcgcgtcatgctcagcgacaactgttcacctttggtggtcgccaatgacggtcaaggccatgtcgactgcaaccggcttatctcgattttgccaagttctacggattcgtgcccaaggcatgtcggcctcgccggagccgcaccaagggcaaggtag

SEQ ID NO: 2260 - DNA, 510 bp, Artificial
  Alicyclobacillus acidocaldarius mutated SEQ ID NO 2246
gtgaagcagcgtatgcaacttggtgttctcaacgctgaaaaaattctgcgagagattcgggagcagggctataccggcggtatcaccgtcctacgtgagttcatgaagccacttcgcccggtggtctctgccaaggccacggaacgctatgagtcggatcctggtgaacaagcccagatcgatttgggggccttcccctactacgattcgcacggtcagcgacgaacgatttgggccttcgccatggtactcgcctactcccgcatgctctacgttgagtttatcaaagcggcagaccagctgcacatccttcaggcccttcgcaacgccctagagttctttggcggtgtgccgcgcgtcatgctcagcgacaactgttcacctttggtggtcgccaatgacggtcaaggccatgtcgactgcaaccggcttatctcgattttgccaagttctacggattcgtgcccaaggcatgtcggcctcgccggagccgcaccaagggcaaggtag

SEQ ID NO: 2261 - DNA, 510 bp, Artificial
  Alicyclobacillus acidocaldarius mutated SEQ ID NO 2246
gtgaagcagcgtatgcaacttggtgttattaacgctgaacgaattctgcgagagattcgggagcagggctataccggcggtatcaccgtcctacgtgagttcatgaagccacttcgcccggtggtctctgccaaggccacggaacgctatgagtcggatcctggtgaacaagcccagatcgatttgggggccttcccctactacgattcgcacggtcagcgacgaacgatttgggccttcgccatggtactcgcctactcccgcatgctctacgttgagtttatcaaagcggcagaccagctgcacatccttcaggcccttcgcaacgccctagagttctttggcggtgtgccgcgcgtcatgctcagcgacaactgttcacctttggtggtcgccaatgacggtcaaggccatgtcgactgcaaccggcttatctcgattttgccaagttctacggattcgtgcccaaggcatgtcggcctcgccggagccgcaccaagggcaaggtag

SEQ ID NO: 2262 - protein, 512 aa, Alicyclobacillus acidocaldarius
MLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYAESQKTA

SEQ ID NO: 2263 - DNA, 1539 bp, Alicyclobacillus acidocaldarius
ttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacgcggaatcccaaaaaacggcttga

SEQ ID NO: 2264 - protein, 502 aa, Bacillus coagulans
LVLNILCSGKPLYKVHEFYQNLDSEMLFDTSVSPDQLNDDALGRALDYLYEAEAWKVYSTLALKTLKKLNLPIGILHNDTTSISVYGEYKQPKEDGLQITYGYSKAHRPDLKQIVLGMGVTPERIPILAKVENGNTSDKSWNVEFIQKMRKILSHEDWKNLIYQADSALITTENLAEIQQQNLSFISRLPDTFGLSTELKKEAWLLNNWERVGSLSNKKDAAIYQIQAFERQIQNLPYRFLVVHSNNLDQRKEKTLNRAIEKEEIQLKKEIEKLSKVIFHCKEDALEAIQSFKKKQKASYFCYKLNVQMSDQPIKRKKRGRPKKDEQTKREQIYQIQLESFEKDHDFIENKKKMLSTFVLITNKLDEETLSNQEVLRVYKGQSAAETRFRLIKDSQMIDAIYLKTPERVEALGIVYVMALLIYGILEYRVRKELKEKNLSLILKGKRKLYQPTGQALLEQLEDITVILINQNQQKIRLLPDNIDSQAKKIIELCGYDLSIYA

SEQ ID NO: 2265 - protein, 501 aa, Bacillus coagulans
LVLNILCSGKPLYKVHEFYQNLDSEMLFDTSISPDQLNDDALGRALDYLYKAEAWKVYSTLALKALKKLNLPIGVLHNDTTSISVYGEYKQPKEDGLQITYGYSKAHRPDLKQIVLGMGVTPERIPILAKVENGNTSDKSWNVEFIQKMRKILSHEDWKNLIYQADSALITTENLAEIQQQNLSFISRLPDTFGLSTELKKEAWLLNNWERVGSLSNKKDAAIYQIQAFERQIQNLPYRFLVVHSNNLDQRKEKTLNRAIEKEEIKLKKEIEKLSKVIFHCKEDALEAIQSFKKKQKASYFCYKLNVQMSDQPIKRKKRGRPKKDEQTKREQIYQIQLESFEKDHDFIENKKRMLSTFVLITNKLDEETLSNQEVLRVYKGQSAVETRFRLIKDSQMIDAIYLKTPERVEALGIVYVMALLIYGILEYRVRKELKEKNLSLILKGKRKLYQPTGQALLEQLEDITVILINQNRQKLRLLPDNIDSQAKKIIELCGYDLSIY

SEQ ID NO: 2266 - protein, 502 aa, Bacillus coagulans
LVLNILCSGKPLYKVHEFYQNLDSEMLFDTSVSPDQLNDDALGRALDYLYEAEAWKVYSTLALKALKKLNLPIGILHNDTTSISVYGEYKQPKEDGLQITYGYSKAHRPDLKQIVLGMGVTPERIPILAKVENGNTSDKSWNVEFIQKMRKILSHEDWKNLIYQADSALITTENLAEIQQQNLSFISRLPDTFGLSTELKKEAWLLNNWERVGSLSNKKDAAIYQIQAFERQIQNLPYRFLVVHSNNLDQRKEKTLNRAIEKEEIQLKKEIEKLSKVIFHCKEDALEAIQSFKKKQKASYFCYKLNVQMSDQPIKRKKRGRPKKDEQTKREQIYQIQLESFEKDHDFIENKKKMLSTFVLITNKLDEETLSNQEVLRVYKGQSAAETRFRLIKDSQMIDAIYLKTPERVEALGIVYVMALLIYGILEYRVRKELKEKNLSLILKGKRKLSQPTGQALLEQLEDITVILINQNQQKIRLLPDNIDSQAKKIIELCGYDLSIYA

SEQ ID NO: 2267 - protein, 501 aa, Bacillus coagulans
LVLNILCSGKPLYKVHEFYQNLDSEMLFDTSISPDQLNDDALGRALDYLYKAEAWKVYSTLALKALKKLNLPIGVLHNDTTSISVYGEYKQPKEDGLQITYGYSKAHRPDLKQIVLGMGVTPERIPILAKVENGNTSDKSWNVEFIQKMRKILSHEDWKNLIYQADSALITTENLAEIQQQNLSFISRLPDTFGLSTELKKEAWLLNNWERVGSLSNKKDAAIYQIQAFERQIQNLPYRFLVVHSNNLDQRKEKTLNRAIEKEEIQLKKEIEKLSKVIFHCKEDALEAIQSFKKKQKASYFCYKLNVQMSDQPIKRKKRGRPKKDEQTKREQIYQIQLESFEKDHDFIENKKKMLSTFVLITNKLDEETLSNQEVLRVYKGQSAAETRFRLIKDSQMIDAIYLKTPERVEALGIVYVMALLIYGILEYRVRKELKEKNLSLILKGKRKLYQPTGQALLEQLEDITVILINQNRQKLRLLPDNIDSQAKKIIELCGYDLSIY

SEQ ID NO: 2268 - protein, 303 aa, Moorella thermoacetica
LIINLLVDREALYHVERFYENQDLEVLFGAEQQVRPEDFNDDALGRALDKLFTSGQLKKLFSSIALTAAATHNVSIAGIHVDTTSISVQGAYDGEGDLDITFGFSKDHRPDLKQFLIGLTVNRDGLPILAQSLDGNSSDKSWYPQVIEELVQTFKPEKLKEVIFVADCALVTKDNLALLVQEEGNKPALQFISLLPENFGLNKEIKAEAFRTGTWQEIGKLSPKKDAACYKSQSFVREIDGRDYRLIVVHSTTLDKRKENSLLKKWAKQREVLEKAAKDLSRRPFACKADARKAIELFLREYR

SEQ ID NO: 2269 - protein, 512 aa, Artificial
  Alicyclobacillus acidocaldarius mutated SEQ ID NO 2262
MLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQLLRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYAESQKTA

SEQ ID NO: 2270 - protein, 512 aa, Artificial
  Alicyclobacillus acidocaldarius mutated SEQ ID NO 2262
MLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRIPATPHNPQIMRVLKLLNMDLSIYAESQKTA

SEQ ID NO: 2271 - protein, 512 aa, Artificial
  Alicyclobacillus acidocaldarius mutated SEQ ID NO 2262
MLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICADQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYAESQKTA

SEQ ID NO: 2272 - protein, 512 aa, Artificial
  Alicyclobacillus acidocaldarius mutated SEQ ID NO 2262
MLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLAEAEDSAHYRIQAFRRTLYGRTYRFVVVRSSSLDTRKERKLKEVLKREKAALEKAAKAMSQNVYSCEQDAQMAMQTFMHEHRATLHPISARICAENVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYAESQKTA

SEQ ID NO: 2273 - protein, 512 aa, Artificial
  Alicyclobacillus acidocaldarius mutated SEQ ID NO 2262
MLVNIGTNREALYRVEEFYAQRDVEVLLGSGVSADDLHDDALARALDALYDAGLEALYARIALHTLRRLRVLSDSNELIPIHADTTSLSMTGEYLDQTAFRIDRGFSKDHRPDLKQIVFGLCTVHGLGLCANVNPGNLDDHTWNFENIQQLLSQLDEETRKRSVYVADAALVTKDNLELLAEEDFHFISRLPGTYKLSEDLKRAAWEKENSWKEVGRLADAEDSAHYRIQAFRRTLYGRTYRFVVVRSSSLDTRKERKLKEVLKREKAALEKAAKAMSQNVYSCEQDAQMAMQTFMHEHRATLHPISARICAEQVQAKRARRGRPRKDDPPPPVHTQYRVEVAILPPSEERVQQWREKEATFVLITDIRDDQRVSDEQILRLYKEQHEVEARFRYLKSPYHVGPIYLHKPTRVKAFGFVMLLSLLLYSVLEYLIREKMKRETEPLMLPGNRKSFRPTGLAILEMLDGVTTVHMQVGDTWQRVPATPHNPQIMRVLKLLNMDLSIYAESQKTA

SEQ ID NO: 2274 - DNA, 1539 bp, Artificial
  Alicyclobacillus acidocaldarius mutated SEQ ID NO 2263
ttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagttactccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacgcggaatcccaaaaaacggcttga

SEQ ID NO: 2275 - DNA, 1539 bp, Artificial
  Alicyclobacillus acidocaldarius mutated SEQ ID NO 2263
ttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgaattcctgcaacgcctcataatcctcagatcatgagggttcttaagctgctgaacatggacctgagcatctacgcggaatcccaaaaaacggcttga

SEQ ID NO: 2276 - DNA, 1539 bp, Artificial
  Alicyclobacillus acidocaldarius mutated SEQ ID NO 2263
ttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgatcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacgcggaatcccaaaaaacggcttga

SEQ ID NO: 2277 - DNA, 1539 bp, Artificial
  Alicyclobacillus acidocaldarius mutated SEQ ID NO 2263
ttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgaggcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagaatgtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacgcggaatcccaaaaaacggcttga

SEQ ID NO: 2278 - DNA, 1539 bp, Artificial
  Alicyclobacillus acidocaldarius mutated SEQ ID NO 2263
ttgctggttaatatcggcacgaatcgcgaagccctctaccgggtggaggagttctacgcgcaacgggatgtggaagtcctgcttggaagcggcgtctccgcagacgatctccatgatgacgctttggcccgggctctggatgccttgtacgacgcaggtctcgaggcattatacgcgcgtatcgccctccacacgctacgcagactccgggtgctcagcgattccaacgaactcatccccatccatgcggataccacgtcgctctctatgacaggcgagtacctggaccaaacagcgtttcgcattgaccggggattctccaaggaccaccggcctgatctcaagcaaattgtgtttggactttgcaccgtccatggtctggggctatgcgcgaacgtcaaccctgggaacttggacgatcacacatggaatttcgagaacatccagcaactcctgagccagctcgatgaggagacgcgaaagagaagcgtctacgtcgcggacgcggcgttggtgacgaaggacaaccttgagcttttggcggaggaagacttccatttcatctcacgactgccggggacgtataagctgtccgaggacctgaagagagcggcatgggagaaagaaaacagctggaaagaagtcggtcggctcgctgatgcggaagacagcgcccattacaggatccaggccttccgtcgcacgctgtacgggcgaacgtatcgattcgtcgtggtgcgctcctccagcctggatacccggaaggagcgtaagctcaaagaggtgctcaagcgtgagaaggctgcgctggagaaagcggccaaggcgatgagccaaaacgtctacagttgtgaacaagatgcgcagatggccatgcagaccttcatgcacgaacaccgtgccactttgcatcccatctccgcccgcatatgtgccgagcaggtgcaggcaaaacgcgcgcgccgcggtcgcccgcgcaaagatgacccgccaccgccggtgcatacacagtaccgtgtggaagtggcgatcttaccgccttctgaggagcgggttcagcagtggcgagagaaggaagcgacgtttgtgctcatcaccgacatccgcgatgatcagcgtgtgtcagatgaacagatcctccgcctgtataaggaacaacacgaggtggaggcgcgttttcggtatctgaaaagcccgtatcacgtgggtcccatctacctgcataagccgacacgggtgaaagcgttcggtttcgtcatgctgttatccctgctcttgtatagcgtattggaatatctcatccgagagaagatgaagcgggaaacggaaccgctcatgctgccaggcaatcgaaagagttttcgtccaacagggttggccatcctcgagatgctggatggagtgacgaccgtgcacatgcaggtcggcgacacgtggcagcgagtacctgcaacgcctcataatcctcagatcatgagggttcttaagctgctgaacatggacctgagcatctacgcggaatcccaaaaaacggcttga

SEQ ID NO: 2279 - protein, 138 aa, Alicyclobacillus acidocaldarius
MELLSKEQIRQLIRDGKLKDIHDVQSMLKDLFASTIQEMLEAELNTHLGYAKYDAKHKDTDNARNGHGAKRTVQSELGDIDIALPRDRKGEFEPLIVQKRQKRMPSIEEQVIALYLKFDSKTPHPKVRTALQRGFFAV

SEQ ID NO: 2280 - DNA, 417 bp, Alicyclobacillus acidocaldarius
atggaacttctatccaaggagcaaatccgtcaactcattcgagatggcaagttgaaggatattcacgacgtccaaagcatgctcaaggatcttttcgcgagcaccatccaagagatgctcgaagccgaattgaacacgcacctggggtatgccaaatacgacgcgaagcacaaagacacggataacgcccgaaatggccacggcgccaagcggacggtgcagtccgaactcggcgatatcgatatcgcgcttcctcgagaccggaaaggcgagtttgagcctttgattgtgcaaaagcgtcaaaagcgcatgccaagtatcgaagaacaggtcattgcgctgtatctcaagtttgacagtaagacgcctcatccgaaggtccgaaccgcgctacagcgcggttttttcgccgtttag

SEQ ID NO: 2281 - protein, 116 aa, Paenibacillus larvae
MGLWTKQQLREFIKENNLVTAQDAQNALKELFAETIQEMLEAELDTHLGYEKHEVKAKKTPNSRNGRSHKTVVSEYGEQQIAVPRDRMGEFEPLVVKKHQSNVTGIEDQIVALYAK

SEQ ID NO: 2282 - protein, 116 aa, Paenibacillus larvae; identical to SEQ ID NO: 2281

SEQ ID NO: 2283 - protein, 116 aa, Paenibacillus larvae; identical to SEQ ID NO: 2281

SEQ ID NO: 2284 - protein, 116 aa, Thermoanaerobacter pseudethanolicus
MSLLTKEQLRNFISENNIQSIPDLYTSLKNLFKDTIQEMLEAELSTELGYERYDKKDKDTQNSRNGYTQKTVKTQFGEMEIDIPRDRQGEFEPKIVPKYKRDISGIEEKVIALYAR

SEQ ID NO: 2285 - protein, 116 aa, Thermoanaerobacter pseudethanolicus; identical to SEQ ID NO: 2284

SEQ ID NO: 2286 - protein, 138 aa, Artificial
  Alicyclobacillus acidocaldarius mutated SEQ ID NO 2279
MELLSKEQIRQLIRDGKLKDIHDVQSMLKDLFASTIQEMLEAELNTHLGYAKYDAKHKDTDNARNGHGAKRTVQSELGDIDIALPRDRKGEFEPIIVQKRQKRMPSIEEQVIALYLKFDSKTPHPKVRTALQRGFFAV

SEQ ID NO: 2287 - protein, 138 aa, Artificial
  Alicyclobacillus acidocaldarius mutated SEQ ID NO 2279
MELLSKEQIRQLIRDGKLKDIHDIQSMLKDLFASTIQEMLEAELNTHLGYAKYDAKHKDTDNARNGHGAKRTVQSELGDIDIALPRDRKGEFEPLIVQKRQKRMPSIEEQVIALYLKFDSKTPHPKVRTALQRGFFAV

SEQ ID NO: 2288 - protein, 138 aa, Artificial
  Alicyclobacillus acidocaldarius mutated SEQ ID NO 2279
MELLSKEQIRQLIRDGKLKDIHDVQSMLKDLFASTIQEMLEAELNTHLGYAKYDAKHKDTDNARNGHGAKRTVNSELGDIDIALPRDRKGEFEPLIVQKRQKRMPSIEEQVIALYLKFDSKTPHPKVRTALQRGFFAV

SEQ ID NO: 2289 - protein, 138 aa, Artificial
  Alicyclobacillus acidocaldarius mutated SEQ ID NO 2279
MELLSKEQIRQLIRDGKLKDIHDVQSMLKDLFASTIQEMLEAELNTHLGYAKYDAKHKDTDNARNGHGAKRTVQSELGDIDIALPRDRKGEFEPLIVQKRQRRMPSIEEQVIALYLKFDSKTPHPKVRTALQRGFFAV

SEQ ID NO: 2290 - protein, 138 aa, Artificial
  Alicyclobacillus acidocaldarius mutated SEQ ID NO 2279
MELLSKEQIRQLIRDGKLKDIHDVQSMLKDLFASTIQEMLEAELNTHLGYAKYDAKHKDTDNARNGHGAKRTVQSELGDIDIALPRDRKGEFEPLIVQKRQKRMPSIEEQVIALYLKFDSKTPHPKVRTAIQRGFFAV

SEQ ID NO: 2291 - DNA, 417 bp, Artificial
  Alicyclobacillus acidocaldarius mutated SEQ ID NO 2280
atggaacttctatccaaggagcaaatccgtcaactcattcgagatggcaagttgaaggatattcacgacgtccaaagcatgctcaaggatcttttcgcgagcaccatccaagagatgctcgaagccgaattgaacacgcacctggggtatgccaaatacgacgcgaagcacaaagacacggataacgcccgaaatggccacggcgccaagcggacggtgcagtccgaactcggcgatatcgatatcgcgcttcctcgagaccggaaaggcgagtttgagcctattattgtgcaaaagcgtcaaaagcgcatgccaagtatcgaagaacaggtcattgcgctgtatctcaagtttgacagtaagacgcctcatccgaaggtccgaaccgcgctacagcgcggttttttcgccgtttag

SEQ ID NO: 2292 - DNA, 417 bp, Artificial
  Alicyclobacillus acidocaldarius mutated SEQ ID NO 2280
atggaacttctatccaaggagcaaatccgtcaactcattcgagatggcaagttgaaggatattcacgacattcaaagcatgctcaaggatcttttcgcgagcaccatccaagagatgctcgaagccgaattgaacacgcacctggggtatgccaaatacgacgcgaagcacaaagacacggataacgcccgaaatggccacggcgccaagcggacggtgcagtccgaactcggcgatatcgatatcgcgcttcctcgagaccggaaaggcgagtttgagcctttgattgtgcaaaagcgtcaaaagcgcatgccaagtatcgaagaacaggtcattgcgctgtatctcaagtttgacagtaagacgcctcatccgaaggtccgaaccgcgctacagcgcggttttttcgccgtttag

SEQ ID NO: 2293 - DNA, 417 bp, Artificial
  Alicyclobacillus acidocaldarius mutated SEQ ID NO 2280
atggaacttctatccaaggagcaaatccgtcaactcattcgagatggcaagttgaaggatattcacgacgtccaaagcatgctcaaggatcttttcgcgagcaccatccaagagatgctcgaagccgaattgaacacgcacctggggtatgccaaatacgacgcgaagcacaaagacacggataacgcccgaaatggccacggcgccaagcggacggtgaattccgaactcggcgatatcgatatcgcgcttcctcgagaccggaaaggcgagtttgagcctttgattgtgcaaaagcgtcaaaagcgcatgccaagtatcgaagaacaggtcattgcgctgtatctcaagtttgacagtaagacgcctcatccgaaggtccgaaccgcgctacagcgcggttttttcgccgtttag

SEQ ID NO: 2294 - DNA, 417 bp, Artificial
  Alicyclobacillus acidocaldarius mutated SEQ ID NO 2280
atggaacttctatccaaggagcaaatccgtcaactcattcgagatggcaagttgaaggatattcacgacgtccaaagcatgctcaaggatcttttcgcgagcaccatccaagagatgctcgaagccgaattgaacacgcacctggggtatgccaaatacgacgcgaagcacaaagacacggataacgcccgaaatggccacggcgccaagcggacggtgcagtccgaactcggcgatatcgatatcgcgcttcctcgagaccggaaaggcgagtttgagcctttgattgtgcaaaagcgtcaacgtcgcatgccaagtatcgaagaacaggtcattgcgctgtatctcaagtttgacagtaagacgcctcatccgaaggtccgaaccgcgctacagcgcggttttttcgccgtttag

SEQ ID NO: 2295 - DNA, 417 bp, Artificial
  Alicyclobacillus acidocaldarius mutated SEQ ID NO 2280
atggaacttctatccaaggagcaaatccgtcaactcattcgagatggcaagttgaaggatattcacgacgtccaaagcatgctcaaggatcttttcgcgagcaccatccaagagatgctcgaagccgaattgaacacgcacctggggtatgccaaatacgacgcgaagcacaaagacacggataacgcccgaaatggccacggcgccaagcggacggtgcagtccgaactcggcgatatcgatatcgcgcttcctcgagaccggaaaggcgagtttgagcctttgattgtgcaaaagcgtcaaaagcgcatgccaagtatcgaagaacaggtcattgcgctgtatctcaagtttgacagtaagacgcctcatccgaaggtccgaaccgcgattcagcgcggttttttcgccgtttag

SEQ ID NO: 2296 - protein, 599 aa, Alicyclobacillus acidocaldarius
MILLFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGEHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAITKEALRDGKFLIRTNTDLPAADVAQSYKTLMGIERAFHQIKNFLDVGPIYHWNEQRVRGHIFVCVLAYLFEQEMQVLYRRQWAHDKAVAESLACVEEQAKVLAELESRWYTGEAIVRELRRWKAVRATFLDKEFVSVTKATDQAKAILTSLGIPTPNKTLSVTKVPSMTPDE

SEQ ID NO: 2297 - DNA, 1800 bp, Alicyclobacillus acidocaldarius
gtgatcctcttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagagcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgcaatcaccaaggaagcactgcgcgacggaaagttcctgattcgaaccaatacggatttgcctgcagccgacgtggcccaatcgtacaagacgttgatggggatcgaacgtgcgtttcaccaaatcaaaaacttcctggatgtcgggccgatctatcactggaatgagcagcgggttcgcgggcacatcttcgtctgcgtgctggcctacctcttcgagcaggagatgcaagtgctctatcgccgccaatgggcccacgacaaggcagtggcggaaagccttgcatgcgttgaagagcaggccaaggtgctagccgaactcgagtcgcggtggtacaccggcgaagccatcgtacgggagctgagacgctggaaagcggtgcgcgccacattcttggacaaggagttcgtcagtgtgaccaaagcgacggaccaggcgaaggccatcctcacgagcctgggcattccgacgccaaacaagaccttgtcggtgacgaaagtcccatccatgacgccggacgagtaa

SEQ ID NO: 2298 - protein, 522 aa, Desulfitobacterium hafniense; identical to SEQ ID NO: 2060

SEQ ID NO: 2299 - protein, 522 aa, Desulfitobacterium hafniense; identical to SEQ ID NO: 2061

SEQ ID NO: 2300 - protein, 522 aa, Desulfitobacterium hafniense; identical to SEQ ID NO: 2062

SEQ ID NO: 2301 - protein, 522 aa, Desulfitobacterium hafniense; identical to SEQ ID NO: 2063

SEQ ID NO: 2302 - protein, 433 aa, Desulfitobacterium hafniense; identical to SEQ ID NO: 2064

SEQ ID NO: 2303 - protein, 599 aa, Artificial
  Alicyclobacillus acidocaldarius mutated SEQ ID NO 2296
MILLFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGEHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAITKEALRDGKFLIRTNTDLPAADVAQSYKTLMGIERAFHQIKNFLDVGPIYHWNEQRVRGHIFVCVLAYLFEQEMQVLYRRQWAHDKAVAESLACVEEQAKVLAELESRWYTGEAIVRELRRWKAVRATFLDKEFVSVTKATDQAKAILTSLGIPTPNKTLSVTRVPSMTPDE

SEQ ID NO: 2304 - protein, 599 aa, Artificial
  Alicyclobacillus acidocaldarius mutated SEQ ID NO 2296
MILIFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGEHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAITKEALRDGKFLIRTNTDLPAADVAQSYKTLMGIERAFHQIKNFLDVGPIYHWNEQRVRGHIFVCVLAYLFEQEMQVLYRRQWAHDKAVAESLACVEEQAKVLAELESRWYTGEAIVRELRRWKAVRATFLDKEFVSVTKATDQAKAILTSLGIPTPNKTLSVTKVPSMTPDE

SEQ ID NO: 2305 - protein, 599 aa, Artificial
  Alicyclobacillus acidocaldarius mutated SEQ ID NO 2296
MILLFAQIVSTKKPDGRTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGEHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAITKEALRDGKFLIRTNTDLPAADVAQSYKTLMGIERAFHQIKNFLDVGPIYHWNEQRVRGHIFVCVLAYLFEQEMQVLYRRQWAHDKAVAESLACVEEQAKVLAELESRWYTGEAIVRELRRWKAVRATFLDKEFVSVTKATDQAKAILTSLGIPTPNKTLSVTKVPSMTPDE

SEQ ID NO: 2306 - protein, 599 aa, Artificial
  Alicyclobacillus acidocaldarius mutated SEQ ID NO 2296
MILLFAQIVSTRKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGEHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAITKEALRDGKFLIRTNTDLPAADVAQSYKTLMGIERAFHQIKNFLDVGPIYHWNEQRVRGHIFVCVLAYLFEQEMQVLYRRQWAHDKAVAESLACVEEQAKVLAELESRWYTGEAIVRELRRWKAVRATFLDKEFVSVTKATDQAKAILTSLGIPTPNKTLSVTKVPSMTPDE

SEQ ID NO: 2307 - protein, 599 aa, Artificial
  Alicyclobacillus acidocaldarius mutated SEQ ID NO 2296
MILLFAQIVSTKKPDGKTYKYLHIVESYREGRTVKKRRVASLGNISQYSEREIEQIIRTLESLLQHRTTGSLEDFEAQQVLHFGVPYVVQFLWNQLGLTEAIRDALRAREVTFDVARYVQAMVIHRLVDPSSKLRLFHTLDDLYLPDWGGEPWQLQHFYRALDYLVDIKPQLERVLYARLTDLLNFRLSLVLYDLTSTHLHGHACPLGEHGYSRTHRPDLEQVELGLLVTPEGIPITHEVFAGNVSDKQTVPDILKRLKEDFAVEQCVFVGDRGMVTEKNMALMAEAGFPYIVGFHKRGRIVSDALLEQFADVNAYHELKDNLRYLEVPAASVDDVEKAEGVRYILCYNPEKARQDAAFRESALEEAETGLKALAESLAKPKRGRKPTDKGVMLKVADLLTRKGVEAFFQVDYKDGILTYRRDEDAITKEALRDGKFLIRTNTDLPAADVAQSYKTLMGIERAFHQIKNFLDVGPIYHWNEQRVRGHIFVCVLAYLFEQEMQVLYRRQWAHDKAVAESLACIEEQAKVLAELESRWYTGEAIVRELRRWKAVRATFLDKEFVSVTKATDQAKAILTSLGIPTPNKTLSVTKVPSMTPDE

SEQ ID NO: 2308 - DNA, 1800 bp, Artificial
  Alicyclobacillus acidocaldarius mutated SEQ ID NO 2297
gtgatcctcttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagagcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgcaatcaccaaggaagcactgcgcgacggaaagttcctgattcgaaccaatacggatttgcctgcagccgacgtggcccaatcgtacaagacgttgatggggatcgaacgtgcgtttcaccaaatcaaaaacttcctggatgtcgggccgatctatcactggaatgagcagcgggttcgcgggcacatcttcgtctgcgtgctggcctacctcttcgagcaggagatgcaagtgctctatcgccgccaatgggcccacgacaaggcagtggcggaaagccttgcatgcgttgaagagcaggccaaggtgctagccgaactcgagtcgcggtggtacaccggcgaagccatcgtacgggagctgagacgctggaaagcggtgcgcgccacattcttggacaaggagttcgtcagtgtgaccaaagcgacggaccaggcgaaggccatcctcacgagcctgggcattccgacgccaaacaagaccttgtcggtgacgcgtgtcccatccatgacgccggacgagtaa

SEQ ID NO: 2309 - DNA, 1800 bp, Artificial
  Alicyclobacillus acidocaldarius mutated SEQ ID NO 2297
gtgatcctcattttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagagcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgcaatcaccaaggaagcactgcgcgacggaaagttcctgattcgaaccaatacggatttgcctgcagccgacgtggcccaatcgtacaagacgttgatggggatcgaacgtgcgtttcaccaaatcaaaaacttcctggatgtcgggccgatctatcactggaatgagcagcgggttcgcgggcacatcttcgtctgcgtgctggcctacctcttcgagcaggagatgcaagtgctctatcgccgccaatgggcccacgacaaggcagtggcggaaagccttgcatgcgttgaagagcaggccaaggtgctagccgaactcgagtcgcggtggtacaccggcgaagccatcgtacgggagctgagacgctggaaagcggtgcgcgccacattcttggacaaggagttcgtcagtgtgaccaaagcgacggaccaggcgaaggccatcctcacgagcctgggcattccgacgccaaacaagaccttgtcggtgacgaaagtcccatccatgacgccggacgagtaa

SEQ ID NO: 2310 - DNA, 1800 bp, Artificial
  Alicyclobacillus acidocaldarius mutated SEQ ID NO 2297
gtgatcctcttgttcgcgcaaattgtatccacaaagaagcccgacggtcgtacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagagcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgcaatcaccaaggaagcactgcgcgacggaaagttcctgattcgaaccaatacggatttgcctgcagccgacgtggcccaatcgtacaagacgttgatggggatcgaacgtgcgtttcaccaaatcaaaaacttcctggatgtcgggccgatctatcactggaatgagcagcgggttcgcgggcacatcttcgtctgcgtgctggcctacctcttcgagcaggagatgcaagtgctctatcgccgccaatgggcccacgacaaggcagtggcggaaagccttgcatgcgttgaagagcaggccaaggtgctagccgaactcgagtcgcggtggtacaccggcgaagccatcgtacgggagctgagacgctggaaagcggtgcgcgccacattcttggacaaggagttcgtcagtgtgaccaaagcgacggaccaggcgaaggccatcctcacgagcctgggcattccgacgccaaacaagaccttgtcggtgacgaaagtcccatccatgacgccggacgagtaa

SEQ ID NO: 2311 - DNA, 1800 bp, Artificial
  Alicyclobacillus acidocaldarius mutated SEQ ID NO 2297
gtgatcctcttgttcgcgcaaattgtatccacacgtaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagagcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgcaatcaccaaggaagcactgcgcgacggaaagttcctgattcgaaccaatacggatttgcctgcagccgacgtggcccaatcgtacaagacgttgatggggatcgaacgtgcgtttcaccaaatcaaaaacttcctggatgtcgggccgatctatcactggaatgagcagcgggttcgcgggcacatcttcgtctgcgtgctggcctacctcttcgagcaggagatgcaagtgctctatcgccgccaatgggcccacgacaaggcagtggcggaaagccttgcatgcgttgaagagcaggccaaggtgctagccgaactcgagtcgcggtggtacaccggcgaagccatcgtacgggagctgagacgctggaaagcggtgcgcgccacattcttggacaaggagttcgtcagtgtgaccaaagcgacggaccaggcgaaggccatcctcacgagcctgggcattccgacgccaaacaagaccttgtcggtgacgaaagtcccatccatgacgccggacgagtaa

SEQ ID NO: 2312 - DNA, 1800 bp, Artificial
  Alicyclobacillus acidocaldarius mutated SEQ ID NO 2297
gtgatcctcttgttcgcgcaaattgtatccacaaagaagcccgacggtaagacctacaagtatctccacatcgttgagtcctaccgtgaaggtcggacggtcaagaagcggcgtgtcgcaagcctaggcaacatcagtcaatattctgagcgcgaaatcgaacagattatccggaccctcgagtctctcctacaacatcgcaccaccggttcgctcgaggacttcgaggcccagcaggtactccatttcggcgttccgtatgtggtgcaatttttgtggaaccaactcgggctcaccgaggccattcgtgacgccctgcgtgcccgcgaggtcacctttgatgtcgcgcggtacgtccaagccatggtcattcatcggctcgtcgatccctcgagtaagcttcgcctctttcacacgctggacgatctctatcttcccgactggggcggggagccgtggcagcttcagcacttctatcgagcgctcgactatcttgtcgacatcaagcctcaactggaacgcgtgttgtacgcgcgactgacagacttgctgaacttcaggctctcgttggttctgtacgacttgaccagcactcatctccacgggcacgcctgtcccttaggagagcatgggtattcgcgaacgcatcgccccgacctcgagcaggtggagcttgggctcctggtgacccctgaaggcattcccatcacgcacgaagtgttcgcgggcaacgtgtccgacaagcaaaccgtgccggacatcttgaaacgtctgaaggaagactttgcggtcgagcagtgcgtgttcgtgggtgaccgcggcatggtcacggaaaagaacatggccctgatggcggaggcgggattcccgtacattgtcgggttccacaagcgcgggcgcatcgtgagcgacgcgttgctggaacagtttgcagacgtcaacgcctaccacgaactgaaagacaacctgcgctacctcgaggtgcccgccgcaagcgtggacgacgtcgaaaaggccgaaggcgtccgatacatcctttgctacaacccggagaaagcgcgtcaggatgccgcgtttcgggagagcgcgctggaggaggctgaaacgggtctgaaagctttggcggagagcttggcgaaaccgaagcgcggccgaaagccgaccgacaaaggcgtcatgctcaaggtggcggacctgttgaccagaaaaggggttgaagcgttttttcaggtcgattacaaggacggcatcctgacgtatcggcgcgatgaggacgcaatcaccaaggaagcactgcgcgacggaaagttcctgattcgaaccaatacggatttgcctgcagccgacgtggcccaatcgtacaagacgttgatggggatcgaacgtgcgtttcaccaaatcaaaaacttcctggatgtcgggccgatctatcactggaatgagcagcgggttcgcgggcacatcttcgtctgcgtgctggcctacctcttcgagcaggagatgcaagtgctctatcgccgccaatgggcccacgacaaggcagtggcggaaagccttgcatgcattgaagagcaggccaaggtgctagccgaactcgagtcgcggtggtacaccggcgaagccatcgtacgggagctgagacgctggaaagcggtgcgcgccacattcttggacaaggagttcgtcagtgtgaccaaagcgacggaccaggcgaaggccatcctcacgagcctgggcattccgacgccaaacaagaccttgtcggtgacgaaagtcccatccatgacgccggacgagtaa

SEQ ID NO: 2313 - protein, 315 aa, Alicyclobacillus acidocaldarius
MRVVQTCPYNPRHIKGTVKLELYARGFSTRDIQDHLQQIYGVDMSPTLVSNLTDRLLPRIQEWQNRPLHPLYTVVFLDAIHYKVREEGRLVSKAAYMVIGIDIEGQKDVLGIWIGQSESSKFWLGVLNDLKARGVQDVLVFSTDNLKGFSEAIAACFPQSDVQKCIVHQIRNSLRYVSYKDFKAVAAALKPIYQAPTEEAALMELDQFERGWGARYPLCVKSWRDNWTELATFYRYPVEMRRIMYTTNIIEGYHRQLRKATKGKSMFPNDEALLKMLYLATMELTRKWTMRVANWGTILGQLAIYFGDRVTPYIP

SEQ ID NO: 2314 - DNA, 948 bp, Alicyclobacillus acidocaldarius
gtgcgtgtggtacaaacttgcccctacaatccgcgtcatatcaagggtactgtcaaacttgagctgtatgctcgcggtttcagcacaagggatatccaggaccacctccagcagatctacggcgtggatatgtcgcccacgctggtgtcgaacctcaccgatcgcctcttgccgcggattcaggagtggcagaatcgtccattgcaccccctctataccgtcgtcttcctcgacgccattcactacaaggtgcgcgaagaaggccgcttggtaagcaaggcggcgtacatggtcattggcatcgacatcgagggtcagaaagatgtgctgggcatctggatagggcagagtgagtcctcgaagttctggctcggcgtgttgaatgacctgaaggcgcgcggcgtgcaggatgtgctcgtcttttcgactgacaacctgaagggattcagcgaagccatcgccgcctgtttcccgcaatccgatgtccaaaaatgcatcgtccaccaaattcgaaattcgctgcggtatgtgtcctataaggatttcaaggcggtcgcggcagcactcaagcccatctatcaggcacccacggaagaggcggccttgatggagcttgaccagtttgaacggggatggggagcgcgctatcccctgtgtgtgaagtcgtggcgagacaactggacggaactcgcgacgttctatcggtaccctgtggaaatgcggcgaatcatgtatacaacgaacatcatcgaaggctaccaccggcagctgcgaaaagcgacgaaagggaagagcatgtttccaaacgacgaagctttgctgaagatgctgtacctggcgacgatggagttgacgagaaaatggacgatgcgggtggccaactggggcaccattctggggcaattggccatctacttcggagatcgcgtgacgccctacattccgtga

SEQ ID NO: 2315 - protein, 291 aa, Natranaerobius thermophilus
LSMYAKGMTVRDIQTHLQELYGVDASPTLISGITDKIVPLIKEWQNRPLSRIYAHVVMDAVHYKVRQDGRIVNKAAYMAIGIDLDGMKDVLGIWIGENESSKYWLKIINELKNRGVEDILIVSIDGLKGFEDAIHAVYPQTEIQSCIIHQIRNSTRYISYKDRKEFCSDLKNVYRAPTEEVALIELDKLEEKWGDKYEISIRSWRNNWDKLSVMFKYPEEVRKLIYTNNSMESYNRQLRKVTKSKSIFPTDESLLKMLYLATMDITKKWTMRTKNWAQILGQLSIYFEGRI

SEQ ID NO: 2316 - protein, 254 aa, Paenibacillus larvae
LYAKGVSTREIQDHLQNLYGIEVSPTLISNVTNKIVPLIKEWQNRPLQSVYAVVFLDAIHFKVKQDGAIVSKAAYMVIGIDLDGNKDVLGMWIGENESSKFWLSVLNDLKNRGVQDILITCVDNLNGFSEAITASYPKTEIQKCIIHQIRNSTRYVSYKDLKKVTADLKPIYKASTEEAAVLELDRFEEVWGSKYPLIIRSWRNNWAELATFFKYPPEIRRLIYTTNMIESYHRQLRKVTKGKSIFPSDEALLK

SEQ ID NO: 2317 - protein, 297 aa, Clostridium beijerinckii
HLESAVIGMYAKGMTTRDIATQINDIYGMDASPTLISNITDKVIPMLKEWQSRPLESIYPIIFMDAIHFKVRKDNAIVSKAAYAVIGVNLEGKKDVLGIWIGASESPKYWLLVLNELKNRGINDILIACVDGLNGFKEAIKAVFPNTEIQRCIIHQIRNSSKYLSYKDLKAFNTDLKSVYKAPTEDVALAELDNLEEKWGGKYLIAIKSWRNNWDELSTFFKYPPEIRKIIYTTNAMESYNRQLRKVTKSKSIFPNDESLLKILYLATIDITKKWTQGIKGWAQILAQLSIFFEGRL

SEQ ID NO: 2318 - protein, 291 aa, Pelotomaculum thermopropionicum
IAMYAKGMSTRDIEDHMRDIYGIDVSPTMVSKITDKILPMISEWQSRPLDRVYPVVFLDAIHFKVRKENRIINKAAYSVMAINMAGQKEVLGIWVGENESASFWLGVCNDLKNRGVQDILIACKDGLSGFSEAISSAFPRTEIQLCIIHQIRNSMKYVPYKYQKELIADLKKIYQALTIEEAEMSFTTFKGKWGKKHPIIVRSWENNWLELTAYFKYPYEIRRMIYTTNIIEGYHRQLRKVTKTKTAYPTDEALVKIIYLATIEASKKWTMSIKDWKNCISQFAIYFEDRL

SEQ ID NO: 2319 - protein, 291 aa, Desulfotomaculum reducens
IAMYGKGMSTRDIEDHMRDIYGIDVSPTMVSRITDKIMPMVIEWQSRPLDRVYPIVFLDAIHFKVRQDNRIINKAAYSVLGITMDGHKEILGIWVGEHESSKFWLGVCNDLKSRGVEDILIACKDGLSGFSEAINTAFPKTQIQLCVIHQIRNSLKYVPYKYRKELMKDLKKVYQALTIEEAEFAFEEFKEKWGSKYPVVIKSWENNWVELTTYFQYPRGIRRMIYTTNVIEGYHRQLRKVTKTKTAYPSDEALVKMLYLATLDASKKWTMPLREWRECISQFLIFFGDRL

SEQ ID NO: 2320 - protein, 315 aa, Artificial
  Alicyclobacillus acidocaldarius mutated SEQ ID NO 2313
MRVVQTCPYNPRHIKGTVKLELYARGFSTRDIQDHLQQIYGVDMSPTLVSNLTDRLLPRIQEWQNRPLHPLYTVVFLDAIHYKVREEGRLVSKAAYMVIGIDIEGQKDVLGIWIGQSESSKFWLGVLNDLKARGVQDVLVFSTDNLKGFSEAIAACFPQSDVQKCIVHQIRNSLRYVSYKDFKAVAAALKPIYQAPTEEAALMELDQFERGWGARYPLCVKSWRDNWTELATFYRYPVEMRRIMYTTNIIEGYHRQLRKATKGKSMFPNDEALLKMLYLATMELTRKWTMRVANWGTILGQLAIYFGDRITPYIP

SEQ ID NO: 2321 - protein, 315 aa, Artificial
  Alicyclobacillus acidocaldarius mutated SEQ ID NO 2313
MRVVQTCPYNPRHIKGTVKLELYARGFSTRDIQDHLQQIYGVDMSPTLVSNLTDRLLPRIQEWQNRPLHPLYTVVFLDAIHYKVREEGRLVSKAAYMVIGIDIEGQKDVLGIWIGQSESSKFWLGVLNDLKARGVQDVLVFSTDNLKGFSEAIAACFPQSDVQKCIVHQIRNSLRYVSYKDFKAVAAALKPIYQAPTEEAALMELDQFERGWGARYPLCVKSWRDNWTELATFYRYPVEMRRIMYTTNIIEGYHRQLRKATKGKSMFPNDEALLKMLYLATMELTRKWTMRVANWGTIIGQLAIYFGDRVTPYIP

SEQ ID NO: 2322 - protein, 315 aa, Artificial
  Alicyclobacillus acidocaldarius mutated SEQ ID NO 2313
MRVVQTCPYNPRHIKGTVKLELYARGFSTRDIQDHLQQIYGVDMSPTLVSNLTDRLLPRIQEWQNRPLHPLYTVVFLDAIHYKVREEGKLVSKAAYMVIGIDIEGQKDVLGIWIGQSESSKFWLGVLNDLKARGVQDVLVFSTDNLKGFSEAIAACFPQSDVQKCIVHQIRNSLRYVSYKDFKAVAAALKPIYQAPTEEAALMELDQFERGWGARYPLCVKSWRDNWTELATFYRYPVEMRRIMYTTNIIEGYHRQLRKATKGKSMFPNDEALLKMLYLATMELTRKWTMRVANWGTILGQLAIYFGDRVTPYIP

SEQ ID NO: 2323 - protein, 315 aa, Artificial
  Alicyclobacillus acidocaldarius mutated SEQ ID NO 2313
MRVVQTCPYNPRHIKGTVKLELYARGFSTRDIQDHLQQIYGVDMSPTLVSNLTDRLLPRIQEWQNRPLHPLYTVVFLDAIHYKVREEGRLVSKAAYMVIGIDIEGQKDVLGIWIGQSESSKFWLGVLNDLKARGVQDVLVFSTDNLKGFSEAIAACFPQSDVQKCIVHQIRNSLRYVSYKDFKAVAAALKPIYQAPTEEAALMELDQFERGWGARYPLCVKSWRDNWTELATFYRYPVEMRRIMYTTNIIEGYHRQLRKATKGKSMFPNDEALLKMLYLATMELTRKWTMRVANWGTILGQLAIYFGDRVTPYLP

SEQ ID NO: 2324 - protein, 315 aa, Artificial
  Alicyclobacillus acidocaldarius mutated SEQ ID NO 2313
MRVVQTCPYNPRHIKGTVKLELYARGFSTRDIQDHLQQIYGVDMSPTLVSNLTDRLLPRINEWQNRPLHPLYTVVFLDAIHYKVREEGRLVSKAAYMVIGIDIEGQKDVLGIWIGQSESSKFWLGVLNDLKARGVQDVLVFSTDNLKGFSEAIAACFPQSDVQKCIVHQIRNSLRYVSYKDFKAVAAALKPIYQAPTEEAALMELDQFERGWGARYPLCVKSWRDNWTELATFYRYPVEMRRIMYTTNIIEGYHRQLRKATKGKSMFPNDEALLKMLYLATMELTRKWTMRVANWGTILGQLAIYFGDRVTPYIP

SEQ ID NO: 2325 - DNA, 948 bp, Artificial
  Alicyclobacillus acidocaldarius mutated SEQ ID NO 2314
gtgcgtgtggtacaaacttgcccctacaatccgcgtcatatcaagggtactgtcaaacttgagctgtatgctcgcggtttcagcacaagggatatccaggaccacctccagcagatctacggcgtggatatgtcgcccacgctggtgtcgaacctcaccgatcgcctcttgccgcggattcaggagtggcagaatcgtccattgcaccccctctataccgtcgtcttcctcgacgccattcactacaaggtgcgcgaagaaggccgcttggtaagcaaggcggcgtacatggtcattggcatcgacatcgagggtcagaaagatgtgctgggcatctggatagggcagagtgagtcctcgaagttctggctcggcgtgttgaatgacctgaaggcgcgcggcgtgcaggatgtgctcgtcttttcgactgacaacctgaagggattcagcgaagccatcgccgcctgtttcccgcaatccgatgtccaaaaatgcatcgtccaccaaattcgaaattcgctgcggtatgtgtcctataaggatttcaaggcggtcgcggcagcactcaagcccatctatcaggcacccacggaagaggcggccttgatggagcttgaccagtttgaacggggatggggagcgcgctatcccctgtgtgtgaagtcgtggcgagacaactggacggaactcgcgacgttctatcggtaccctgtggaaatgcggcgaatcatgtatacaacgaacatcatcgaaggctaccaccggcagctgcgaaaagcgacgaaagggaagagcatgtttccaaacgacgaagctttgctgaagatgctgtacctggcgacgatggagttgacgagaaaatggacgatgcgggtggccaactggggcaccattctggggcaattggccatctacttcggagatcgcattacgccctacattccgtga

SEQ ID NO: 2326 - DNA, 948 bp, Artificial
  Alicyclobacillus acidocaldarius mutated SEQ ID NO 2314
gtgcgtgtggtacaaacttgcccctacaatccgcgtcatatcaagggtactgtcaaacttgagctgtatgctcgcggtttcagcacaagggatatccaggaccacctccagcagatctacggcgtggatatgtcgcccacgctggtgtcgaacctcaccgatcgcctcttgccgcggattcaggagtggcagaatcgtccattgcaccccctctataccgtcgtcttcctcgacgccattcactacaaggtgcgcgaagaaggccgcttggtaagcaaggcggcgtacatggtcattggcatcgacatcgagggtcagaaagatgtgctgggcatctggatagggcagagtgagtcctcgaagttctggctcggcgtgttgaatgacctgaaggcgcgcggcgtgcaggatgtgctcgtcttttcgactgacaacctgaagggattcagcgaagccatcgccgcctgtttcccgcaatccgatgtccaaaaatgcatcgtccaccaaattcgaaattcgctgcggtatgtgtcctataaggatttcaaggcggtcgcggcagcactcaagcccatctatcaggcacccacggaagaggcggccttgatggagcttgaccagtttgaacggggatggggagcgcgctatcccctgtgtgtgaagtcgtggcgagacaactggacggaactcgcgacgttctatcggtaccctgtggaaatgcggcgaatcatgtatacaacgaacatcatcgaaggctaccaccggcagctgcgaaaagcgacgaaagggaagagcatgtttccaaacgacgaagctttgctgaagatgctgtacctggcgacgatggagttgacgagaaaatggacgatgcgggtggccaactggggcaccattattgggcaattggccatctacttcggagatcgcgtgacgccctacattccgtga

SEQ ID NO: 2327 - DNA, 948 bp, Artificial
  Alicyclobacillus acidocaldarius mutated SEQ ID NO 2314
gtgcgtgtggtacaaacttgcccctacaatccgcgtcatatcaagggtactgtcaaacttgagctgtatgctcgcggtttcagcacaagggatatccaggaccacctccagcagatctacggcgtggatatgtcgcccacgctggtgtcgaacctcaccgatcgcctcttgccgcggattcaggagtggcagaatcgtccattgcaccccctctataccgtcgtcttcctcgacgccattcactacaaggtgcgcgaagaaggcaaattggtaagcaaggcggcgtacatggtcattggcatcgacatcgagggtcagaaagatgtgctgggcatctggatagggcagagtgagtcctcgaagttctggctcggcgtgttgaatgacctgaaggcgcgcggcgtgcaggatgtgctcgtcttttcgactgacaacctgaagggattcagcgaagccatcgccgcctgtttcccgcaatccgatgtccaaaaatgcatcgtccaccaaattcgaaattcgctgcggtatgtgtcctataaggatttcaaggcggtcgcggcagcactcaagcccatctatcaggcacccacggaagaggcggccttgatggagcttgaccagtttgaacggggatggggagcgcgctatcccctgtgtgtgaagtcgtggcgagacaactggacggaactcgcgacgttctatcggtaccctgtggaaatgcggcgaatcatgtatacaacgaacatcatcgaaggctaccaccggcagctgcgaaaagcgacgaaagggaagagcatgtttccaaacgacgaagctttgctgaagatgctgtacctggcgacgatggagttgacgagaaaatggacgatgcgggtggccaactggggcaccattctggggcaattggccatctacttcggagatcgcgtgacgccctacattccgtga

SEQ ID NO: 2328 - DNA, 948 bp, Artificial
  Alicyclobacillus acidocaldarius mutated SEQ ID NO 2314
gtgcgtgtggtacaaacttgcccctacaatccgcgtcatatcaagggtactgtcaaacttgagctgtatgctcgcggtttcagcacaagggatatccaggaccacctccagcagatctacggcgtggatatgtcgcccacgctggtgtcgaacctcaccgatcgcctcttgccgcggattcaggagtggcagaatcgtccattgcaccccctctataccgtcgtcttcctcgacgccattcactacaaggtgcgcgaagaaggccgcttggtaagcaaggcggcgtacatggtcattggcatcgacatcgagggtcagaaagatgtgctgggcatctggatagggcagagtgagtcctcgaagttctggctcggcgtgttgaatgacctgaaggcgcgcggcgtgcaggatgtgctcgtcttttcgactgacaacctgaagggattcagcgaagccatcgccgcctgtttcccgcaatccgatgtccaaaaatgcatcgtccaccaaattcgaaattcgctgcggtatgtgtcctataaggatttcaaggcggtcgcggcagcactcaagcccatctatcaggcacccacggaagaggcggccttgatggagcttgaccagtttgaacggggatggggagcgcgctatcccctgtgtgtgaagtcgtggcgagacaactggacggaactcgcgacgttctatcggtaccctgtggaaatgcggcgaatcatgtatacaacgaacatcatcgaaggctaccaccggcagctgcgaaaagcgacgaaagggaagagcatgtttccaaacgacgaagctttgctgaagatgctgtacctggcgacgatggagttgacgagaaaatggacgatgcgggtggccaactggggcaccattctggggcaattggccatctacttcggagatcgcgtgacgccctacttaccgtga

SEQ ID NO: 2329 - DNA, 948 bp, Artificial
  Alicyclobacillus acidocaldarius mutated SEQ ID NO 2314
gtgcgtgtggtacaaacttgcccctacaatccgcgtcatatcaagggtactgtcaaacttgagctgtatgctcgcggtttcagcacaagggatatccaggaccacctccagcagatctacggcgtggatatgtcgcccacgctggtgtcgaacctcaccgatcgcctcttgccgcggattaatgagtggcagaatcgtccattgcaccccctctataccgtcgtcttcctcgacgccattcactacaaggtgcgcgaagaaggccgcttggtaagcaaggcggcgtacatggtcattggcatcgacatcgagggtcagaaagatgtgctgggcatctggatagggcagagtgagtcctcgaagttctggctcggcgtgttgaatgacctgaaggcgcgcggcgtgcaggatgtgctcgtcttttcgactgacaacctgaagggattcagcgaagccatcgccgcctgtttcccgcaatccgatgtccaaaaatgcatcgtccaccaaattcgaaattcgctgcggtatgtgtcctataaggatttcaaggcggtcgcggcagcactcaagcccatctatcaggcacccacggaagaggcggccttgatggagcttgaccagtttgaacggggatggggagcgcgctatcccctgtgtgtgaagtcgtggcgagacaactggacggaactcgcgacgttctatcggtaccctgtggaaatgcggcgaatcatgtatacaacgaacatcatcgaaggctaccaccggcagctgcgaaaagcgacgaaagggaagagcatgtttccaaacgacgaagctttgctgaagatgctgtacctggcgacgatggagttgacgagaaaatggacgatgcgggtggccaactggggcaccattctggggcaattggccatctacttcggagatcgcgtgacgccctacattccgtga

SEQ ID NO: 2330 - protein, 72 aa, Alicyclobacillus acidocaldarius
MNKLGGAGRNLPAAPRYALNSTCVASQLPIEAWYDTFADPTVADAVLDRLAKCSQALVEKAITKELIEGRRN

SEQ ID NO: 2331 - DNA, 219 bp, Alicyclobacillus acidocaldarius
atgaacaaactgggaggagcaggtcggaatcttcccgccgctccccgttacgccctcaattcgacatgtgttgcaagtcagctgccgattgaggcgtggtacgacacatttgccgatcccacggtcgcggatgctgtcctcgatcggctcgccaaatgctcacaagctcttgttgaaaaggccattacgaaagagcttatagaagggcgacgaaactag

SEQ ID NO: 2332 - protein, 35 aa, Loktanella vestfoldensis
RYERKSTVITSQLPIEKWYDIIADPTLADAILDRL

SEQ ID NO: 2333 - protein, 35 aa, Geobacter lovleyi
RYDRKATIVTSQLPIKAWYDAMQDPTLADAILDRL

SEQ ID NO: 2334 - protein, 45 aa, Geobacter uraniumreducens
RHGITSTIIASQIPTEKWHDAIGDPTIADAVLDRLVHNAHMITMK

SEQ ID NO: 2335 - protein, 35 aa, Roseobacter denitrificans
RYEVGSTLITSQLPIDAWHDVIGEPTFADAILDRL

SEQ ID NO: 2336 - protein, 52 aa, Pseudomonas aeruginosa
SLLITSQYPQEKWYELFADPTIADAILDRIIHKSHTLQLKGESMRKVRARRS

SEQ ID NO: 2337 - protein, 72 aa, Artificial
  Alicyclobacillus acidocaldarius mutated SEQ ID NO 2330
MNKLGGAGRNLPAAPRYALNSTCVASQLPIEAWYDTFADPTVADAVLDRLAKCSQAIVEKAITKELIEGRRN

SEQ ID NO: 2338 - protein, 72 aa, Artificial
  Alicyclobacillus acidocaldarius mutated SEQ ID NO 2330
MNKLGGAGRNLPAAPRYALQSTCVASQLPIEAWYDTFADPTVADAVLDRLAKCSQALVEKAITKELIEGRRN

SEQ ID NO: 2339 - protein, 72 aa, Artificial
  Alicyclobacillus acidocaldarius mutated SEQ ID NO 2330
MNKLGGAGRNLPAAPKYALNSTCVASQLPIEAWYDTFADPTVADAVLDRLAKCSQALVEKAITKELIEGRRN

SEQ ID NO: 2340 - protein, 72 aa, Artificial
  Alicyclobacillus acidocaldarius mutated SEQ ID NO 2330
MNKLGGAGRNLPAAPRYALNSTCVASQLPIEAWYDTFADPTVADAVLDRLAKCSQALVEKAITKELIDGRRN

SEQ ID NO: 2341 - protein, 72 aa, Artificial
  Alicyclobacillus acidocaldarius mutated SEQ ID NO 2330
MNKLGGAGRNLPAAPRYALNSTCVASQLPIEAWYDTFADPTVADAVLDRLAKCSQALVERAITKELIEGRRN

SEQ ID NO: 2342 - DNA, 219 bp, Artificial
  Alicyclobacillus acidocaldarius mutated SEQ ID NO 2331
atgaacaaactgggaggagcaggtcggaatcttcccgccgctccccgttacgccctcaattcgacatgtgttgcaagtcagctgccgattgaggcgtggtacgacacatttgccgatcccacggtcgcggatgctgtcctcgatcggctcgccaaatgctcacaagctattgttgaaaaggccattacgaaagagcttatagaagggcgacgaaactag

SEQ ID NO: 2343 - DNA, 219 bp, Artificial
  Alicyclobacillus acidocaldarius mutated SEQ ID NO 2331
atgaacaaactgggaggagcaggtcggaatcttcccgccgctccccgttacgccctccaatcgacatgtgttgcaagtcagctgccgattgaggcgtggtacgacacatttgccgatcccacggtcgcggatgctgtcctcgatcggctcgccaaatgctcacaagctcttgttgaaaaggccattacgaaagagcttatagaagggcgacgaaactag

SEQ ID NO: 2344 - DNA, 219 bp, Artificial
  Alicyclobacillus acidocaldarius mutated SEQ ID NO 2331
atgaacaaactgggaggagcaggtcggaatcttcccgccgctcccaaatacgccctcaattcgacatgtgttgcaagtcagctgccgattgaggcgtggtacgacacatttgccgatcccacggtcgcggatgctgtcctcgatcggctcgccaaatgctcacaagctcttgttgaaaaggccattacgaaagagcttatagaagggcgacgaaactag

SEQ ID NO: 2345 - DNA, 219 bp, Artificial
  Alicyclobacillus acidocaldarius mutated SEQ ID NO 2331
atgaacaaactgggaggagcaggtcggaatcttcccgccgctccccgttacgccctcaattcgacatgtgttgcaagtcagctgccgattgaggcgtggtacgacacatttgccgatcccacggtcgcggatgctgtcctcgatcggctcgccaaatgctcacaagctcttgttgaaaaggccattacgaaagagcttatagatgggcgacgaaactag

SEQ ID NO: 2346 - DNA, 219 bp, Artificial
  Alicyclobacillus acidocaldarius mutated SEQ ID NO 2331
atgaacaaactgggaggagcaggtcggaatcttcccgccgctccccgttacgccctcaattcgacatgtgttgcaagtcagctgccgattgaggcgtggtacgacacatttgccgatcccacggtcgcggatgctgtcctcgatcggctcgccaaatgctcacaagctcttgttgaacgtgccattacgaaagagcttatagaagggcgacgaaactag

SEQ ID NO: 2347 - protein, 199 aa, Alicyclobacillus acidocaldarius
MYGYPEPVARAIEHFMKLPGVGPKTAARLAFHVLEMSEADVKAFAKALIDLKTGLTECAVCCNITEASPCAICRDPRRDRRVICVVQEPRDVIAMERTREYHGLYHVLHGAISPMEGVGPQDIRIRELVTRVGENEIEEVILATNPNVEGEATAMYISRLLKPFQVKLTRIAHGLPVGGDLEYADEVTLAKALEGRRAL

SEQ ID NO: 2348 - DNA, 600 bp, Alicyclobacillus acidocaldarius
atgtacgggtacccggagccggtggcgcgggccatcgaacatttcatgaagttgcccggcgttgggccgaagactgccgcgcgcctggcatttcacgtgctggagatgagcgaggccgacgttaaagccttcgccaaggcgctgatcgatctcaagacggggctcacagagtgcgccgtctgctgcaacatcacggaagcgtctccgtgcgccatctgccgagacccacgccgagaccggcgcgtcatctgcgtcgtgcaggagccgcgggacgtgatcgcgatggagcgcacgcgcgagtatcatgggctgtaccacgtgctgcacggcgccatctcgccgatggagggcgtgggcccgcaggacattcggattcgggaactggtgacgcgagtgggcgagaacgagattgaggaagtcatcctcgccaccaacccgaacgtcgaaggcgaggcgacggcgatgtacatctcgcgcctgttgaagccgttccaggtcaagctgacgcgcatcgcgcatggcttgccggtgggcggcgatctcgagtacgcggacgaggtcacgctcgcgaaggccctcgagggcaggcgggcgctgtag

SEQ ID NO: 2349 - protein, 196 aa, Geobacillus kaustophilus
YPEPLSKLIDSFMKLPGIGPKTAARLAFHVLAMKEDTVLEFAKALVDVKRHIHYCTICGHITDTDPCYICKDERRDRTTICVVQDPKDVIAMERMKEYNGLYHVLHGAISPMEGIGPEDIKIAELLTRLQDETVQEVILATDPNIEGEATAMYISRLLKPTGIKVTRIAHGLPVGGDLEYADEVTLSKALEGRREL

SEQ ID NO: 2350 - protein, 196 aa, Geobacillus thermodenitrificans
YPEPISKLIDSFMKLPGIGPKTAARLAFHVLAMKEDTVLEFAKALVDVKRHIHYCTICGHITDTDPCYICKDERRDRTMICVVQDPKDVIAMEKMKEYNGLYHVLHGAISPMEGIGPEDIKIAELLARLQDETIQEVILATDPNIEGEATAMYLSRLLKPTGIKITRIAHGLPVGGDLEYADEVTLSKALEGRREL

SEQ ID NO: 2351 - protein, 196 aa, Paenibacillus  JDR-2
YPEPIAKLIDAFTRLPGVGPKTAARLAFHVLRMKEDDVIDFAKALVSVKRNLTYCSVCCNITDTDPCRICQDKTRDNSVICVVQESKDLVAMERTKEFQGFYHVLQGAISPIEGIGPDQIKIAELLRRLSDERVQELILATNPNIEGEATAMYISRLVKPFGIRVTRIAHGLPVGGDLEYADEVTLSKALEGRREL

SEQ ID NO: 2352 - protein, 196 aa, Bacillus halodurans
YPEPIAKLIEGFMRLPGIGPKTASRLAFFVLEMKEDDVLDFAKALVNVKRKLTYCSVCHNITDTDPCRICEDSKRDESVICVVQDAKDVIAMEKMKEYHGKYHVLHGAISPMDGIGPEDIKIPELIKRLQDDTIQEVIVATNPTIEGEATAMYISRLVKPTGIKVTRIAHGLPVGGDLEYADEVTLSKAMEGRREL

SEQ ID NO: 2353 - protein, 194 aa, Listeria monocytogenes
YPEPITKLIDSFMKLPGIGPKSAARLAFYVLDMKEDDVLDFAKALVDAKRNLSFCSVCGHITDKDPCYICADTSRDRSVICVVQESKDVIAMEKMRDFHGLYHVLHGTISPMDGIGPEDINIPDLLKRLQDDTIEEVILATNPNVEGEATAMYISRLLKPSGIKVTRIAHGLPVGGDLEYADEVTLSKAMEGRR

SEQ ID NO: 2354 - protein, 199 aa, Artificial
  Alicyclobacillus acidocaldarius mutated SEQ ID NO 2347
MYGYPEPVARAIEHFMKLPGVGPKTAARLAFHVLEMSEADVKAFAKALIDIKTGLTECAVCCNITEASPCAICRDPRRDRRVICVVQEPRDVIAMERTREYHGLYHVLHGAISPMEGVGPQDIRIRELVTRVGENEIEEVILATNPNVEGEATAMYISRLLKPFQVKLTRIAHGLPVGGDLEYADEVTLAKALEGRRAL

SEQ ID NO: 2355 - protein, 199 aa, Artificial
  Alicyclobacillus acidocaldarius mutated SEQ ID NO 2347
MYGYPEPVARAIEHFMKLPGVGPKTAARLAFHVLEMSEADVKAFAKALIDLKTGLTECAVCCNITEASPCAICRDPRRDRRVICVVQEPRDVIAMERTREYHGLYHVLHGAISPMEGVGPQDIRIKELVTRVGENEIEEVILATNPNVEGEATAMYISRLLKPFQVKLTRIAHGLPVGGDLEYADEVTLAKALEGRRAL

SEQ ID NO: 2356 - protein, 199 aa, Artificial
  Alicyclobacillus acidocaldarius mutated SEQ ID NO 2347
MYGYPEPVARAIEHFMKLPGVGPKTAARLAFHVLEMSEADVKAFAKALIDLKTGLTDCAVCCNITEASPCAICRDPRRDRRVICVVQEPRDVIAMERTREYHGLYHVLHGAISPMEGVGPQDIRIRELVTRVGENEIEEVILATNPNVEGEATAMYISRLLKPFQVKLTRIAHGLPVGGDLEYADEVTLAKALEGRRAL

SEQ ID NO: 2357 - protein, 199 aa, Artificial
  Alicyclobacillus acidocaldarius mutated SEQ ID NO 2347
MYGYPEPVARAIEHFMKLPGVGPKTAARLAFHVLEMSEAEVKAFAKALIDLKTGLTECAVCCNITEASPCAICRDPRRDRRVICVVQEPRDVIAMERTREYHGLYHVLHGAISPMEGVGPQDIRIRELVTRVGENEIEEVILATNPNVEGEATAMYISRLLKPFQVKLTRIAHGLPVGGDLEYADEVTLAKALEGRRAL

SEQ ID NO: 2358 - protein, 199 aa, Artificial
  Alicyclobacillus acidocaldarius mutated SEQ ID NO 2347
MYGYPEPVARAIEHFMKLPGVGPKTAARLAFHVLEMSEADVKAFAKALIDLKTGLTECAVCCNITEASPCAICRDPRRDRRVICVVQEPRDVIAMERTREYHGLYHVLHGAISPMEGVGPQDIRIRELVTRVGENEIEEVILATNPNVEGEATAMYISRLLKPFQVKLTRIAHGLPVGGDLEYADEVTLAKALEGRRAI

SEQ ID NO: 2359 - DNA, 600 bp, Artificial
  Alicyclobacillus acidocaldarius mutated SEQ ID NO 2348
atgtacgggtacccggagccggtggcgcgggccatcgaacatttcatgaagttgcccggcgttgggccgaagactgccgcgcgcctggcatttcacgtgctggagatgagcgaggccgacgttaaagccttcgccaaggcgctgatcgatattaagacggggctcacagagtgcgccgtctgctgcaacatcacggaagcgtctccgtgcgccatctgccgagacccacgccgagaccggcgcgtcatctgcgtcgtgcaggagccgcgggacgtgatcgcgatggagcgcacgcgcgagtatcatgggctgtaccacgtgctgcacggcgccatctcgccgatggagggcgtgggcccgcaggacattcggattcgggaactggtgacgcgagtgggcgagaacgagattgaggaagtcatcctcgccaccaacccgaacgtcgaaggcgaggcgacggcgatgtacatctcgcgcctgttgaagccgttccaggtcaagctgacgcgcatcgcgcatggcttgccggtgggcggcgatctcgagtacgcggacgaggtcacgctcgcgaaggccctcgagggcaggcgggcgctgtag

SEQ ID NO: 2360 - DNA, 600 bp, Artificial
  Alicyclobacillus acidocaldarius mutated SEQ ID NO 2348
atgtacgggtacccggagccggtggcgcgggccatcgaacatttcatgaagttgcccggcgttgggccgaagactgccgcgcgcctggcatttcacgtgctggagatgagcgaggccgacgttaaagccttcgccaaggcgctgatcgatctcaagacggggctcacagagtgcgccgtctgctgcaacatcacggaagcgtctccgtgcgccatctgccgagacccacgccgagaccggcgcgtcatctgcgtcgtgcaggagccgcgggacgtgatcgcgatggagcgcacgcgcgagtatcatgggctgtaccacgtgctgcacggcgccatctcgccgatggagggcgtgggcccgcaggacattcggattaaagaactggtgacgcgagtgggcgagaacgagattgaggaagtcatcctcgccaccaacccgaacgtcgaaggcgaggcgacggcgatgtacatctcgcgcctgttgaagccgttccaggtcaagctgacgcgcatcgcgcatggcttgccggtgggcggcgatctcgagtacgcggacgaggtcacgctcgcgaaggccctcgagggcaggcgggcgctgtag

SEQ ID NO: 2361 - DNA, 600 bp, Artificial
  Alicyclobacillus acidocaldarius mutated SEQ ID NO 2348
atgtacgggtacccggagccggtggcgcgggccatcgaacatttcatgaagttgcccggcgttgggccgaagactgccgcgcgcctggcatttcacgtgctggagatgagcgaggccgacgttaaagccttcgccaaggcgctgatcgatctcaagacggggctcacagattgcgccgtctgctgcaacatcacggaagcgtctccgtgcgccatctgccgagacccacgccgagaccggcgcgtcatctgcgtcgtgcaggagccgcgggacgtgatcgcgatggagcgcacgcgcgagtatcatgggctgtaccacgtgctgcacggcgccatctcgccgatggagggcgtgggcccgcaggacattcggattcgggaactggtgacgcgagtgggcgagaacgagattgaggaagtcatcctcgccaccaacccgaacgtcgaaggcgaggcgacggcgatgtacatctcgcgcctgttgaagccgttccaggtcaagctgacgcgcatcgcgcatggcttgccggtgggcggcgatctcgagtacgcggacgaggtcacgctcgcgaaggccctcgagggcaggcgggcgctgtag

SEQ ID NO: 2362 - DNA, 600 bp, Artificial
  Alicyclobacillus acidocaldarius mutated SEQ ID NO 2348
atgtacgggtacccggagccggtggcgcgggccatcgaacatttcatgaagttgcccggcgttgggccgaagactgccgcgcgcctggcatttcacgtgctggagatgagcgaggccgaagttaaagccttcgccaaggcgctgatcgatctcaagacggggctcacagagtgcgccgtctgctgcaacatcacggaagcgtctccgtgcgccatctgccgagacccacgccgagaccggcgcgtcatctgcgtcgtgcaggagccgcgggacgtgatcgcgatggagcgcacgcgcgagtatcatgggctgtaccacgtgctgcacggcgccatctcgccgatggagggcgtgggcccgcaggacattcggattcgggaactggtgacgcgagtgggcgagaacgagattgaggaagtcatcctcgccaccaacccgaacgtcgaaggcgaggcgacggcgatgtacatctcgcgcctgttgaagccgttccaggtcaagctgacgcgcatcgcgcatggcttgccggtgggcggcgatctcgagtacgcggacgaggtcacgctcgcgaaggccctcgagggcaggcgggcgctgtag

SEQ ID NO: 2363 - DNA, 600 bp, Artificial
  Alicyclobacillus acidocaldarius mutated SEQ ID NO 2348
atgtacgggtacccggagccggtggcgcgggccatcgaacatttcatgaagttgcccggcgttgggccgaagactgccgcgcgcctggcatttcacgtgctggagatgagcgaggccgacgttaaagccttcgccaaggcgctgatcgatctcaagacggggctcacagagtgcgccgtctgctgcaacatcacggaagcgtctccgtgcgccatctgccgagacccacgccgagaccggcgcgtcatctgcgtcgtgcaggagccgcgggacgtgatcgcgatggagcgcacgcgcgagtatcatgggctgtaccacgtgctgcacggcgccatctcgccgatggagggcgtgggcccgcaggacattcggattcgggaactggtgacgcgagtgggcgagaacgagattgaggaagtcatcctcgccaccaacccgaacgtcgaaggcgaggcgacggcgatgtacatctcgcgcctgttgaagccgttccaggtcaagctgacgcgcatcgcgcatggcttgccggtgggcggcgatctcgagtacgcggacgaggtcacgctcgcgaaggccctcgagggcaggcgggcgatttag

SEQ ID NO: 2364 - protein, 446 aa, Alicyclobacillus acidocaldarius
MKMSCMSKEYLVMRQEEARRLTVISKLIDGHLSVAQAAEYLQLSIRQVLRIKKRVLEEGEAGVIHKNRGRQPSHTLPQSLKHKIVALYQSDDYRGCNDTHFTELLAVRENIYVSTSTVRRILRAAGISAARKHRAPRSHRSRRRMPQAGLLWQMDASTFDWLEDRGPRLTLHAAIDDATGRIVGAAFARTECLEGYWSVLHHGITAYGIPVALYVDRHTIFRSPKADKLTIDEELAGVKPSTQLGRAVAELGISLTFARSPQAKGRIERLWETLQDRLTHELRLHRISTLEAANAFLPAFVERFNARFAVEPESPEPAYRPLAPHHNLHRILCYRAWRKVSPGQTISWKGQTYRIVPEQHRETLAPRSTVEVRVTTNGELWIVAGQGRLYRLEPCSKSPAVKRREDATPTPSRQPYKPPADHPWRRMTLGRPKPKLPTPSAEAISP

SEQ ID NO: 2365 - DNA, 1341 bp, Alicyclobacillus acidocaldarius
gtgaaaatgtcatgtatgagcaaggagtatcttgtaatgcggcaggaagaagctcggcgtctcacggtcatttcgaaattgattgacggccatctctcggtcgctcaggctgctgaatatttacagctttcgattcgtcaagttcttcgtatcaaaaaacgcgtcctcgaggagggggaagcaggggtcattcataaaaaccgaggacgccaaccttcccatacgttaccccaatccctgaagcacaagattgtcgcgctgtatcagtcggacgactatcgcggctgtaacgatacgcacttcacagagcttttggcagtacgtgaaaacatctacgtcagcacgtccaccgttcggcgtatcctccgtgcagccggtatttcagccgcccgcaaacatcgtgcaccacgatcccatcgctcgcgtcgtagaatgccccaagcgggcctgctatggcaaatggatgccagtaccttcgactggttagaagaccgcggaccgcgtctgaccttgcatgctgcgatcgacgacgccacggggcgaatcgtcggtgctgcatttgcccgcacggagtgtcttgagggctattggtccgttcttcaccacggcatcacggcgtatggcatccccgtcgccctgtacgtggatcgccatacgatcttccgctcgcccaaggctgacaaactcacgatcgacgaagaactggctggcgtcaaaccttccactcaacttggcagggcagtggccgaactcgggatttccttgacctttgcacgctccccgcaggcgaaagggcgaattgaacgtctttgggagacccttcaggaccgcctaacccatgaactacgcctgcaccgtatctcaacccttgaagcggcaaatgccttccttcccgcgtttgttgagcggttcaacgcacgttttgctgtggagcctgagtcaccagaaccggcataccgaccactggctccccaccacaacctccaccgtattctttgctaccgggcttggcgtaaggtttcacccggtcaaacgatttcgtggaaaggacaaacgtaccgcattgttcccgaacagcaccgggagactctggcccctcgttccaccgtggaggttcgggtgactactaatggagaattgtggattgtggcggggcaaggtcggttgtatcgtctcgagccttgttcgaagtctccggctgtgaaaaggcgggaagatgccacacccacaccttcccgccaaccctacaagccccctgcagaccatccatggcgtcgaatgactctcggccgcccaaaaccgaagcttccaaccccgtctgcagaggcaatttcaccgtaa

SEQ ID NO: 2366 - protein, 418 aa, Paenibacillus  A11-2
MSKEQITLTKNELKRVMVIEKWIDGHLTEQDVARNLGISVRQAYRLKAKYRHGGAQAIAHGNRGRKPAHTLTDSLKQRVMLLYQERYFGSNATHFAELLAEHENIHLSVSSVRRILLEGGLRPARLRRRPKAHRPRPRKPQAGMLWQIDASPYAWLEDRGPMLTLHGIIDDATGEVVAATFRPTETLEGYVTVMIEGLRRKGVPLALYSDQHSIFHPPKGKPTLEQELAGEPPSLSTFGQALADLGITHIEALSPQAKGRIERLWQTFQDRLVIELRLRNVCTMEEANRVLPELIAKHNRQFAVAPQEAEPAYRPLPETPLEHIFTRREYRRISGGQTFFWKGKCYMPKPVPGVPRWEAKSVVEVRVGMDGQVWLWDQGRAWPCVETQATQTPAPTTAKKEAAPASPRKPAANHPWRK

SEQ ID NO: 2367 - protein, 422 aa, Thermosinus carboxydivorans
MSLMEKEKIFLSDKEVRRAIVIDKVIQGVCTIAEAAEVLSLSERQVKRLKAGVIKEGFGFLAHGNRGRKPAHAISDELREQVLAIIRQPVFCEANDSHLTELLAEHYNIFLSVSSIRRIRRSAGISSPRKHRRPKFHRRRKRREQEGMLIQMDGSPHAWLGEDKPYISLIGAIDDATGKIVGAIFRPTEDLNGYFEVLRQIITKYGIPIAVYTDRHSIFVSPNADKLTIEDQLEGKKANLTQLGRALSELGIEHIKARSAQAKGRVERLWETLQDRLRIEMALAGIQTIEQANEFLQKFILKHNAMFEVEPANPNSAYRPAPSEESLREILCVKEKRKLKGGVLSFQGQLYKLDGLPAYFPDTTVLVHVHPDGKLRASYPKQNVVYDLTRVSEPVRTKSQPKEKAGPPPTPRRPAPDHPWRK

SEQ ID NO: 2368 - protein, 420 aa, Pelotomaculum thermopropionicum
LSMTQDERNKLYVARCLLDGKMTISEAAETLGLSERQVKRIKKGVKEHGESFVIHKNRGRKPPHALTDEVRKLVVNLKKSEKYSKANFSHFQELLEEFESISLSKPSVYRILVANGLTSPKKHSKVKRHKRRKRKPQRGMLVIIDASPHAWFFNNEECSLHGAVDDATGEILALFFMRNECLEGHYQVMKTVISNNGVPLAVYADRHTIFRSPKSDKLSLEEELNGKKVKATQFGRAMAELGINLIWAKSAQAKGRIERLWETLQSRLPVELNIAGITTMEEANAFLATFINKYNEKFAVEPKDPQPAFRKLEDNINLDYILCTKETRQIDRGSAFSYGGVYYRVICNGKTMPIAPKAKITVLKSPQFGLKVQYGSSIYDIEILEQLPPKDIAPGQPRQPRKPVKPAENHPWRTKTTTFP

SEQ ID NO: 2369 - protein, 419 aa, Desulfovibrio desulfuricans
VLMKAEEARRAFVIKQAVAGAFTVREAGEVLGLSYRQVIRLKNRYRKEGAVGLVHKGRGKASNRRIAQEIRKFVAEKAKSDFEGASCQHMEELFASRYGLELSAKSIGRILKEQGVACAHRHRSPKGRRCRERSRRRGDLVQMDASPFDWLGDGVMRSLHGAIDDATGEVVGLWIEKNECLSGYLRVLRQMLERHGVPRAIYADRHTIFVSPKTGKLTIEEELQGKVAPQTQFGRVLETLGVRFIAARSPQAKGRIERLWRTLQSRLVIAFRLAGIRTVEAANDFLGTYAEQMHNPKFAGAPAEAQNAFLPVVEGTNLDLLLARHEQRKACGDSTVAFGGQKYRLQDSRGRTRLLRRGKAVTVVEKLDDELMALADGEAFVLVPVVTGKSSEEPASEEKSLARGAQEREQTSPAAESSW

SEQ ID NO: 2370 - protein, 417 aa, Desulfovibrio desulfuricans
MKAEEARRAFVIKQAVAGAFTVREAGEVLGLSYRQVIRLKNRYRKEGAVGLVHKGRGKASNRRIAQEIRKFVAEKAKSDFEGASCQHMEELFASRYGLELSAKSIGRILKEQGVACAHRHRSPKGRRCRERSRRRGDLVQMDASPFDWLGDGVMRSLHGAIDDATGEVVGLWIEKNECLSGYLRVLRQMLERHGVPRAIYADRHTIFVSPKTGKLTIEEELQGKVAPQTQFGRVLETLGVRFIAARSPQAKGRIERLWRTLQSRLVIAFRLAGIRTVEAANDFLGTYAEQMHNPKFAGAPAEAQNAFLPVVEGTNLDLLLARHEQRKACGDSTVAFGGQKYRLQDSRGRTRLLRRGKAVTVVEKLDDELMALADGEAFVLVPVVTGKSSEEPASEEKSLARGAQEREQTSPAAESSW

SEQ ID NO: 2371 - protein, 446 aa, Artificial
  Alicyclobacillus acidocaldarius mutated SEQ ID NO 2364
MKMSCMSKEYLVMRQEEARRLTVISKLIDGHLSVAQAAEYLQLSIRQVLRIKKRVLEEGEAGVIHKNRGRQPSHTLPQSLKHKIVALYQSDDYRGCNDTHFTELLAVRENIYVSTSTVRRILRAAGISAARKHRAPRSHRSRKRMPQAGLLWQMDASTFDWLEDRGPRLTLHAAIDDATGRIVGAAFARTECLEGYWSVLHHGITAYGIPVALYVDRHTIFRSPKADKLTIDEELAGVKPSTQLGRAVAELGISLTFARSPQAKGRIERLWETLQDRLTHELRLHRISTLEAANAFLPAFVERFNARFAVEPESPEPAYRPLAPHHNLHRILCYRAWRKVSPGQTISWKGQTYRIVPEQHRETLAPRSTVEVRVTTNGELWIVAGQGRLYRLEPCSKSPAVKRREDATPTPSRQPYKPPADHPWRRMTLGRPKPKLPTPSAEAISP

SEQ ID NO: 2372 - protein, 446 aa, Artificial
  Alicyclobacillus acidocaldarius mutated SEQ ID NO 2364
MKMSCMSKEYLVMRQEEARRLTVISKLIDGHLSVAQAAEYLQLSIRQVLRIKKRVLEEGEAGVIHKNRGRQPSHTLPQSLKHKIVALYQSDDYKGCNDTHFTELLAVRENIYVSTSTVRRILRAAGISAARKHRAPRSHRSRRRMPQAGLLWQMDASTFDWLEDRGPRLTLHAAIDDATGRIVGAAFARTECLEGYWSVLHHGITAYGIPVALYVDRHTIFRSPKADKLTIDEELAGVKPSTQLGRAVAELGISLTFARSPQAKGRIERLWETLQDRLTHELRLHRISTLEAANAFLPAFVERFNARFAVEPESPEPAYRPLAPHHNLHRILCYRAWRKVSPGQTISWKGQTYRIVPEQHRETLAPRSTVEVRVTTNGELWIVAGQGRLYRLEPCSKSPAVKRREDATPTPSRQPYKPPADHPWRRMTLGRPKPKLPTPSAEAISP

SEQ ID NO: 2373 - protein, 446 aa, Artificial
  Alicyclobacillus acidocaldarius mutated SEQ ID NO 2364
MKMSCMSKEYLVMRQEEARRLTVISKLIDGHLSVAQAAEYLQLSIRQVLRIKKRVLEEGEAGVIHKNRGRQPSHTLPQSLKHKIVALYQSDDYRGCNDTHFTELLAVRENIYVSTSTVRRILRAAGISAARKHRAPRSHRSRRRMPQAGLLWQMDASTFDWLEDRGPRLTLHAAIDDATGRIVGAAFARTECLEGYWSVLHHGITAYGIPVALYVDRHTIFRSPKADKLTIDEELAGVKPSTQLGRAVAELGISLTFARSPQAKGRIERLWETLQDRLTHELRLHRISTLEAANAFLPAFVERFNARFAVEPESPEPAYRPLAPHHNLHRILCYRAWRKVSPGQTISWKGQTYRIVPEQHRETLAPRSTVEVRVTTNGELWIVAGQGRLYRLEPCSKSPAVKKREDATPTPSRQPYKPPADHPWRRMTLGRPKPKLPTPSAEAISP

SEQ ID NO: 2374 - protein, 446 aa, Artificial
  Alicyclobacillus acidocaldarius mutated SEQ ID NO 2364
MKMSCMSKEYLVMRQEEARRLTVISKLIDGHLSVAQAAEYLQLSIRQVLRIKKRVLEEGEAGVIHKNRGRQPSHTLPQSLKHKIVALYQSDDYRGCNDTHFTELLAVKENIYVSTSTVRRILRAAGISAARKHRAPRSHRSRRRMPQAGLLWQMDASTFDWLEDRGPRLTLHAAIDDATGRIVGAAFARTECLEGYWSVLHHGITAYGIPVALYVDRHTIFRSPKADKLTIDEELAGVKPSTQLGRAVAELGISLTFARSPQAKGRIERLWETLQDRLTHELRLHRISTLEAANAFLPAFVERFNARFAVEPESPEPAYRPLAPHHNLHRILCYRAWRKVSPGQTISWKGQTYRIVPEQHRETLAPRSTVEVRVTTNGELWIVAGQGRLYRLEPCSKSPAVKRREDATPTPSRQPYKPPADHPWRRMTLGRPKPKLPTPSAEAISP

SEQ ID NO: 2375 - protein, 446 aa, Artificial
  Alicyclobacillus acidocaldarius mutated SEQ ID NO 2364
MKMSCMSKEYLVMRQEEARRLTVISKLIDGHLSVAQAAEYLQLSIRQVLRIKKRVLEEGEAGVIHKNRGRQPSHTLPQSLKHKIVALYQSDDYRGCNDTHFTELLAVRENIYVSTSTVRRILRAAGISAARKHRAPRSHRSRRRMPQAGLLWQMDASTFDWLEDRGPRLTLHAAIDDATGRIVGAAFARTECLEGYWSVLHHGITAYGIPVALYVDRHTIFRSPKADKLTIDEELAGVKPSTQLGRAVAELGISLTFARSPQAKGRIERLWETLQDRLTHELRLHRISTLEAANAFLPAFVERFNARFAVEPESPEPAYRPLAPHHNLHKILCYRAWRKVSPGQTISWKGQTYRIVPEQHRETLAPRSTVEVRVTTNGELWIVAGQGRLYRLEPCSKSPAVKRREDATPTPSRQPYKPPADHPWRRMTLGRPKPKLPTPSAEAISP

SEQ ID NO: 2376 - DNA, 1341 bp, Artificial
  Alicyclobacillus acidocaldarius mutated SEQ ID NO 2365
gtgaaaatgtcatgtatgagcaaggagtatcttgtaatgcggcaggaagaagctcggcgtctcacggtcatttcgaaattgattgacggccatctctcggtcgctcaggctgctgaatatttacagctttcgattcgtcaagttcttcgtatcaaaaaacgcgtcctcgaggagggggaagcaggggtcattcataaaaaccgaggacgccaaccttcccatacgttaccccaatccctgaagcacaagattgtcgcgctgtatcagtcggacgactatcgcggctgtaacgatacgcacttcacagagcttttggcagtacgtgaaaacatctacgtcagcacgtccaccgttcggcgtatcctccgtgcagccggtatttcagccgcccgcaaacatcgtgcaccacgatcccatcgctcgcgtaaaagaatgccccaagcgggcctgctatggcaaatggatgccagtaccttcgactggttagaagaccgcggaccgcgtctgaccttgcatgctgcgatcgacgacgccacggggcgaatcgtcggtgctgcatttgcccgcacggagtgtcttgagggctattggtccgttcttcaccacggcatcacggcgtatggcatccccgtcgccctgtacgtggatcgccatacgatcttccgctcgcccaaggctgacaaactcacgatcgacgaagaactggctggcgtcaaaccttccactcaacttggcagggcagtggccgaactcgggatttccttgacctttgcacgctccccgcaggcgaaagggcgaattgaacgtctttgggagacccttcaggaccgcctaacccatgaactacgcctgcaccgtatctcaacccttgaagcggcaaatgccttccttcccgcgtttgttgagcggttcaacgcacgttttgctgtggagcctgagtcaccagaaccggcataccgaccactggctccccaccacaacctccaccgtattctttgctaccgggcttggcgtaaggtttcacccggtcaaacgatttcgtggaaaggacaaacgtaccgcattgttcccgaacagcaccgggagactctggcccctcgttccaccgtggaggttcgggtgactactaatggagaattgtggattgtggcggggcaaggtcggttgtatcgtctcgagccttgttcgaagtctccggctgtgaaaaggcgggaagatgccacacccacaccttcccgccaaccctacaagccccctgcagaccatccatggcgtcgaatgactctcggccgcccaaaaccgaagcttccaaccccgtctgcagaggcaatttcaccgtaa

SEQ ID NO: 2377 - DNA, 1341 bp, Artificial
  Alicyclobacillus acidocaldarius mutated SEQ ID NO 2365
gtgaaaatgtcatgtatgagcaaggagtatcttgtaatgcggcaggaagaagctcggcgtctcacggtcatttcgaaattgattgacggccatctctcggtcgctcaggctgctgaatatttacagctttcgattcgtcaagttcttcgtatcaaaaaacgcgtcctcgaggagggggaagcaggggtcattcataaaaaccgaggacgccaaccttcccatacgttaccccaatccctgaagcacaagattgtcgcgctgtatcagtcggacgactataaaggctgtaacgatacgcacttcacagagcttttggcagtacgtgaaaacatctacgtcagcacgtccaccgttcggcgtatcctccgtgcagccggtatttcagccgcccgcaaacatcgtgcaccacgatcccatcgctcgcgtcgtagaatgccccaagcgggcctgctatggcaaatggatgccagtaccttcgactggttagaagaccgcggaccgcgtctgaccttgcatgctgcgatcgacgacgccacggggcgaatcgtcggtgctgcatttgcccgcacggagtgtcttgagggctattggtccgttcttcaccacggcatcacggcgtatggcatccccgtcgccctgtacgtggatcgccatacgatcttccgctcgcccaaggctgacaaactcacgatcgacgaagaactggctggcgtcaaaccttccactcaacttggcagggcagtggccgaactcgggatttccttgacctttgcacgctccccgcaggcgaaagggcgaattgaacgtctttgggagacccttcaggaccgcctaacccatgaactacgcctgcaccgtatctcaacccttgaagcggcaaatgccttccttcccgcgtttgttgagcggttcaacgcacgttttgctgtggagcctgagtcaccagaaccggcataccgaccactggctccccaccacaacctccaccgtattctttgctaccgggcttggcgtaaggtttcacccggtcaaacgatttcgtggaaaggacaaacgtaccgcattgttcccgaacagcaccgggagactctggcccctcgttccaccgtggaggttcgggtgactactaatggagaattgtggattgtggcggggcaaggtcggttgtatcgtctcgagccttgttcgaagtctccggctgtgaaaaggcgggaagatgccacacccacaccttcccgccaaccctacaagccccctgcagaccatccatggcgtcgaatgactctcggccgcccaaaaccgaagcttccaaccccgtctgcagaggcaatttcaccgtaa

SEQ ID NO: 2378 - DNA, 1341 bp, Artificial
  Alicyclobacillus acidocaldarius mutated SEQ ID NO 2365
gtgaaaatgtcatgtatgagcaaggagtatcttgtaatgcggcaggaagaagctcggcgtctcacggtcatttcgaaattgattgacggccatctctcggtcgctcaggctgctgaatatttacagctttcgattcgtcaagttcttcgtatcaaaaaacgcgtcctcgaggagggggaagcaggggtcattcataaaaaccgaggacgccaaccttcccatacgttaccccaatccctgaagcacaagattgtcgcgctgtatcagtcggacgactatcgcggctgtaacgatacgcacttcacagagcttttggcagtacgtgaaaacatctacgtcagcacgtccaccgttcggcgtatcctccgtgcagccggtatttcagccgcccgcaaacatcgtgcaccacgatcccatcgctcgcgtcgtagaatgccccaagcgggcctgctatggcaaatggatgccagtaccttcgactggttagaagaccgcggaccgcgtctgaccttgcatgctgcgatcgacgacgccacggggcgaatcgtcggtgctgcatttgcccgcacggagtgtcttgagggctattggtccgttcttcaccacggcatcacggcgtatggcatccccgtcgccctgtacgtggatcgccatacgatcttccgctcgcccaaggctgacaaactcacgatcgacgaagaactggctggcgtcaaaccttccactcaacttggcagggcagtggccgaactcgggatttccttgacctttgcacgctccccgcaggcgaaagggcgaattgaacgtctttgggagacccttcaggaccgcctaacccatgaactacgcctgcaccgtatctcaacccttgaagcggcaaatgccttccttcccgcgtttgttgagcggttcaacgcacgttttgctgtggagcctgagtcaccagaaccggcataccgaccactggctccccaccacaacctccaccgtattctttgctaccgggcttggcgtaaggtttcacccggtcaaacgatttcgtggaaaggacaaacgtaccgcattgttcccgaacagcaccgggagactctggcccctcgttccaccgtggaggttcgggtgactactaatggagaattgtggattgtggcggggcaaggtcggttgtatcgtctcgagccttgttcgaagtctccggctgtgaaaaaacgggaagatgccacacccacaccttcccgccaaccctacaagccccctgcagaccatccatggcgtcgaatgactctcggccgcccaaaaccgaagcttccaaccccgtctgcagaggcaatttcaccgtaa

SEQ ID NO: 2379 - DNA, 1341 bp, Artificial
  Alicyclobacillus acidocaldarius mutated SEQ ID NO 2365
gtgaaaatgtcatgtatgagcaaggagtatcttgtaatgcggcaggaagaagctcggcgtctcacggtcatttcgaaattgattgacggccatctctcggtcgctcaggctgctgaatatttacagctttcgattcgtcaagttcttcgtatcaaaaaacgcgtcctcgaggagggggaagcaggggtcattcataaaaaccgaggacgccaaccttcccatacgttaccccaatccctgaagcacaagattgtcgcgctgtatcagtcggacgactatcgcggctgtaacgatacgcacttcacagagcttttggcagtaaaagaaaacatctacgtcagcacgtccaccgttcggcgtatcctccgtgcagccggtatttcagccgcccgcaaacatcgtgcaccacgatcccatcgctcgcgtcgtagaatgccccaagcgggcctgctatggcaaatggatgccagtaccttcgactggttagaagaccgcggaccgcgtctgaccttgcatgctgcgatcgacgacgccacggggcgaatcgtcggtgctgcatttgcccgcacggagtgtcttgagggctattggtccgttcttcaccacggcatcacggcgtatggcatccccgtcgccctgtacgtggatcgccatacgatcttccgctcgcccaaggctgacaaactcacgatcgacgaagaactggctggcgtcaaaccttccactcaacttggcagggcagtggccgaactcgggatttccttgacctttgcacgctccccgcaggcgaaagggcgaattgaacgtctttgggagacccttcaggaccgcctaacccatgaactacgcctgcaccgtatctcaacccttgaagcggcaaatgccttccttcccgcgtttgttgagcggttcaacgcacgttttgctgtggagcctgagtcaccagaaccggcataccgaccactggctccccaccacaacctccaccgtattctttgctaccgggcttggcgtaaggtttcacccggtcaaacgatttcgtggaaaggacaaacgtaccgcattgttcccgaacagcaccgggagactctggcccctcgttccaccgtggaggttcgggtgactactaatggagaattgtggattgtggcggggcaaggtcggttgtatcgtctcgagccttgttcgaagtctccggctgtgaaaaggcgggaagatgccacacccacaccttcccgccaaccctacaagccccctgcagaccatccatggcgtcgaatgactctcggccgcccaaaaccgaagcttccaaccccgtctgcagaggcaatttcaccgtaa

SEQ ID NO: 2380 - DNA, 1341 bp, Artificial
  Alicyclobacillus acidocaldarius mutated SEQ ID NO 2365
gtgaaaatgtcatgtatgagcaaggagtatcttgtaatgcggcaggaagaagctcggcgtctcacggtcatttcgaaattgattgacggccatctctcggtcgctcaggctgctgaatatttacagctttcgattcgtcaagttcttcgtatcaaaaaacgcgtcctcgaggagggggaagcaggggtcattcataaaaaccgaggacgccaaccttcccatacgttaccccaatccctgaagcacaagattgtcgcgctgtatcagtcggacgactatcgcggctgtaacgatacgcacttcacagagcttttggcagtacgtgaaaacatctacgtcagcacgtccaccgttcggcgtatcctccgtgcagccggtatttcagccgcccgcaaacatcgtgcaccacgatcccatcgctcgcgtcgtagaatgccccaagcgggcctgctatggcaaatggatgccagtaccttcgactggttagaagaccgcggaccgcgtctgaccttgcatgctgcgatcgacgacgccacggggcgaatcgtcggtgctgcatttgcccgcacggagtgtcttgagggctattggtccgttcttcaccacggcatcacggcgtatggcatccccgtcgccctgtacgtggatcgccatacgatcttccgctcgcccaaggctgacaaactcacgatcgacgaagaactggctggcgtcaaaccttccactcaacttggcagggcagtggccgaactcgggatttccttgacctttgcacgctccccgcaggcgaaagggcgaattgaacgtctttgggagacccttcaggaccgcctaacccatgaactacgcctgcaccgtatctcaacccttgaagcggcaaatgccttccttcccgcgtttgttgagcggttcaacgcacgttttgctgtggagcctgagtcaccagaaccggcataccgaccactggctccccaccacaacctccacaaaattctttgctaccgggcttggcgtaaggtttcacccggtcaaacgatttcgtggaaaggacaaacgtaccgcattgttcccgaacagcaccgggagactctggcccctcgttccaccgtggaggttcgggtgactactaatggagaattgtggattgtggcggggcaaggtcggttgtatcgtctcgagccttgttcgaagtctccggctgtgaaaaggcgggaagatgccacacccacaccttcccgccaaccctacaagccccctgcagaccatccatggcgtcgaatgactctcggccgcccaaaaccgaagcttccaaccccgtctgcagaggcaatttcaccgtaa

SEQ ID NO: 2381 - protein, 558 aa, Alicyclobacillus acidocaldarius
MSYHVDMYIRVIRRKNKNGSVTGYVQLAHNYRDPQTGQPKAKVLYTFGREDEMDLEALRRLAQSIHRFVGDEFTSGRGQSEAIQTTLLDSRPMGGAYLLDELWRQLELDEVLRERLVDRKFKAAVERVIFAMVANRALAPSSKLAMEEWVEREVALPGMTELDVWQAYRAMDVLHDVTEELQYEVFRRVSNLLNLDVDLLFFDTTSTYFETEDEPEDGLRRKGYSKDHRPDLPQVVIGLAVTRDGIPVRCWTWPGNTADMSVVEEVKQGLIGWRLGRVITVVDRGFVSESNLRILQRAGGHYIAGEKMNSGKSAVEVALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRTWSDIRSHMQAMHQVTKSTPDGMVVQRTETTEVQREILRALRIKEPPRILKVEPRTRGL

SEQ ID NO: 2382 - DNA, 1677 bp, Alicyclobacillus acidocaldarius
gtgtcgtatcatgtggacatgtatatccgcgtcattcgccgaaaaaacaagaacggttctgttaccggttacgtgcagttggcccataactaccgcgatccacagaccggtcagccgaaggccaaggtcctgtacaccttcggtcgtgaagacgaaatggacctggaggcgctccggcgccttgcccagagtattcatcgcttcgtgggcgacgagtttacctcggggcgcggccagtcggaagccatccaaaccacgctgctggacagccgtcccatgggaggggcgtatctgctggacgagctgtggcgacagcttgaattggacgaagtcttgcgcgagcggctggtcgaccggaagttcaaggcggctgtcgagcgtgtcatcttcgccatggtcgcgaatcgcgcgttggcgccaagcagcaagctggccatggaggagtgggtcgagcgcgaagtggcccttcctggtatgaccgagttggacgtgtggcaggcgtaccgggccatggacgttctccacgatgtgacagaagagttgcaatatgaggtcttccggcgggtcagcaatctcttgaacttggacgtggacctcctgttcttcgacacgacgtccacgtacttcgaaacggaggacgagcccgaagacggactacggcgcaaaggatattcgaaagaccatcggcccgatttgccacaggtggtgatcggccttgcggtgacacgagacggcatccctgtccgctgttggacgtggcctgggaacacggcggatatgagcgtggtcgaagaagtcaaacagggcctcatcggatggcggcttggccgggtgatcacggttgtagaccgcggcttcgtatcggagagcaatctgcggatcctgcaacgcgccggcggtcactacatcgctggggagaaaatgaactccgggaaatcagcggtggaagtggccttggcgcgccctggacgttttcgtgagcttcgtccgaacctgaaggtgaaggaggttgtggtgggagacggtgaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacctgatccgcacctccgacgacacgctgtcgacggaagatgtcgcgctgggatacaagcaactcctgatggtggagtcagcgtttcgtaccctgaagacgacgttggacatccgtcccatgtatcaccggaaggacgagcggatccgttcgcatgtgctgctttgctggctggccttgttgttggtgcgcatcgcggaggtccaaacggggcgcacatggtctgacatccgctctcacatgcaagcgatgcatcaggtgacgaagagcacgccggacgggatggtcgtgcagcgcaccgaaacgaccgaggtgcagcgggagatcctgcgagccttgaggatcaaggaaccaccgaggatcctgaaggtagaacctcggacaagagggctgtag

SEQ ID NO: 2383 - protein, 554 aa, Geobacillus kaustophilus
MYIRRVTRKNKDGTTVAYLQLAHNEWDPKAKYAKAKVIYSFGREDEVDRAVLERLAKSISRFLSPEQAWEVEKLTGEASDDFQFQSCKHLGGVWLLDQLWRQLGLGEILHSLFTSRHHQISLERLIFAMVANRALHPSSKLAMEEWVEKDVYIPHLPQVASHQLYRAMDELLAVQPELERQVFHAVADLLNLEVDLIYFDTTSSYFEVDPSETPEGESLRKQGFSKDKRPDLVQIVIGLAVTREGIPIRAWVWPGNTMDMTVIKQVKQDLIGWKLGRVISVMDRGFSSEENLRILQQAGGHYIVGENMRSGKAAVEEALSRRGRYHEVDENLHIKEIIVGDGEARQRYVLVYNPGEAERQRKERETLLESLKEELEGLRQLPNEAHHKATCRLRSHPSYGKYLRQLKDGTLRIDKQAVRDAEKYDGNYLIRTSDDTLSAEDVAIGYKQLVDIEQAFRTLKSTLELRPMYHRLEDRIRAHVLLSWLALLLVRIVEIRTHESWPKVRDECERLMLGHFSSKNGDLYQRTELTAKQAQLFAALGLEPPPKILGIHPR

SEQ ID NO: 2384 - protein, 538 aa, Geobacillus kaustophilus
YLQLAHNEWDPKAKYAKAKVIYSFGREDEVDRAVLERLAKSISRFLSPEQAWEIETLTGEVSDDFQFQSSKRLGGAWLLDQLWRQLGLGEILHSLFASRHHQIPLERLIFAMVANRALHPSSKLAMEEWVEKDVHIPHLPQVASHQLYRAMDELLAVQPELERQVFHAVADLLNLEVDLIYFDTTSSYFEVDPSETPEGESLRKQGFSKDKRPDLVQIVIGLAVTREGVPIRAWVWPGNTMDMTVIKQVKQDLIGWKLGRVISVMDRGFSSEENLRILQQAGGHYIVGEKMRSGKAAVEEALNRRGRYQQVRENLHIKEIIVGDGEARQRYVLVYNPSEAERQRKEREKLLESLKEELEGLRQLPNEAHHKATCRLRSHPSYGKYLRQLKDGTLRIDKQAVREAEKYDGKYLIRTSDDTLSAEDVALGYKQLVDIEQAFRTLKSTLELRPMYHRLEDRIRAHVLLSWLALLLVRIVEIRTHESWPKVRDECERLMLGHFSSKNGDLYQRTELTAKQALFLAALGLEPPPKILGIHPRT

SEQ ID NO: 2385 - protein, 538 aa, Geobacillus thermodenitrificans
YLQLAHNEWDPKAKYAKAKVIYSFGREDEVDRAVLERLAKSISRFLSPEQAWEIETLTGEVSDDFQFQSSKRLGGAWLLDQLWRQLGLGEILHSLFASRHHQIPLERLIFAMVANRALHPSSKLAMEEWVEKDVHIPHLPQGASHQLYRAMDELLAVQPELERQVFHAVADLLNLEVDLIYFDTTSSYFEVDPSETPEGESLRKQGFSKDKRPDLVQIVIGLAVTREGVPIRAWVWPGNTMDMTVIKQVKQDLIGWKLGRVISVMDRGFSSEENLRILQQAGGHYIVGEKMRSGKAAVEEALNRRGRYQQVRENLHIKEIIVGDGEARQRYVLVYNPSEAERQRKEREKLLESLKEELEGLRQLPNEAHHKATCRLRSHPSYGKYLRQLKDGTLRIDKQAVREAEKYDGKYLIRTSDDTLSAEDVALGYKQLVDIEQAFRTLKSTLELRPMYHRLEDRIRAHVLLSWLALLLVRIVEIRTHESWPKVRDECERLMLGHFSSKNGDLYQRTELTAKQALFLAALGLEPPPKILGIHPRT

SEQ ID NO: 2386 - protein, 548 aa, Desulfatibacillum alkenivorans
MYIRTISRKNKDGSKVEYVQLAHNYRDPKSKQARAEVLYSFGRKDQLDMEAIRRLAKSVERFLAKTGDVETQCKLQFPGEDVRFVESRPMGGVFVLKKIWDRLRISECLDKALADRQYTAPIGDAVFAMVANRALAPDSKLAVEDWAAKDVHLELDQPLKVQHLYRAMDFLLENQEAIQKEVFWSTANLLNLEVDLVFFDTTSTYFERDEEDEEGLKRYGHSKDKRKDLPQVVVGLAVTKEGLPIRSWVFPGNTPDVNTVEQIQKEMNDWKLGRVVWAMDRGMTSEENRAILQRGGGNYILGEKLRGSNMSKAVLGSPGRFTTVRDNLEIKEVTAGDGACRRRYVIVRNPKQVKRDQATRERLIRRAEQEIEAIGDLTGKKHTKAACALLSHRSMGKYVRELKSGKLKINKAKITEEEKLDGKYLLSCSDDTLSPEEIALGYKQLLEVERAFRTLKSTLDLRPVYHRKDERIRSHVTLCWLALLLVRLIELETGMTWNQVRRILERLHMGEFFLNNSRILQRTELTQDQNKLLKKLKIKPPPLIKKID

SEQ ID NO: 2387 - protein, 434 aa, Geobacillus kaustophilus
LERLIFAMVANRALHPSSKLAMEEWVEKDVHIPHLPQVASHQLYRAMDELLAVQPELERQVFHAVADLLNLEVDLIYFDTTSSYFEVDPSETPEGESLRKQGFSKDKRPDLVQIVIGLAVTREGVPIRAWVWPGNTMDMTVIKQVKQDLIGWKLGRVISVMDRGFSSEENLRILQQAGGHYIVGEKMRSGKAAVEEALNRRGRYQQVRENLHIKEIIVGDGEARQRYVLVYNPSEAERQRKEREKLLESLKEELEGLRQLPNEAHHKATCRLRSHPSYGKYLRQLKDGTLRIDKQAVREAEKYDGKYLIRTSDDTLSAEDVALGYKQLVDIEQAFRTLKSTLELRPMYHRLEDRIRAHVLLSWLALLLVRIVEIRTHESWPKVRDECERLMLGHFSSKNGDLYQRTELTAKQALFLAALGLEPPPKILGIHPRT

SEQ ID NO: 2388 - protein, 558 aa, Artificial
  Alicyclobacillus acidocaldarius mutated SEQ ID NO 2381
MSYHVDMYIRVIRRKNKNGSVTGYVQLAHNYRDPQTGQPKAKVLYTFGREDEMDLEALRRLAQSIHRFVGDEFTSGRGQSEAIQTTLLDSRPMGGAYLLDEIWRQLELDEVLRERLVDRKFKAAVERVIFAMVANRALAPSSKLAMEEWVEREVALPGMTELDVWQAYRAMDVLHDVTEELQYEVFRRVSNLLNLDVDLLFFDTTSTYFETEDEPEDGLRRKGYSKDHRPDLPQVVIGLAVTRDGIPVRCWTWPGNTADMSVVEEVKQGLIGWRLGRVITVVDRGFVSESNLRILQRAGGHYIAGEKMNSGKSAVEVALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRTWSDIRSHMQAMHQVTKSTPDGMVVQRTETTEVQREILRALRIKEPPRILKVEPRTRGL

SEQ ID NO: 2389 - protein, 558 aa, Artificial
  Alicyclobacillus acidocaldarius mutated SEQ ID NO 2381
MSYHVDMYIRVIRRKNKNGSVTGYVQLAHNYRDPQTGQPKAKVLYTFGREDEMDLEALRRLAQSIHRFVGDEFTSGRGQSEAIQTTLLDSRPMGGAYLLDELWRQLELDEVLRERLVDRKFKAAVERVIFAMVANRALAPSSKLAMEEWVEREVALPGMTELDVWQAYRAMDVLHDVTEELQYEVFRRVSNLLNLDVDLLFFDTTSTYFETEDEPEDGLRRKGYSKDHRPDLPQVVIGLAVTRDGIPVRCWTWPGNTADMSVVEEVKQGLIGWRLGRVITVVDRGFVSESNLRILQRAGGHYIAGEKMNSGKSAVEVALARPGRFRELRPNLKVKEVVVGDGEARVRYVLAFNPEEAKRDEARREAMLRELRMELEKLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRTWSDIRSHMQAMHQVTKSTPDGMVVQRTETTEVQREILRALRIKEPPRILKVEPRTRGL

SEQ ID NO: 2390 - protein, 558 aa, Artificial
  Alicyclobacillus acidocaldarius mutated SEQ ID NO 2381
MSYHVDMYIRVIRRKNKNGSVTGYVQLAHNYRDPQTGQPKAKVLYTFGREDEMDLEALRRLAQSIHRFVGDEFTSGRGQSEAIQTTLLDSRPMGGAYLLDELWRQLELDEVLRERLVDRKFKAAVERVIFAMVANRALAPSSKLAMEEWVEREVALPGMTELDVWQAYRAMDVLHDVTEELQYEVFRRVSNLLNLDVDLLFFDTTSTYFETEDEPEDGLRRKGYSKDHRPDLPQVVIGLAVTRDGIPVRCWTWPGNTADMSVVEEVKQGLIGWRLGRVITVVDRGFVSESNLRILQRAGGHYIAGEKMNSGKSAVEVALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRTWSDIRSHMQAMHQVTRSTPDGMVVQRTETTEVQREILRALRIKEPPRILKVEPRTRGL

SEQ ID NO: 2391 - protein, 558 aa, Artificial
  Alicyclobacillus acidocaldarius mutated SEQ ID NO 2381
MSYHVDMYIRVIRRKNKNGSVTGYVQLAHNYRDPQTGQPKAKVLYTFGREDEMDLEALRRLAQSIHRFVGDEFTSGRGQSEAIQTTLLDSRPMGGAYLLDELWRQLELDEVLKERLVDRKFKAAVERVIFAMVANRALAPSSKLAMEEWVEREVALPGMTELDVWQAYRAMDVLHDVTEELQYEVFRRVSNLLNLDVDLLFFDTTSTYFETEDEPEDGLRRKGYSKDHRPDLPQVVIGLAVTRDGIPVRCWTWPGNTADMSVVEEVKQGLIGWRLGRVITVVDRGFVSESNLRILQRAGGHYIAGEKMNSGKSAVEVALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRTWSDIRSHMQAMHQVTKSTPDGMVVQRTETTEVQREILRALRIKEPPRILKVEPRTRGL

SEQ ID NO: 2392 - protein, 558 aa, Artificial
  Alicyclobacillus acidocaldarius mutated SEQ ID NO 2381
MSYHVDMYIRVIRRKNKNGSVTGYVQLAHNYRDPQTGQPKAKVLYTFGREDEMDLEALRRLAQSIHRFVGDEFTSGRGQSDAIQTTLLDSRPMGGAYLLDELWRQLELDEVLRERLVDRKFKAAVERVIFAMVANRALAPSSKLAMEEWVEREVALPGMTELDVWQAYRAMDVLHDVTEELQYEVFRRVSNLLNLDVDLLFFDTTSTYFETEDEPEDGLRRKGYSKDHRPDLPQVVIGLAVTRDGIPVRCWTWPGNTADMSVVEEVKQGLIGWRLGRVITVVDRGFVSESNLRILQRAGGHYIAGEKMNSGKSAVEVALARPGRFRELRPNLKVKEVVVGDGEARVRYVLAFNPEEAKRDEARREAMLRELRMELERLKELQGEAHTKAHCRLASHPTFKRYLKQDRWGNLRIDPEAVRQAAHLDGKYLIRTSDDTLSTEDVALGYKQLLMVESAFRTLKTTLDIRPMYHRKDERIRSHVLLCWLALLLVRIAEVQTGRTWSDIRSHMQAMHQVTKSTPDGMVVQRTETTEVQREILRALRIKEPPRILKVEPRTRGL

SEQ ID NO: 2393 - DNA, 1677 bp, Artificial
  Alicyclobacillus acidocaldarius mutated SEQ ID NO 2382
gtgtcgtatcatgtggacatgtatatccgcgtcattcgccgaaaaaacaagaacggttctgttaccggttacgtgcagttggcccataactaccgcgatccacagaccggtcagccgaaggccaaggtcctgtacaccttcggtcgtgaagacgaaatggacctggaggcgctccggcgccttgcccagagtattcatcgcttcgtgggcgacgagtttacctcggggcgcggccagtcggaagccatccaaaccacgctgctggacagccgtcccatgggaggggcgtatctgctggacgagatttggcgacagcttgaattggacgaagtcttgcgcgagcggctggtcgaccggaagttcaaggcggctgtcgagcgtgtcatcttcgccatggtcgcgaatcgcgcgttggcgccaagcagcaagctggccatggaggagtgggtcgagcgcgaagtggcccttcctggtatgaccgagttggacgtgtggcaggcgtaccgggccatggacgttctccacgatgtgacagaagagttgcaatatgaggtcttccggcgggtcagcaatctcttgaacttggacgtggacctcctgttcttcgacacgacgtccacgtacttcgaaacggaggacgagcccgaagacggactacggcgcaaaggatattcgaaagaccatcggcccgatttgccacaggtggtgatcggccttgcggtgacacgagacggcatccctgtccgctgttggacgtggcctgggaacacggcggatatgagcgtggtcgaagaagtcaaacagggcctcatcggatggcggcttggccgggtgatcacggttgtagaccgcggcttcgtatcggagagcaatctgcggatcctgcaacgcgccggcggtcactacatcgctggggagaaaatgaactccgggaaatcagcggtggaagtggccttggcgcgccctggacgttttcgtgagcttcgtccgaacctgaaggtgaaggaggttgtggtgggagacggtgaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacctgatccgcacctccgacgacacgctgtcgacggaagatgtcgcgctgggatacaagcaactcctgatggtggagtcagcgtttcgtaccctgaagacgacgttggacatccgtcccatgtatcaccggaaggacgagcggatccgttcgcatgtgctgctttgctggctggccttgttgttggtgcgcatcgcggaggtccaaacggggcgcacatggtctgacatccgctctcacatgcaagcgatgcatcaggtgacgaagagcacgccggacgggatggtcgtgcagcgcaccgaaacgaccgaggtgcagcgggagatcctgcgagccttgaggatcaaggaaccaccgaggatcctgaaggtagaacctcggacaagagggctgtag

SEQ ID NO: 2394 - DNA, 1677 bp, Artificial
  Alicyclobacillus acidocaldarius mutated SEQ ID NO 2382
gtgtcgtatcatgtggacatgtatatccgcgtcattcgccgaaaaaacaagaacggttctgttaccggttacgtgcagttggcccataactaccgcgatccacagaccggtcagccgaaggccaaggtcctgtacaccttcggtcgtgaagacgaaatggacctggaggcgctccggcgccttgcccagagtattcatcgcttcgtgggcgacgagtttacctcggggcgcggccagtcggaagccatccaaaccacgctgctggacagccgtcccatgggaggggcgtatctgctggacgagctgtggcgacagcttgaattggacgaagtcttgcgcgagcggctggtcgaccggaagttcaaggcggctgtcgagcgtgtcatcttcgccatggtcgcgaatcgcgcgttggcgccaagcagcaagctggccatggaggagtgggtcgagcgcgaagtggcccttcctggtatgaccgagttggacgtgtggcaggcgtaccgggccatggacgttctccacgatgtgacagaagagttgcaatatgaggtcttccggcgggtcagcaatctcttgaacttggacgtggacctcctgttcttcgacacgacgtccacgtacttcgaaacggaggacgagcccgaagacggactacggcgcaaaggatattcgaaagaccatcggcccgatttgccacaggtggtgatcggccttgcggtgacacgagacggcatccctgtccgctgttggacgtggcctgggaacacggcggatatgagcgtggtcgaagaagtcaaacagggcctcatcggatggcggcttggccgggtgatcacggttgtagaccgcggcttcgtatcggagagcaatctgcggatcctgcaacgcgccggcggtcactacatcgctggggagaaaatgaactccgggaaatcagcggtggaagtggccttggcgcgccctggacgttttcgtgagcttcgtccgaacctgaaggtgaaggaggttgtggtgggagacggtgaggcccgggtccgttacgtgttggcgttcaatcccgaggaagccaaacgcgatgaggcgcgccgagaggcgatgttgcgcgagcttcggatggagttggaaaaactcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacctgatccgcacctccgacgacacgctgtcgacggaagatgtcgcgctgggatacaagcaactcctgatggtggagtcagcgtttcgtaccctgaagacgacgttggacatccgtcccatgtatcaccggaaggacgagcggatccgttcgcatgtgctgctttgctggctggccttgttgttggtgcgcatcgcggaggtccaaacggggcgcacatggtctgacatccgctctcacatgcaagcgatgcatcaggtgacgaagagcacgccggacgggatggtcgtgcagcgcaccgaaacgaccgaggtgcagcgggagatcctgcgagccttgaggatcaaggaaccaccgaggatcctgaaggtagaacctcggacaagagggctgtag

SEQ ID NO: 2395 - DNA, 1677 bp, Artificial
  Alicyclobacillus acidocaldarius mutated SEQ ID NO 2382
gtgtcgtatcatgtggacatgtatatccgcgtcattcgccgaaaaaacaagaacggttctgttaccggttacgtgcagttggcccataactaccgcgatccacagaccggtcagccgaaggccaaggtcctgtacaccttcggtcgtgaagacgaaatggacctggaggcgctccggcgccttgcccagagtattcatcgcttcgtgggcgacgagtttacctcggggcgcggccagtcggaagccatccaaaccacgctgctggacagccgtcccatgggaggggcgtatctgctggacgagctgtggcgacagcttgaattggacgaagtcttgcgcgagcggctggtcgaccggaagttcaaggcggctgtcgagcgtgtcatcttcgccatggtcgcgaatcgcgcgttggcgccaagcagcaagctggccatggaggagtgggtcgagcgcgaagtggcccttcctggtatgaccgagttggacgtgtggcaggcgtaccgggccatggacgttctccacgatgtgacagaagagttgcaatatgaggtcttccggcgggtcagcaatctcttgaacttggacgtggacctcctgttcttcgacacgacgtccacgtacttcgaaacggaggacgagcccgaagacggactacggcgcaaaggatattcgaaagaccatcggcccgatttgccacaggtggtgatcggccttgcggtgacacgagacggcatccctgtccgctgttggacgtggcctgggaacacggcggatatgagcgtggtcgaagaagtcaaacagggcctcatcggatggcggcttggccgggtgatcacggttgtagaccgcggcttcgtatcggagagcaatctgcggatcctgcaacgcgccggcggtcactacatcgctggggagaaaatgaactccgggaaatcagcggtggaagtggccttggcgcgccctggacgttttcgtgagcttcgtccgaacctgaaggtgaaggaggttgtggtgggagacggtgaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacctgatccgcacctccgacgacacgctgtcgacggaagatgtcgcgctgggatacaagcaactcctgatggtggagtcagcgtttcgtaccctgaagacgacgttggacatccgtcccatgtatcaccggaaggacgagcggatccgttcgcatgtgctgctttgctggctggccttgttgttggtgcgcatcgcggaggtccaaacggggcgcacatggtctgacatccgctctcacatgcaagcgatgcatcaggtgacgcgtagcacgccggacgggatggtcgtgcagcgcaccgaaacgaccgaggtgcagcgggagatcctgcgagccttgaggatcaaggaaccaccgaggatcctgaaggtagaacctcggacaagagggctgtag

SEQ ID NO: 2396 - DNA, 1677 bp, Artificial
  Alicyclobacillus acidocaldarius mutated SEQ ID NO 2382
gtgtcgtatcatgtggacatgtatatccgcgtcattcgccgaaaaaacaagaacggttctgttaccggttacgtgcagttggcccataactaccgcgatccacagaccggtcagccgaaggccaaggtcctgtacaccttcggtcgtgaagacgaaatggacctggaggcgctccggcgccttgcccagagtattcatcgcttcgtgggcgacgagtttacctcggggcgcggccagtcggaagccatccaaaccacgctgctggacagccgtcccatgggaggggcgtatctgctggacgagctgtggcgacagcttgaattggacgaagtcttgaaagagcggctggtcgaccggaagttcaaggcggctgtcgagcgtgtcatcttcgccatggtcgcgaatcgcgcgttggcgccaagcagcaagctggccatggaggagtgggtcgagcgcgaagtggcccttcctggtatgaccgagttggacgtgtggcaggcgtaccgggccatggacgttctccacgatgtgacagaagagttgcaatatgaggtcttccggcgggtcagcaatctcttgaacttggacgtggacctcctgttcttcgacacgacgtccacgtacttcgaaacggaggacgagcccgaagacggactacggcgcaaaggatattcgaaagaccatcggcccgatttgccacaggtggtgatcggccttgcggtgacacgagacggcatccctgtccgctgttggacgtggcctgggaacacggcggatatgagcgtggtcgaagaagtcaaacagggcctcatcggatggcggcttggccgggtgatcacggttgtagaccgcggcttcgtatcggagagcaatctgcggatcctgcaacgcgccggcggtcactacatcgctggggagaaaatgaactccgggaaatcagcggtggaagtggccttggcgcgccctggacgttttcgtgagcttcgtccgaacctgaaggtgaaggaggttgtggtgggagacggtgaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacctgatccgcacctccgacgacacgctgtcgacggaagatgtcgcgctgggatacaagcaactcctgatggtggagtcagcgtttcgtaccctgaagacgacgttggacatccgtcccatgtatcaccggaaggacgagcggatccgttcgcatgtgctgctttgctggctggccttgttgttggtgcgcatcgcggaggtccaaacggggcgcacatggtctgacatccgctctcacatgcaagcgatgcatcaggtgacgaagagcacgccggacgggatggtcgtgcagcgcaccgaaacgaccgaggtgcagcgggagatcctgcgagccttgaggatcaaggaaccaccgaggatcctgaaggtagaacctcggacaagagggctgtag

SEQ ID NO: 2397 - DNA, 1677 bp, Artificial
  Alicyclobacillus acidocaldarius mutated SEQ ID NO 2382
gtgtcgtatcatgtggacatgtatatccgcgtcattcgccgaaaaaacaagaacggttctgttaccggttacgtgcagttggcccataactaccgcgatccacagaccggtcagccgaaggccaaggtcctgtacaccttcggtcgtgaagacgaaatggacctggaggcgctccggcgccttgcccagagtattcatcgcttcgtgggcgacgagtttacctcggggcgcggccagtcggatgccatccaaaccacgctgctggacagccgtcccatgggaggggcgtatctgctggacgagctgtggcgacagcttgaattggacgaagtcttgcgcgagcggctggtcgaccggaagttcaaggcggctgtcgagcgtgtcatcttcgccatggtcgcgaatcgcgcgttggcgccaagcagcaagctggccatggaggagtgggtcgagcgcgaagtggcccttcctggtatgaccgagttggacgtgtggcaggcgtaccgggccatggacgttctccacgatgtgacagaagagttgcaatatgaggtcttccggcgggtcagcaatctcttgaacttggacgtggacctcctgttcttcgacacgacgtccacgtacttcgaaacggaggacgagcccgaagacggactacggcgcaaaggatattcgaaagaccatcggcccgatttgccacaggtggtgatcggccttgcggtgacacgagacggcatccctgtccgctgttggacgtggcctgggaacacggcggatatgagcgtggtcgaagaagtcaaacagggcctcatcggatggcggcttggccgggtgatcacggttgtagaccgcggcttcgtatcggagagcaatctgcggatcctgcaacgcgccggcggtcactacatcgctggggagaaaatgaactccgggaaatcagcggtggaagtggccttggcgcgccctggacgttttcgtgagcttcgtccgaacctgaaggtgaaggaggttgtggtgggagacggtgaggcccgggtccgttacgtgttggcgttcaatcccgaggaagccaaacgcgatgaggcgcgccgagaggcgatgttgcgcgagcttcggatggagttggaacgcctcaaggagcttcagggcgaagcgcacacgaaagcgcactgtcggcttgcgagccatccaacgttcaagcgctatctgaaacaggaccgatgggggaacctgagaattgacccggaggccgtgcggcaagcggctcatctggacgggaagtacctgatccgcacctccgacgacacgctgtcgacggaagatgtcgcgctgggatacaagcaactcctgatggtggagtcagcgtttcgtaccctgaagacgacgttggacatccgtcccatgtatcaccggaaggacgagcggatccgttcgcatgtgctgctttgctggctggccttgttgttggtgcgcatcgcggaggtccaaacggggcgcacatggtctgacatccgctctcacatgcaagcgatgcatcaggtgacgaagagcacgccggacgggatggtcgtgcagcgcaccgaaacgaccgaggtgcagcgggagatcctgcgagccttgaggatcaaggaaccaccgaggatcctgaaggtagaacctcggacaagagggctgtag

SEQ ID NO: 2398 - protein, 407 aa, Alicyclobacillus acidocaldarius
MELLSKEQIRQLIRDGKLKDIHDVQSMLKDLFASTIQEMLEAELDTHLGYAKYDAKHKDTDNARNGHGAKRTVQSELGDIDIALPRDRKGEFEPLIVQKRQKRMPSIEEQVIALYARGFSTRDIQDHLQQIYGVDMSPTLVSNLTDRLLPRIQEWQNRPLHPLYTVVFLDAIHYKVREEGRLVSKAAYMVIGIDIEGQKDVLGIWIGQSESSKFWLGVLNDLKARGVQDVLVFSTDNLKGFSEAIAACFPQSDVQKCIVHQIRNSLRYVSYKDFKAVAAALKPIYQAPTEEAALMELDQFERGWGARYPLCVKSWRDNWTELATFYRYPVEMRRIMYTTNIIEGYHRQLRKATKGKSMFPNDEALLKMLYLATMELTRKWTMRVANWGTILGQLAIYFGDRVTPYIP

SEQ ID NO: 2399 - DNA, 1224 bp, Alicyclobacillus acidocaldarius
atggaacttctatccaaggagcaaatccgtcaactcattcgagatggcaagttgaaggatattcacgacgtccaaagcatgctcaaggatcttttcgcgagcaccatccaagagatgctcgaagccgaattggacacgcacctggggtatgccaaatacgacgcgaagcacaaagacacggataacgcccgaaatggccacggcgccaagcggacggtgcagtccgaactcggcgatatcgatatcgcgcttcctcgagaccggaaaggcgagtttgagcctttgattgtgcaaaagcgtcaaaagcgcatgccaagtatcgaagaacaggtcattgcgctgtatgctcgcggtttcagcacaagggatatccaggaccacctccagcagatctacggcgtggatatgtcgcccacgctggtgtcgaacctcaccgatcgcctcttgccgcggattcaggagtggcagaatcgtccattgcaccccctctataccgtcgtcttcctcgacgccattcactacaaggtgcgcgaagaaggccgcttggtaagcaaggcggcgtacatggtcattggcatcgacatcgagggtcagaaagatgtgctgggcatctggatagggcagagtgagtcctcgaagttctggctcggcgtgttgaatgacctgaaggcgcgcggcgtgcaggatgtgctcgtcttttcgactgacaacctgaagggattcagcgaagccatcgccgcctgtttcccgcaatccgatgtccaaaaatgcatcgtccaccaaattcgaaattcgctgcggtatgtgtcctataaggatttcaaggcggtcgcggcagcactcaagcccatctatcaggcacccacggaagaggcggccttgatggagcttgaccagtttgaacggggatggggagcgcgctatcccctgtgtgtgaagtcgtggcgagacaactggacggaactcgcgacgttctatcggtaccctgtggaaatgcggcgaatcatgtatacaacgaacatcatcgaaggctaccaccggcagctgcgaaaagcgacgaaagggaagagcatgtttccaaacgacgaagctttgctgaagatgctgtacctggcgacgatggagttgacgagaaaatggacgatgcgggtggccaactggggcaccattctggggcaattggccatctacttcggagatcgcgtgacgccctacattccgtga

SEQ ID NO: 2400 - protein, 401 aa, Natranaerobius thermophilus
MNLIDKKKVREMMKEGKLKDVNDIQDLLKEQFGELIEEMLEGELDHELGYSKYDYREKETTNSRNGKREKQLKSNYGNLEIEVPRDREGEFEPQVVKKNQRDVSSIDDQVLSMYAKGMTVRDIQTHLQELYGVDASPTLISGITDKIVPLIKEWQNRPLSRIYAHVVMDAVHYKVRQDGRIVNKAAYMAIGIDLDGMKDVLGIWIGENESSKYWLKIINELKNRGVEDILIVSIDGLKGFEDAIHAVYPQTEIQSCIIHQIRNSTRYISYKDRKEFCSDLKNVYRAPTEEVALIELDKLEEKWGDKYEISIRSWRNNWDKLSVMFKYPEEVRKLIYTNNSMESYNRQLRKVTKSKSIFPTDESLLKMLYLATMDITKKWTMRTKNWAQILGQLSIYFEGRI

SEQ ID NO: 2401 - protein, 366 aa, Paenibacillus larvae
MGLWTKQQLREFIKENNLVTAQDAQNALKELFAETIQEMLEAELDTHLGYEKHEVKAKKTPNSRNGRSHKTVVSEYGEQQIAVPRDRMGEFEPLVVKKHQSNVTGIEDQIVALYAKGVSTREIQDHLQNLYGIEVSPTLISNVTNKIVPLIKEWQNRPLQSVYAVVFLDAIHFKVKQDGAIVSKAAYMVIGIDLDGNKDVLGMWIGENESSKFWLSVLNDLKNRGVQDILITCVDNLNGFSEAITASYPKTEIQKCIIHQIRNSTRYVSYKDLKKVTADLKPIYKASTEEAAVLELDRFEEVWGSKYPLIIRSWRNNWAELATFFKYPPEIRRLIYTTNMIESYHRQLRKVTKGKSIFPSDEALLK

SEQ ID NO: 2402 - protein, 405 aa, Thermoanaerobacter pseudethanolicus
MSLLTKEQLRNFISENNIQSIPDLYTSLKNLFKDTIQEMLEAELSTELGYERYDKKDKDTQNSRNGYTQKTVKTQFGEMEIDIPRDRQGEFEPKIVPKYKRDISGIEEKVIALYARGMSTRDIHDQIKDLYGIELSAEMVSKITERIVPEIKEWQSRPLEKIYTFIFMDAIHYKVRTDGHIINRAAYVVLGVTIEGIKDVLGIWIGENESSRFWLGVLNELKNRGVEDVIVFSVDGLTGIKEAIQAAFPKSEIQRCIIHQLRNCFKYVSYKHLKEFSKDFKAVYQSANEEIARDEFEKLKNKWQNLYPYAIKSWENNWDVLSPFYKFPEEVRKIMYTTNIIEGFHRQLRKVTKSKTIFPSDEALEKMLYLVTMNVLKKWTVRYKNWDIVLNQLIIMYPGRLEKYL

SEQ ID NO: 2403 - protein, 401 aa, Clostridium beijerinckii
MSLSRDELVKLILSNSDIKTTEDIQNTLKDLFGGVLQQMLESEMESHLGYAKHDYENKNTSNSRNGKSTKTMKSNLGLFDLDVPRDREGSFEPAIVKKHQTDVSHLESAVIGMYAKGMTTRDIATQINDIYGMDASPTLISNITDKVIPMLKEWQSRPLESIYPIIFMDAIHFKVRKDNAIVSKAAYAVIGVNLEGKKDVLGIWIGASESPKYWLLVLNELKNRGINDILIACVDGLNGFKEAIKAVFPNTEIQRCIIHQIRNSSKYLSYKDLKAFNTDLKSVYKAPTEDVALAELDNLEEKWGGKYLIAIKSWRNNWDELSTFFKYPPEIRKIIYTTNAMESYNRQLRKVTKSKSIFPNDESLLKILYLATIDITKKWTQGIKGWAQILAQLSIFFEGRL

SEQ ID NO: 2404 - protein, 402 aa, Alkaliphilus metalliredigens
MSTVSKKVLREMITGGDLKTAGDLQSYLKELFKDTLQEMLEAEIESDLGYEKGDRKNKNTQNRRNGYSEKTVKSKFGEMEIEVPRDRNGEFEPVVVPKNKRDISGIEEKVISLYARGMSTRDIHDQIQDIYGIEISAEMVSKITDKVIPQVKEWQNRALEAIYPFVFMDAIHYKVREDGQIKSKAAYVVLGIAMDGMKDILGIWIGESESSKFWLGILNDLKNRGVNDVLIFSVDGLAGMKEAIQASFPKSEIQRCVIHQLRYSFKYVNYKDRKEFAKDFKEVYTAVNEKAGHEKLMELENKWGKKYPYAIKSWDANWDVLSPFFKFPSEVRKIMYTTNMIEGLHRQFRKVTKTKSIFPSDQALEKMLFLASQNIMKKWTLSHRNWDIVLNQLMIFFEDRLT

SEQ ID NO: 2405 - protein, 407 aa, Artificial
  Alicyclobacillus acidocaldarius mutated SEQ ID NO 2398
MELLSKEQIRQLIRDGKLKDIHDVQSMLKDLFASTIQEMLEAELDTHLGYAKYDAKHKDTDNARNGHGAKRTVQSELGDIDIALPRDRKGEFEPLIVQKRQKRMPSIEEQVIALYARGFSTRDIQDHLQQIYGVDMSPTLVSNLTDRLLPRIQEWQNRPLHPLYTVVFLDAIHYKVRDEGRLVSKAAYMVIGIDIEGQKDVLGIWIGQSESSKFWLGVLNDLKARGVQDVLVFSTDNLKGFSEAIAACFPQSDVQKCIVHQIRNSLRYVSYKDFKAVAAALKPIYQAPTEEAALMELDQFERGWGARYPLCVKSWRDNWTELATFYRYPVEMRRIMYTTNIIEGYHRQLRKATKGKSMFPNDEALLKMLYLATMELTRKWTMRVANWGTILGQLAIYFGDRVTPYIP

SEQ ID NO: 2406 - protein, 407 aa, Artificial
  Alicyclobacillus acidocaldarius mutated SEQ ID NO 2398
MELLSKEQIRQLIRDGKLKDIHDVQSMLKDLFASTIQEMLEAELDTHLGYAKYDAKHKDTDNARNGHGAKRTVQSELGDIDIALPRDRKGEFEPLIVQKRQKRMPSIEEQVIALYARGFSTRDIQDHLQQIYGVDMSPTLVSNLTDRLLPRIQEWQNRPLHPLYTVVFLDAIHYKVREEGRLVSKAAYMVIGIDIEGQKDVLGIWIGQSESSKFWLGVLNDLKARGVQDVLVFSTDNLRGFSEAIAACFPQSDVQKCIVHQIRNSLRYVSYKDFKAVAAALKPIYQAPTEEAALMELDQFERGWGARYPLCVKSWRDNWTELATFYRYPVEMRRIMYTTNIIEGYHRQLRKATKGKSMFPNDEALLKMLYLATMELTRKWTMRVANWGTILGQLAIYFGDRVTPYIP

SEQ ID NO: 2407 - protein, 407 aa, Artificial
  Alicyclobacillus acidocaldarius mutated SEQ ID NO 2398
MELLSKEQIRQLIRDGKLKDIHDVQSMLKDLFASTIQEMLEAELDTHLGYAKYDAKHKDTDNARNGHGAKRTVQSELGDIDIALPRDRKGEFEPIIVQKRQKRMPSIEEQVIALYARGFSTRDIQDHLQQIYGVDMSPTLVSNLTDRLLPRIQEWQNRPLHPLYTVVFLDAIHYKVREEGRLVSKAAYMVIGIDIEGQKDVLGIWIGQSESSKFWLGVLNDLKARGVQDVLVFSTDNLKGFSEAIAACFPQSDVQKCIVHQIRNSLRYVSYKDFKAVAAALKPIYQAPTEEAALMELDQFERGWGARYPLCVKSWRDNWTELATFYRYPVEMRRIMYTTNIIEGYHRQLRKATKGKSMFPNDEALLKMLYLATMELTRKWTMRVANWGTILGQLAIYFGDRVTPYIP

SEQ ID NO: 2408 - protein, 407 aa, Artificial
  Alicyclobacillus acidocaldarius mutated SEQ ID NO 2398
MELLSKEQIRQLIRDGKLKDIHDVQSMLKDLFASTIQEMLEAELDTHLGYAKYDAKHKDTDNARNGHGAKRTVQSELGDIDIALPRDRKGEFEPLIVQKRQKRMPSIEEQVIALYARGFSTRDIQDHLQQIYGVDMSPTLVSNLTDRLLPRIQEWQNRPLHPLYTVVFLDAIHYKVREEGRLVSKAAYMVIGIDIEGQKDVLGIWIGQSESSKFWLGVLNDLKARGVQDVLVFSTDNLKGFSEAIAACFPQSDVQKCIVHQIRNSLRYVSYKDFKAVAAALKPIYQAPTEEAALMELDQFERGWGAKYPLCVKSWRDNWTELATFYRYPVEMRRIMYTTNIIEGYHRQLRKATKGKSMFPNDEALLKMLYLATMELTRKWTMRVANWGTILGQLAIYFGDRVTPYIP

SEQ ID NO: 2409 - protein, 407 aa, Artificial
  Alicyclobacillus acidocaldarius mutated SEQ ID NO 2398
MELLSKEQIRQLIRDGKLKDIHDVQSMLKDLFASTIQEMLEAELDTHLGYAKYDAKHKDTDNARNGHGAKRTVQSELGDIDIALPRDRKGEFEPLIVQKRQKRMPSIEEQVIALYARGFSTRDIQDHLQQIYGVDMSPTLVSNLTDRLLPRIQEWQNRPLHPLYTVVFLDAIHYKVREEGRLVSKAAYMVIGIDIEGQKDVLGIWIGQSESSKFWLGVLNDLKARGVQDVLVFSTDNLKGFSEAIAACFPQSDVQKCIVHQIRNSLRYVSYKDFKAVAAALKPIYQAPTEEAALMELDQFERGWGARYPLCVKSWRDNWTELATFYRYPVEMRRIMYTTNIIEGYHRQLRKATKGKSMFPNDEALLKMLYLATMELTRKWTMRIANWGTILGQLAIYFGDRVTPYIP

SEQ ID NO: 2410 - DNA, 1224 bp, Artificial
  Alicyclobacillus acidocaldarius mutated SEQ ID NO 2399
atggaacttctatccaaggagcaaatccgtcaactcattcgagatggcaagttgaaggatattcacgacgtccaaagcatgctcaaggatcttttcgcgagcaccatccaagagatgctcgaagccgaattggacacgcacctggggtatgccaaatacgacgcgaagcacaaagacacggataacgcccgaaatggccacggcgccaagcggacggtgcagtccgaactcggcgatatcgatatcgcgcttcctcgagaccggaaaggcgagtttgagcctttgattgtgcaaaagcgtcaaaagcgcatgccaagtatcgaagaacaggtcattgcgctgtatgctcgcggtttcagcacaagggatatccaggaccacctccagcagatctacggcgtggatatgtcgcccacgctggtgtcgaacctcaccgatcgcctcttgccgcggattcaggagtggcagaatcgtccattgcaccccctctataccgtcgtcttcctcgacgccattcactacaaggtgcgcgatgaaggccgcttggtaagcaaggcggcgtacatggtcattggcatcgacatcgagggtcagaaagatgtgctgggcatctggatagggcagagtgagtcctcgaagttctggctcggcgtgttgaatgacctgaaggcgcgcggcgtgcaggatgtgctcgtcttttcgactgacaacctgaagggattcagcgaagccatcgccgcctgtttcccgcaatccgatgtccaaaaatgcatcgtccaccaaattcgaaattcgctgcggtatgtgtcctataaggatttcaaggcggtcgcggcagcactcaagcccatctatcaggcacccacggaagaggcggccttgatggagcttgaccagtttgaacggggatggggagcgcgctatcccctgtgtgtgaagtcgtggcgagacaactggacggaactcgcgacgttctatcggtaccctgtggaaatgcggcgaatcatgtatacaacgaacatcatcgaaggctaccaccggcagctgcgaaaagcgacgaaagggaagagcatgtttccaaacgacgaagctttgctgaagatgctgtacctggcgacgatggagttgacgagaaaatggacgatgcgggtggccaactggggcaccattctggggcaattggccatctacttcggagatcgcgtgacgccctacattccgtga

SEQ ID NO: 2411 - DNA, 1224 bp, Artificial
  Alicyclobacillus acidocaldarius mutated SEQ ID NO 2399
atggaacttctatccaaggagcaaatccgtcaactcattcgagatggcaagttgaaggatattcacgacgtccaaagcatgctcaaggatcttttcgcgagcaccatccaagagatgctcgaagccgaattggacacgcacctggggtatgccaaatacgacgcgaagcacaaagacacggataacgcccgaaatggccacggcgccaagcggacggtgcagtccgaactcggcgatatcgatatcgcgcttcctcgagaccggaaaggcgagtttgagcctttgattgtgcaaaagcgtcaaaagcgcatgccaagtatcgaagaacaggtcattgcgctgtatgctcgcggtttcagcacaagggatatccaggaccacctccagcagatctacggcgtggatatgtcgcccacgctggtgtcgaacctcaccgatcgcctcttgccgcggattcaggagtggcagaatcgtccattgcaccccctctataccgtcgtcttcctcgacgccattcactacaaggtgcgcgaagaaggccgcttggtaagcaaggcggcgtacatggtcattggcatcgacatcgagggtcagaaagatgtgctgggcatctggatagggcagagtgagtcctcgaagttctggctcggcgtgttgaatgacctgaaggcgcgcggcgtgcaggatgtgctcgtcttttcgactgacaacctgcgtggattcagcgaagccatcgccgcctgtttcccgcaatccgatgtccaaaaatgcatcgtccaccaaattcgaaattcgctgcggtatgtgtcctataaggatttcaaggcggtcgcggcagcactcaagcccatctatcaggcacccacggaagaggcggccttgatggagcttgaccagtttgaacggggatggggagcgcgctatcccctgtgtgtgaagtcgtggcgagacaactggacggaactcgcgacgttctatcggtaccctgtggaaatgcggcgaatcatgtatacaacgaacatcatcgaaggctaccaccggcagctgcgaaaagcgacgaaagggaagagcatgtttccaaacgacgaagctttgctgaagatgctgtacctggcgacgatggagttgacgagaaaatggacgatgcgggtggccaactggggcaccattctggggcaattggccatctacttcggagatcgcgtgacgccctacattccgtga

SEQ ID NO: 2412 - DNA, 1224 bp, Artificial
  Alicyclobacillus acidocaldarius mutated SEQ ID NO 2399
atggaacttctatccaaggagcaaatccgtcaactcattcgagatggcaagttgaaggatattcacgacgtccaaagcatgctcaaggatcttttcgcgagcaccatccaagagatgctcgaagccgaattggacacgcacctggggtatgccaaatacgacgcgaagcacaaagacacggataacgcccgaaatggccacggcgccaagcggacggtgcagtccgaactcggcgatatcgatatcgcgcttcctcgagaccggaaaggcgagtttgagcctattattgtgcaaaagcgtcaaaagcgcatgccaagtatcgaagaacaggtcattgcgctgtatgctcgcggtttcagcacaagggatatccaggaccacctccagcagatctacggcgtggatatgtcgcccacgctggtgtcgaacctcaccgatcgcctcttgccgcggattcaggagtggcagaatcgtccattgcaccccctctataccgtcgtcttcctcgacgccattcactacaaggtgcgcgaagaaggccgcttggtaagcaaggcggcgtacatggtcattggcatcgacatcgagggtcagaaagatgtgctgggcatctggatagggcagagtgagtcctcgaagttctggctcggcgtgttgaatgacctgaaggcgcgcggcgtgcaggatgtgctcgtcttttcgactgacaacctgaagggattcagcgaagccatcgccgcctgtttcccgcaatccgatgtccaaaaatgcatcgtccaccaaattcgaaattcgctgcggtatgtgtcctataaggatttcaaggcggtcgcggcagcactcaagcccatctatcaggcacccacggaagaggcggccttgatggagcttgaccagtttgaacggggatggggagcgcgctatcccctgtgtgtgaagtcgtggcgagacaactggacggaactcgcgacgttctatcggtaccctgtggaaatgcggcgaatcatgtatacaacgaacatcatcgaaggctaccaccggcagctgcgaaaagcgacgaaagggaagagcatgtttccaaacgacgaagctttgctgaagatgctgtacctggcgacgatggagttgacgagaaaatggacgatgcgggtggccaactggggcaccattctggggcaattggccatctacttcggagatcgcgtgacgccctacattccgtga

SEQ ID NO: 2413 - DNA, 1224 bp, Artificial
  Alicyclobacillus acidocaldarius mutated SEQ ID NO 2399
atggaacttctatccaaggagcaaatccgtcaactcattcgagatggcaagttgaaggatattcacgacgtccaaagcatgctcaaggatcttttcgcgagcaccatccaagagatgctcgaagccgaattggacacgcacctggggtatgccaaatacgacgcgaagcacaaagacacggataacgcccgaaatggccacggcgccaagcggacggtgcagtccgaactcggcgatatcgatatcgcgcttcctcgagaccggaaaggcgagtttgagcctttgattgtgcaaaagcgtcaaaagcgcatgccaagtatcgaagaacaggtcattgcgctgtatgctcgcggtttcagcacaagggatatccaggaccacctccagcagatctacggcgtggatatgtcgcccacgctggtgtcgaacctcaccgatcgcctcttgccgcggattcaggagtggcagaatcgtccattgcaccccctctataccgtcgtcttcctcgacgccattcactacaaggtgcgcgaagaaggccgcttggtaagcaaggcggcgtacatggtcattggcatcgacatcgagggtcagaaagatgtgctgggcatctggatagggcagagtgagtcctcgaagttctggctcggcgtgttgaatgacctgaaggcgcgcggcgtgcaggatgtgctcgtcttttcgactgacaacctgaagggattcagcgaagccatcgccgcctgtttcccgcaatccgatgtccaaaaatgcatcgtccaccaaattcgaaattcgctgcggtatgtgtcctataaggatttcaaggcggtcgcggcagcactcaagcccatctatcaggcacccacggaagaggcggccttgatggagcttgaccagtttgaacggggatggggagcgaaatatcccctgtgtgtgaagtcgtggcgagacaactggacggaactcgcgacgttctatcggtaccctgtggaaatgcggcgaatcatgtatacaacgaacatcatcgaaggctaccaccggcagctgcgaaaagcgacgaaagggaagagcatgtttccaaacgacgaagctttgctgaagatgctgtacctggcgacgatggagttgacgagaaaatggacgatgcgggtggccaactggggcaccattctggggcaattggccatctacttcggagatcgcgtgacgccctacattccgtga

SEQ ID NO: 2414 - DNA, 1224 bp, Artificial
  Alicyclobacillus acidocaldarius mutated SEQ ID NO 2399
atggaacttctatccaaggagcaaatccgtcaactcattcgagatggcaagttgaaggatattcacgacgtccaaagcatgctcaaggatcttttcgcgagcaccatccaagagatgctcgaagccgaattggacacgcacctggggtatgccaaatacgacgcgaagcacaaagacacggataacgcccgaaatggccacggcgccaagcggacggtgcagtccgaactcggcgatatcgatatcgcgcttcctcgagaccggaaaggcgagtttgagcctttgattgtgcaaaagcgtcaaaagcgcatgccaagtatcgaagaacaggtcattgcgctgtatgctcgcggtttcagcacaagggatatccaggaccacctccagcagatctacggcgtggatatgtcgcccacgctggtgtcgaacctcaccgatcgcctcttgccgcggattcaggagtggcagaatcgtccattgcaccccctctataccgtcgtcttcctcgacgccattcactacaaggtgcgcgaagaaggccgcttggtaagcaaggcggcgtacatggtcattggcatcgacatcgagggtcagaaagatgtgctgggcatctggatagggcagagtgagtcctcgaagttctggctcggcgtgttgaatgacctgaaggcgcgcggcgtgcaggatgtgctcgtcttttcgactgacaacctgaagggattcagcgaagccatcgccgcctgtttcccgcaatccgatgtccaaaaatgcatcgtccaccaaattcgaaattcgctgcggtatgtgtcctataaggatttcaaggcggtcgcggcagcactcaagcccatctatcaggcacccacggaagaggcggccttgatggagcttgaccagtttgaacggggatggggagcgcgctatcccctgtgtgtgaagtcgtggcgagacaactggacggaactcgcgacgttctatcggtaccctgtggaaatgcggcgaatcatgtatacaacgaacatcatcgaaggctaccaccggcagctgcgaaaagcgacgaaagggaagagcatgtttccaaacgacgaagctttgctgaagatgctgtacctggcgacgatggagttgacgagaaaatggacgatgcggattgccaactggggcaccattctggggcaattggccatctacttcggagatcgcgtgacgccctacattccgtga

SEQ ID NO: 2415 - protein, 392 aa, Alicyclobacillus acidocaldarius
MRKRRIAMHVDPNRTDRGAAASQMELWSKRRSSDPRLRLNAISPYYTMFPLAFPLRVLAGAERGWVLDPFCGRGTTNFAARLAGFPTVGVDINPIAVAIAQAKLASTTVHGVVERCQQILESEAPGDVPDGEFWSWCFHQKTLEDVCRLRQALSDVQTEEDIVLRALVLGVLHGPRNKGLPSYLSNQMPRTYATKPDAAVRYWKSRGIHPVYVDVLDVVRRRAEHVLSHVPDKVPGFVRLADSRTLAPEDFAMRFRYVITSPPYFGMKTYVSDHWLRHWFLGGPPYVDYASDPQLGRPSLLAFIEGLREVWTRVSQVCEPGALLVVRFGAIPSYEVDPIEVLRASLSGTPWKERRLCDAGSASNGRRQADQFQFVRSRATLEVDLYASLEEA

SEQ ID NO: 2416 - DNA, 1179 bp, Alicyclobacillus acidocaldarius
ttgagaaagcgaagaatcgccatgcatgtcgacccaaatcgtacagaccgcggcgccgcggcctcccagatggagctttggtcgaaacggaggtcttccgatccgcggctgcggctcaacgccatcagcccgtactacaccatgtttcccctcgcgttcccgcttcgcgttctggcgggcgcggagcgcggatgggtgctggatccgttctgcggtcgaggcacgacgaattttgcggcgaggctcgccggctttcctacggtcggcgtggatatcaatcccatcgcggtggccatcgcgcaggcgaagctggcgtcgaccacggtccacggcgtcgtggagcggtgtcaacagatcttggaaagcgaagcgccgggcgatgtcccggacggcgaattctggagctggtgttttcaccaaaagacgctcgaagatgtctgccgcctccgccaggcgctttccgacgttcagacggaggaggacatcgtgctgcgcgcgctcgtgctcggcgtgctacacggcccgcgcaacaaaggactgccgtcctatttgtccaatcagatgccgcgcacctatgccacgaagcccgacgctgcggtgcgctactggaagtcgcgcgggatccatccggtctatgtggacgtgctggacgtcgtgcgcaggcgcgccgaacacgtgttgtcgcatgtgccggacaaggtgcccggcttcgtccggctggcggacagccgaacgctcgcgccggaggattttgcgatgcgctttcggtacgtcatcacctcgccgccgtatttcggcatgaagacgtacgtctcggaccactggcttcgccactggtttctcggcggtccgccctacgtcgactacgcgtcggacccgcaactcggccgcccctcgctgctcgcgttcatcgagggcctgcgcgaggtctggacgcgggtcagccaagtctgcgaacccggcgcgctcctcgtggtgcggttcggcgccataccgagttacgaggtcgaccccatcgaggtcctgcgcgcgagtctgagcggcacgccgtggaaggagcgccgcctgtgcgatgccggcagcgcatcgaacgggcgaagacaggcggatcagtttcagttcgtccgcagccgcgccacgctggaggtcgatctgtatgcttctctcgaggaggcctag

SEQ ID NO: 2417 - protein, 360 aa, Symbiobacterium thermophilum
PHLRLNALCPYFTMFPLDFPTRYLAQARPGEWVLDPFCGRGTTNYAARLHGLPTVGIDSSPVAVAIARAKLVQVTPDELIAEAERILAGPEPADVPEGHFWDLAYHPRTLLDICRLREALLRDCEAPVRIALRGLILGILHGPRTRRAPSYLSNQMPRTYATKPDPAVRFWVRRGMRPEEVDVLDVLARRARYSFAALPPPVPGCILQADSREPGAIPVVDGGYRWVITSPPYLGMRSYQPDQWLRLWFLGGEPTVRYIHEGQVSHLQGEYQRDLATVWRNVAARCRPGTRLIIRFGCLPTLPCNPKQVLEETLARSGVPWRIVEVTGAGIPPRHRRQAVQFEKTRPAHEEIDLVAVLGE

SEQ ID NO: 2418 - protein, 359 aa, Acaryochloris marina
KTRLNGICPYFTMFPLDFPYSILEEHGSRGEWVLDPFCGRGTTIYASRLLGMPSIGIDSSPVATAISEAKLVNIKPGHIVSTAIKILKNAEEPSDIPTGEFWELAFHKNVLNSLCKFRESFLRNCRSDSRKALRAIILGALHGPRPKSKQSYFSNQSQRTYAPKPNYAVNYWKRKGLLPEEVDVIEIIREKADRYFGLEKSQGMGKIIVGDSRNNKYFQKIQSQVNWVITSPPYYGMSSYIPDQWLRSWFLGDSSQVNYSSPEQLNHLSPDHFSSALKKVWENSSDICAQNATLVIRFGSINTRNVDALEIIKKSLCQTRWKIKNIKSAGFASQGRRQAIHINSKVSNPREEYDIWANL

SEQ ID NO: 2419 - protein, 328 aa, Shewanella putrefaciens
IIDPFCGRGTSMFAARKLGLKAWGIDSSPVATAIARAKLASCSKEDILDLARDLLQNAATDMPESEFFSKLYTSQTLKDVCALREGLLSLAHETDASVMLRALVLGALHGPLNKSLDTAIYFSNQMPRTFASKPDYSVRYWDQRSLVPPAISVLDVLKRKLDRIPTLDEQFTGSFHQIIEGDSQLEITRAKVADDFSIVITSPPYYGMKTYVQDQWIRNWFLGGASTVDYTSGPQLEHGGVTTFAESLGKVWRNMADTRADSLRMFIRFGIIPSAKIDAKKIMQMSLEASGKEWKIISIRSAETAAEGKRQATQMKSKSSAAIEYDFH

SEQ ID NO: 2420 - protein, 135 aa, Nitrobacter winogradskyi
KFDWIITSPPYYGLRTYLPDQWIRNWFLGGPSVVDYTSEGQLSHNGRDRFIADLRQVWANVGARCRPGATLVIRFGSIGDRLVEDPAQLVSASLEETGWVTTEILHADNAARGRRQADTFHRKRSAPYDEVDVWA

SEQ ID NO: 2421 - protein, 273 aa, Flavobacterium  MED217
QVTPWADKSDSDPLHSLCSYLGAFPPSLAKYFIKYFTDENDLVFDPFSGRGTTILESRILNRKSIGSDLNPIALALSKAKSHKLKKKDIIDRIDELESDYDYALYLPEAQSESDEIHLIFHQATIAQLCYLKDILLTSKSDIDEFLIGAILGIMHGGERKDGTSGYLSISMPNTFSMSPEYVRRFVQTKELNRVKRNVFDILKEKVERVFSKHKSPEKESYIFECDAKEISKSEKLKKYQGKVDLILTSPPYLGIVNYAKQNWIRSWFLDSDP

SEQ ID NO: 2422 - protein, 392 aa, Artificial
  Alicyclobacillus acidocaldarius mutated SEQ ID NO 2415
MRKRRIAMHVDPNRTDRGAAASQMELWSKRRSSDPRLRLNAISPYYTMFPLAFPLRVLAGAERGWVLDPFCGRGTTNFAARLAGFPTVGVDINPIAVAIAQAKLASTTVHGVVERCQQILESDAPGDVPDGEFWSWCFHQKTLEDVCRLRQALSDVQTEEDIVLRALVLGVLHGPRNKGLPSYLSNQMPRTYATKPDAAVRYWKSRGIHPVYVDVLDVVRRRAEHVLSHVPDKVPGFVRLADSRTLAPEDFAMRFRYVITSPPYFGMKTYVSDHWLRHWFLGGPPYVDYASDPQLGRPSLLAFIEGLREVWTRVSQVCEPGALLVVRFGAIPSYEVDPIEVLRASLSGTPWKERRLCDAGSASNGRRQADQFQFVRSRATLEVDLYASLEEA

SEQ ID NO: 2423 - protein, 392 aa, Artificial
  Alicyclobacillus acidocaldarius mutated SEQ ID NO 2415
MRKRRIAMHVDPNRTDRGAAASQMELWSKRRSSDPRLRLNAISPYYTMFPLAFPLRVLAGAERGWVLDPFCGRGTTNFAARLAGFPTVGVDINPIAVAIAQAKLASTTVHGVVERCQQILESEAPGDVPDGEFWSWCFHQKTLEDVCRLRQALSDVQTEEDIVLRALVLGVLHGPRNKGLPSYLSNQMPRTYATKPDAAVRYWKSRGIHPVYVDVLDVVRRRAEHVLSHVPDKVPGFVRLADSRTLAPDDFAMRFRYVITSPPYFGMKTYVSDHWLRHWFLGGPPYVDYASDPQLGRPSLLAFIEGLREVWTRVSQVCEPGALLVVRFGAIPSYEVDPIEVLRASLSGTPWKERRLCDAGSASNGRRQADQFQFVRSRATLEVDLYASLEEA

SEQ ID NO: 2424 - protein, 392 aa, Artificial
  Alicyclobacillus acidocaldarius mutated SEQ ID NO 2415
MRKRRIAMHVDPNRTDRGAAASQMELWSKRRSSDPRLRLNAISPYYTMFPLAFPLRVLAGAERGWVLDPFCGRGTTNFAARLAGFPTVGVDINPIAVAIAQAKLASTTVHGVVERCQQILESEAPGDVPDGEFWSWCFHQKTLEDVCRLRQALSDVQTEEDIVLRALVLGVLHGPRNKGLPSYLSNQMPRTYATKPDAAVRYWKSRGIHPVYVDVLDVVRRRAEHVLSHVPDKIPGFVRLADSRTLAPEDFAMRFRYVITSPPYFGMKTYVSDHWLRHWFLGGPPYVDYASDPQLGRPSLLAFIEGLREVWTRVSQVCEPGALLVVRFGAIPSYEVDPIEVLRASLSGTPWKERRLCDAGSASNGRRQADQFQFVRSRATLEVDLYASLEEA

SEQ ID NO: 2425 - protein, 392 aa, Artificial
  Alicyclobacillus acidocaldarius mutated SEQ ID NO 2415
MRKRRIAMHVDPNRTDRGAAASQMELWSKRRSSDPRLRLNAISPYYTMFPLAFPLRVLAGAERGWVLDPFCGRGTTNFAARLAGFPTVGVDINPIAVAIAQAKLASTTVHGVVERCQQILESEAPGDVPDGEFWSWCFHQKTLEDVCRLRQALSDVQTEEDIVLRALVLGVLHGPRNKGLPSYLSNQMPRTYATKPDAAVRYWKSRGIHPVYVDVLDVVRRRAEHVLSHVPDKVPGFVRLADSRTLAPEDFAMRFRYVITSPPYFGMKTYVSDHWLRHWFLGGPPYVDYASDPQLGKPSLLAFIEGLREVWTRVSQVCEPGALLVVRFGAIPSYEVDPIEVLRASLSGTPWKERRLCDAGSASNGRRQADQFQFVRSRATLEVDLYASLEEA

SEQ ID NO: 2426 - protein, 392 aa, Artificial
  Alicyclobacillus acidocaldarius mutated SEQ ID NO 2415
MRKRRIAMHVDPNRTDRGAAASQMELWSKRRSSDPRLRLNAISPYYTMFPLAFPLRVLAGAERGWVLDPFCGRGTTNFAARLAGFPTVGVDINPIAVAIAQAKLASTTVHGVVERCQQILESEAPGDVPDGEFWSWCFHQKTLEDVCRLRQALSDVQTEEDIVLRALVLGVLHGPRNKGLPSYLSNQMPRTYATKPDAAVRYWKSRGIHPVYVDVLDVVRRRAEHVLSHVPDKVPGFVRLADSRTLAPEDFAMRFRYVITSPPYFGMKTYVSDHWLRHWFLGGPPYVDYASEPQLGRPSLLAFIEGLREVWTRVSQVCEPGALLVVRFGAIPSYEVDPIEVLRASLSGTPWKERRLCDAGSASNGRRQADQFQFVRSRATLEVDLYASLEEA

SEQ ID NO: 2427 - DNA, 1179 bp, Artificial
  Alicyclobacillus acidocaldarius mutated SEQ ID NO 2416
ttgagaaagcgaagaatcgccatgcatgtcgacccaaatcgtacagaccgcggcgccgcggcctcccagatggagctttggtcgaaacggaggtcttccgatccgcggctgcggctcaacgccatcagcccgtactacaccatgtttcccctcgcgttcccgcttcgcgttctggcgggcgcggagcgcggatgggtgctggatccgttctgcggtcgaggcacgacgaattttgcggcgaggctcgccggctttcctacggtcggcgtggatatcaatcccatcgcggtggccatcgcgcaggcgaagctggcgtcgaccacggtccacggcgtcgtggagcggtgtcaacagatcttggaaagcgatgcgccgggcgatgtcccggacggcgaattctggagctggtgttttcaccaaaagacgctcgaagatgtctgccgcctccgccaggcgctttccgacgttcagacggaggaggacatcgtgctgcgcgcgctcgtgctcggcgtgctacacggcccgcgcaacaaaggactgccgtcctatttgtccaatcagatgccgcgcacctatgccacgaagcccgacgctgcggtgcgctactggaagtcgcgcgggatccatccggtctatgtggacgtgctggacgtcgtgcgcaggcgcgccgaacacgtgttgtcgcatgtgccggacaaggtgcccggcttcgtccggctggcggacagccgaacgctcgcgccggaggattttgcgatgcgctttcggtacgtcatcacctcgccgccgtatttcggcatgaagacgtacgtctcggaccactggcttcgccactggtttctcggcggtccgccctacgtcgactacgcgtcggacccgcaactcggccgcccctcgctgctcgcgttcatcgagggcctgcgcgaggtctggacgcgggtcagccaagtctgcgaacccggcgcgctcctcgtggtgcggttcggcgccataccgagttacgaggtcgaccccatcgaggtcctgcgcgcgagtctgagcggcacgccgtggaaggagcgccgcctgtgcgatgccggcagcgcatcgaacgggcgaagacaggcggatcagtttcagttcgtccgcagccgcgccacgctggaggtcgatctgtatgcttctctcgaggaggcctag

SEQ ID NO: 2428 - DNA, 1179 bp, Artificial
  Alicyclobacillus acidocaldarius mutated SEQ ID NO 2416
ttgagaaagcgaagaatcgccatgcatgtcgacccaaatcgtacagaccgcggcgccgcggcctcccagatggagctttggtcgaaacggaggtcttccgatccgcggctgcggctcaacgccatcagcccgtactacaccatgtttcccctcgcgttcccgcttcgcgttctggcgggcgcggagcgcggatgggtgctggatccgttctgcggtcgaggcacgacgaattttgcggcgaggctcgccggctttcctacggtcggcgtggatatcaatcccatcgcggtggccatcgcgcaggcgaagctggcgtcgaccacggtccacggcgtcgtggagcggtgtcaacagatcttggaaagcgaagcgccgggcgatgtcccggacggcgaattctggagctggtgttttcaccaaaagacgctcgaagatgtctgccgcctccgccaggcgctttccgacgttcagacggaggaggacatcgtgctgcgcgcgctcgtgctcggcgtgctacacggcccgcgcaacaaaggactgccgtcctatttgtccaatcagatgccgcgcacctatgccacgaagcccgacgctgcggtgcgctactggaagtcgcgcgggatccatccggtctatgtggacgtgctggacgtcgtgcgcaggcgcgccgaacacgtgttgtcgcatgtgccggacaaggtgcccggcttcgtccggctggcggacagccgaacgctcgcgccggatgattttgcgatgcgctttcggtacgtcatcacctcgccgccgtatttcggcatgaagacgtacgtctcggaccactggcttcgccactggtttctcggcggtccgccctacgtcgactacgcgtcggacccgcaactcggccgcccctcgctgctcgcgttcatcgagggcctgcgcgaggtctggacgcgggtcagccaagtctgcgaacccggcgcgctcctcgtggtgcggttcggcgccataccgagttacgaggtcgaccccatcgaggtcctgcgcgcgagtctgagcggcacgccgtggaaggagcgccgcctgtgcgatgccggcagcgcatcgaacgggcgaagacaggcggatcagtttcagttcgtccgcagccgcgccacgctggaggtcgatctgtatgcttctctcgaggaggcctag

SEQ ID NO: 2429 - DNA, 1179 bp, Artificial
  Alicyclobacillus acidocaldarius mutated SEQ ID NO 2416
ttgagaaagcgaagaatcgccatgcatgtcgacccaaatcgtacagaccgcggcgccgcggcctcccagatggagctttggtcgaaacggaggtcttccgatccgcggctgcggctcaacgccatcagcccgtactacaccatgtttcccctcgcgttcccgcttcgcgttctggcgggcgcggagcgcggatgggtgctggatccgttctgcggtcgaggcacgacgaattttgcggcgaggctcgccggctttcctacggtcggcgtggatatcaatcccatcgcggtggccatcgcgcaggcgaagctggcgtcgaccacggtccacggcgtcgtggagcggtgtcaacagatcttggaaagcgaagcgccgggcgatgtcccggacggcgaattctggagctggtgttttcaccaaaagacgctcgaagatgtctgccgcctccgccaggcgctttccgacgttcagacggaggaggacatcgtgctgcgcgcgctcgtgctcggcgtgctacacggcccgcgcaacaaaggactgccgtcctatttgtccaatcagatgccgcgcacctatgccacgaagcccgacgctgcggtgcgctactggaagtcgcgcgggatccatccggtctatgtggacgtgctggacgtcgtgcgcaggcgcgccgaacacgtgttgtcgcatgtgccggacaagattcccggcttcgtccggctggcggacagccgaacgctcgcgccggaggattttgcgatgcgctttcggtacgtcatcacctcgccgccgtatttcggcatgaagacgtacgtctcggaccactggcttcgccactggtttctcggcggtccgccctacgtcgactacgcgtcggacccgcaactcggccgcccctcgctgctcgcgttcatcgagggcctgcgcgaggtctggacgcgggtcagccaagtctgcgaacccggcgcgctcctcgtggtgcggttcggcgccataccgagttacgaggtcgaccccatcgaggtcctgcgcgcgagtctgagcggcacgccgtggaaggagcgccgcctgtgcgatgccggcagcgcatcgaacgggcgaagacaggcggatcagtttcagttcgtccgcagccgcgccacgctggaggtcgatctgtatgcttctctcgaggaggcctag

SEQ ID NO: 2430 - DNA, 1179 bp, Artificial
  Alicyclobacillus acidocaldarius mutated SEQ ID NO 2416
ttgagaaagcgaagaatcgccatgcatgtcgacccaaatcgtacagaccgcggcgccgcggcctcccagatggagctttggtcgaaacggaggtcttccgatccgcggctgcggctcaacgccatcagcccgtactacaccatgtttcccctcgcgttcccgcttcgcgttctggcgggcgcggagcgcggatgggtgctggatccgttctgcggtcgaggcacgacgaattttgcggcgaggctcgccggctttcctacggtcggcgtggatatcaatcccatcgcggtggccatcgcgcaggcgaagctggcgtcgaccacggtccacggcgtcgtggagcggtgtcaacagatcttggaaagcgaagcgccgggcgatgtcccggacggcgaattctggagctggtgttttcaccaaaagacgctcgaagatgtctgccgcctccgccaggcgctttccgacgttcagacggaggaggacatcgtgctgcgcgcgctcgtgctcggcgtgctacacggcccgcgcaacaaaggactgccgtcctatttgtccaatcagatgccgcgcacctatgccacgaagcccgacgctgcggtgcgctactggaagtcgcgcgggatccatccggtctatgtggacgtgctggacgtcgtgcgcaggcgcgccgaacacgtgttgtcgcatgtgccggacaaggtgcccggcttcgtccggctggcggacagccgaacgctcgcgccggaggattttgcgatgcgctttcggtacgtcatcacctcgccgccgtatttcggcatgaagacgtacgtctcggaccactggcttcgccactggtttctcggcggtccgccctacgtcgactacgcgtcggacccgcaactcggcaaaccctcgctgctcgcgttcatcgagggcctgcgcgaggtctggacgcgggtcagccaagtctgcgaacccggcgcgctcctcgtggtgcggttcggcgccataccgagttacgaggtcgaccccatcgaggtcctgcgcgcgagtctgagcggcacgccgtggaaggagcgccgcctgtgcgatgccggcagcgcatcgaacgggcgaagacaggcggatcagtttcagttcgtccgcagccgcgccacgctggaggtcgatctgtatgcttctctcgaggaggcctag

SEQ ID NO: 2431 - DNA, 1179 bp, Artificial
  Alicyclobacillus acidocaldarius mutated SEQ ID NO 2416
ttgagaaagcgaagaatcgccatgcatgtcgacccaaatcgtacagaccgcggcgccgcggcctcccagatggagctttggtcgaaacggaggtcttccgatccgcggctgcggctcaacgccatcagcccgtactacaccatgtttcccctcgcgttcccgcttcgcgttctggcgggcgcggagcgcggatgggtgctggatccgttctgcggtcgaggcacgacgaattttgcggcgaggctcgccggctttcctacggtcggcgtggatatcaatcccatcgcggtggccatcgcgcaggcgaagctggcgtcgaccacggtccacggcgtcgtggagcggtgtcaacagatcttggaaagcgaagcgccgggcgatgtcccggacggcgaattctggagctggtgttttcaccaaaagacgctcgaagatgtctgccgcctccgccaggcgctttccgacgttcagacggaggaggacatcgtgctgcgcgcgctcgtgctcggcgtgctacacggcccgcgcaacaaaggactgccgtcctatttgtccaatcagatgccgcgcacctatgccacgaagcccgacgctgcggtgcgctactggaagtcgcgcgggatccatccggtctatgtggacgtgctggacgtcgtgcgcaggcgcgccgaacacgtgttgtcgcatgtgccggacaaggtgcccggcttcgtccggctggcggacagccgaacgctcgcgccggaggattttgcgatgcgctttcggtacgtcatcacctcgccgccgtatttcggcatgaagacgtacgtctcggaccactggcttcgccactggtttctcggcggtccgccctacgtcgactacgcgtcggaaccgcaactcggccgcccctcgctgctcgcgttcatcgagggcctgcgcgaggtctggacgcgggtcagccaagtctgcgaacccggcgcgctcctcgtggtgcggttcggcgccataccgagttacgaggtcgaccccatcgaggtcctgcgcgcgagtctgagcggcacgccgtggaaggagcgccgcctgtgcgatgccggcagcgcatcgaacgggcgaagacaggcggatcagtttcagttcgtccgcagccgcgccacgctggaggtcgatctgtatgcttctctcgaggaggcctag

SEQ ID NO: 2432 - protein, 207 aa, Alicyclobacillus acidocaldarius
MDNDVHLVYFISMKLSDWARKNGISYKTAWRWVKEGRMPVPFEQTPSGTILVHEPEPSTTNAVALYARVSSADQKADLDRQIARLMEFAMAQKLVVVKAVTEIGSGLNGHRPKLMKMLSDPNAHTIVVEHRDRLMRFGFEYVEAALAAQGRRILVVEPGEVKDDLVQDMVEVLTSFCARLYGRRSARHRAKRALEVLEREDSSGVSV

SEQ ID NO: 2433 - DNA, 624 bp, Alicyclobacillus acidocaldarius
atggacaatgatgtacacttggtgtattttatttctatgaaactcagtgattgggcaagaaagaatggaatctcgtacaagaccgcctggcgttgggtaaaagaaggccggatgcccgtgccttttgagcaaactccttcgggcaccatcctcgtccacgaacccgagccttccacaacgaatgccgtggccttgtatgcgcgcgtgtcaagcgccgaccaaaaagccgatttggatcgccaaatcgcacggctcatggaatttgcaatggcacagaagcttgtcgtggtcaaggcggttacggaaatcggctcgggactcaacgggcatcgaccgaagctcatgaaaatgctgtccgatccaaatgcccatacgattgtggtggaacatcgggatcggctcatgcggttcgggtttgaatacgtcgaggcggctttggcggctcaaggccgacgaattctcgtcgtggagccaggcgaggtcaaggacgacttggtgcaagacatggtcgaagtccttacgtcgttttgcgcgcggttgtacgggcggcgttccgctcgtcaccgcgccaagcgcgctttggaggttctcgagcgtgaagattcatcgggcgtatcggtatga

SEQ ID NO: 2434 - protein, 188 aa, Heliobacterium modesticaldum
MKLSEWAKKNGITYRTAWQWFKAGKLPVPAVQMPTGTILIQEGGKHEGKVALYARVSSADQKSDLDRQVSRLLTYANEQGWDVGEAVTEIGSGLNGRRPKLMKLLADPKVKVIVVEHRDRLMRFGFEYVESALVAQGRRIVVVDQSELKDDLVQDMIEVLTSFCARLYGRRSAANKAKKAMEAMQCED

SEQ ID NO: 2435 - protein, 182 aa, Frankia  EAN1pec
MNLKEWAESQGVAYVTAQRWFHAGKLPVPARKVGGLILVGEPDRPATSGTVVVYARVSSADQKSDLDRQVACVTGWATGQGLPVDRVVTEVGSALNGHRRKFLALLRDPAATTIVVEHRDRFARFGAEYVEAALAANGRRLLVVDPAEVDDDLVRDITEILTSMCARLYGRRAAANRARRAV

SEQ ID NO: 2436 - protein, 186 aa, Frankia  CcI3
YDVRVNLKEWAAANGVGYTTARRWYRDGLLPVPARKVGGLVLVDESTVPAGRPVAVVYARVSSADQKPDLDRQVARIVTWAASQNLAVGRVVTEVGSALNGHRRKFLGLLRDPAVATIVVEHRDRFARFGAEYVEAALSAQGRRLLVVDPGEVDDDLVGDVTEILTSLCARLYGRRAAANRAARAV

SEQ ID NO: 2437 - protein, 182 aa, Frankia  CcI3
MNLKEWAESQGVAYVTARRWYAAGKLPVPARRVGGLILVGEPDQPTGDGLTAVYARVSSADQRPDLDRQVARVTAWATGQNLPVDKVVTEVGSALNGHRRKFLALLRDPDVATIVVEYRDRFARFGAEYVEAALSAQGRRLLVVDPGEVDDDLVGDVTEILTSLCARLYGRRAAVNRATRAV

SEQ ID NO: 2438 - protein, 193 aa, Mycobacterium tuberculosis
MNLADWAESVGVNRHTAYRWFREGTLPVPAERVGRLILVKTAASASAAAAGVVLYARVSSHDRRSDLDRQVARLTAWATERDLGVGQVVCEVGSGLNGKRPKLRRILSDPDARVIVVEHRDRLARFGVEHLEAALSAQGRRIVVADPGETTDDLVCDMIEVLTGMCARLYGRRGARNRAMRAVTEAKREPGAG

SEQ ID NO: 2439 - protein, 207 aa, Artificial
  Alicyclobacillus acidocaldarius mutated SEQ ID NO 2432
MDNDVHLVYFISMKLSDWARKNGISYKTAWRWVKEGRMPVPFEQTPSGTILVHEPEPSTTNAVALYARVSSADQKADLDRQIARLMEFAMAQKLIVVKAVTEIGSGLNGHRPKLMKMLSDPNAHTIVVEHRDRLMRFGFEYVEAALAAQGRRILVVEPGEVKDDLVQDMVEVLTSFCARLYGRRSARHRAKRALEVLEREDSSGVSV

SEQ ID NO: 2440 - protein, 207 aa, Artificial
  Alicyclobacillus acidocaldarius mutated SEQ ID NO 2432
MDNDVHLVYFISMKLSDWARKNGISYKTAWRWVKEGRMPVPFEQTPSGTILVHEPEPSTTNAVALYARVSSADQKADLDRQIARLMEFAMAQKLVVIKAVTEIGSGLNGHRPKLMKMLSDPNAHTIVVEHRDRLMRFGFEYVEAALAAQGRRILVVEPGEVKDDLVQDMVEVLTSFCARLYGRRSARHRAKRALEVLEREDSSGVSV

SEQ ID NO: 2441 - protein, 207 aa, Artificial
  Alicyclobacillus acidocaldarius mutated SEQ ID NO 2432
MDNDVHLVYFISMKLSDWARKNGISYKTAWRWVKEGRMPVPFEQTPSGTILVHEPEPSTTNAVALYARVSSADQKADLDRQIARLMEFAMAQKLVVVKAVTEIGSGLNGHRPKLMKMLSDPNAHTIVVEHRDRLMRFGFEYVEAALAAQGRRILVVEPGEVKDDLVQDMVEVLTSFCARLYGRRSARHRAKRALEVLEREDSSGVSI

SEQ ID NO: 2442 - protein, 207 aa, Artificial
  Alicyclobacillus acidocaldarius mutated SEQ ID NO 2432
MDNDVHLVYFISMKLSDWAKKNGISYKTAWRWVKEGRMPVPFEQTPSGTILVHEPEPSTTNAVALYARVSSADQKADLDRQIARLMEFAMAQKLVVVKAVTEIGSGLNGHRPKLMKMLSDPNAHTIVVEHRDRLMRFGFEYVEAALAAQGRRILVVEPGEVKDDLVQDMVEVLTSFCARLYGRRSARHRAKRALEVLEREDSSGVSV

SEQ ID NO: 2443 - protein, 207 aa, Artificial
  Alicyclobacillus acidocaldarius mutated SEQ ID NO 2432
MDNDVHLVYFISMKLSDWARRNGISYKTAWRWVKEGRMPVPFEQTPSGTILVHEPEPSTTNAVALYARVSSADQKADLDRQIARLMEFAMAQKLVVVKAVTEIGSGLNGHRPKLMKMLSDPNAHTIVVEHRDRLMRFGFEYVEAALAAQGRRILVVEPGEVKDDLVQDMVEVLTSFCARLYGRRSARHRAKRALEVLEREDSSGVSV

SEQ ID NO: 2444 - DNA, 624 bp, Artificial
  Alicyclobacillus acidocaldarius mutated SEQ ID NO 2433
atggacaatgatgtacacttggtgtattttatttctatgaaactcagtgattgggcaagaaagaatggaatctcgtacaagaccgcctggcgttgggtaaaagaaggccggatgcccgtgccttttgagcaaactccttcgggcaccatcctcgtccacgaacccgagccttccacaacgaatgccgtggccttgtatgcgcgcgtgtcaagcgccgaccaaaaagccgatttggatcgccaaatcgcacggctcatggaatttgcaatggcacagaagcttattgtggtcaaggcggttacggaaatcggctcgggactcaacgggcatcgaccgaagctcatgaaaatgctgtccgatccaaatgcccatacgattgtggtggaacatcgggatcggctcatgcggttcgggtttgaatacgtcgaggcggctttggcggctcaaggccgacgaattctcgtcgtggagccaggcgaggtcaaggacgacttggtgcaagacatggtcgaagtccttacgtcgttttgcgcgcggttgtacgggcggcgttccgctcgtcaccgcgccaagcgcgctttggaggttctcgagcgtgaagattcatcgggcgtatcggtatga

SEQ ID NO: 2445 - DNA, 624 bp, Artificial
  Alicyclobacillus acidocaldarius mutated SEQ ID NO 2433
atggacaatgatgtacacttggtgtattttatttctatgaaactcagtgattgggcaagaaagaatggaatctcgtacaagaccgcctggcgttgggtaaaagaaggccggatgcccgtgccttttgagcaaactccttcgggcaccatcctcgtccacgaacccgagccttccacaacgaatgccgtggccttgtatgcgcgcgtgtcaagcgccgaccaaaaagccgatttggatcgccaaatcgcacggctcatggaatttgcaatggcacagaagcttgtcgtgattaaggcggttacggaaatcggctcgggactcaacgggcatcgaccgaagctcatgaaaatgctgtccgatccaaatgcccatacgattgtggtggaacatcgggatcggctcatgcggttcgggtttgaatacgtcgaggcggctttggcggctcaaggccgacgaattctcgtcgtggagccaggcgaggtcaaggacgacttggtgcaagacatggtcgaagtccttacgtcgttttgcgcgcggttgtacgggcggcgttccgctcgtcaccgcgccaagcgcgctttggaggttctcgagcgtgaagattcatcgggcgtatcggtatga

SEQ ID NO: 2446 - DNA, 624 bp, Artificial
  Alicyclobacillus acidocaldarius mutated SEQ ID NO 2433
atggacaatgatgtacacttggtgtattttatttctatgaaactcagtgattgggcaagaaagaatggaatctcgtacaagaccgcctggcgttgggtaaaagaaggccggatgcccgtgccttttgagcaaactccttcgggcaccatcctcgtccacgaacccgagccttccacaacgaatgccgtggccttgtatgcgcgcgtgtcaagcgccgaccaaaaagccgatttggatcgccaaatcgcacggctcatggaatttgcaatggcacagaagcttgtcgtggtcaaggcggttacggaaatcggctcgggactcaacgggcatcgaccgaagctcatgaaaatgctgtccgatccaaatgcccatacgattgtggtggaacatcgggatcggctcatgcggttcgggtttgaatacgtcgaggcggctttggcggctcaaggccgacgaattctcgtcgtggagccaggcgaggtcaaggacgacttggtgcaagacatggtcgaagtccttacgtcgttttgcgcgcggttgtacgggcggcgttccgctcgtcaccgcgccaagcgcgctttggaggttctcgagcgtgaagattcatcgggcgtatcgatttga

SEQ ID NO: 2447 - DNA, 624 bp, Artificial
  Alicyclobacillus acidocaldarius mutated SEQ ID NO 2433
atggacaatgatgtacacttggtgtattttatttctatgaaactcagtgattgggcaaaaaagaatggaatctcgtacaagaccgcctggcgttgggtaaaagaaggccggatgcccgtgccttttgagcaaactccttcgggcaccatcctcgtccacgaacccgagccttccacaacgaatgccgtggccttgtatgcgcgcgtgtcaagcgccgaccaaaaagccgatttggatcgccaaatcgcacggctcatggaatttgcaatggcacagaagcttgtcgtggtcaaggcggttacggaaatcggctcgggactcaacgggcatcgaccgaagctcatgaaaatgctgtccgatccaaatgcccatacgattgtggtggaacatcgggatcggctcatgcggttcgggtttgaatacgtcgaggcggctttggcggctcaaggccgacgaattctcgtcgtggagccaggcgaggtcaaggacgacttggtgcaagacatggtcgaagtccttacgtcgttttgcgcgcggttgtacgggcggcgttccgctcgtcaccgcgccaagcgcgctttggaggttctcgagcgtgaagattcatcgggcgtatcggtatga

SEQ ID NO: 2448 - DNA, 624 bp, Artificial
  Alicyclobacillus acidocaldarius mutated SEQ ID NO 2433
atggacaatgatgtacacttggtgtattttatttctatgaaactcagtgattgggcaagacgtaatggaatctcgtacaagaccgcctggcgttgggtaaaagaaggccggatgcccgtgccttttgagcaaactccttcgggcaccatcctcgtccacgaacccgagccttccacaacgaatgccgtggccttgtatgcgcgcgtgtcaagcgccgaccaaaaagccgatttggatcgccaaatcgcacggctcatggaatttgcaatggcacagaagcttgtcgtggtcaaggcggttacggaaatcggctcgggactcaacgggcatcgaccgaagctcatgaaaatgctgtccgatccaaatgcccatacgattgtggtggaacatcgggatcggctcatgcggttcgggtttgaatacgtcgaggcggctttggcggctcaaggccgacgaattctcgtcgtggagccaggcgaggtcaaggacgacttggtgcaagacatggtcgaagtccttacgtcgttttgcgcgcggttgtacgggcggcgttccgctcgtcaccgcgccaagcgcgctttggaggttctcgagcgtgaagattcatcgggcgtatcggtatga

SEQ ID NO: 2449 - protein, 283 aa, Alicyclobacillus acidocaldarius
MSRLVRPRGEAAGMKPFLKWAGGKYRLLPYIQRALPPGRRLIEPFVGSGAVFLNTSYDAYVLSDINADVIALYRVLSLHGEAFIEACRRLFVPENNCPEVYYALRDEFNASRDLVRRAALFVYLNRHGYNGLCRYNAEGRFNVPFGRYKRPYFPEREMRYFCEKARRAEFLCVDFREVMRMAEPGDVVYCDPPYVPLSKTANFRQYAAQGFGEAEQRDLARIAEELADRGIPVLISNHLTPFTERAYRRAECRQLQVRRAISCQGARRGYAPEVLALFAPRSR

SEQ ID NO: 2450 - DNA, 852 bp, Alicyclobacillus acidocaldarius
atgagccgcctggtgcggccgcgaggggaggcggcgggcatgaagccttttctgaagtgggcggggggcaaataccgccttctaccttacatccaacgtgcgctgccgcctggccggaggttgatcgagccgtttgtcggctccggagccgtgttcctgaataccagctacgacgcctacgtgttgtcggatatcaacgcggacgtgatcgccctgtaccgcgtgctgagcctgcacggagaggcgtttatcgaggcgtgcaggcgcctgtttgtgcccgagaacaactgtccggaggtgtactacgcgctcagggatgagttcaatgcctcgcgcgacctcgtgaggcgcgccgccctgtttgtctacctgaaccggcacgggtacaacgggctctgcaggtacaacgcggaagggcgtttcaacgtgccgttcggccgatacaagcgaccctattttcccgagcgggagatgcggtatttctgcgagaaggccaggcgcgccgagtttttgtgcgtcgacttccgagaggtgatgcgcatggctgagcctggcgacgtcgtgtactgcgatccaccgtatgtcccgctctcgaaaacggcaaacttccgccagtacgcggcgcagggcttcggagaagcggagcagcgcgatctcgcccgcatcgcggaggagcttgccgatcgcgggatcccggtgctcatctccaaccacctgacgcccttcacggagcgagcgtatcgccgcgcggagtgtcgacaactgcaggttcgccgagccattagctgccagggcgctcggcgaggatatgcgccggaggtgctcgcgctgttcgcgccgcgatcgcgttga

SEQ ID NO: 2451 - protein, 264 aa, Heliobacterium modesticaldum
RPFLKWAGNKYRIIHRIRAVLPAGNRLIEPFVGSAAVFLNTSFKENLLADCNGDLIRLYQTVKTGGEDFIAYCRSFFTEENNRPERYYALREIFNTTDDGDLKSALFIYLNRHSYNGLCRYNASGKFNAPAGRYKKPYFPERELRFFMAKARDAVFLCQDFTQTMGEARPGDVVYCDPPYVPLSRTSNFTGYSAGGFGEAEQWKLAELARQLADRGVSVLISNHDTDFTQKAYDAARIERFPVQRFVSCDGANRGKAGELLALF

SEQ ID NO: 2452 - protein, 264 aa, Nitrosococcus oceani
RPFLKWAGNKYRLLTRIISVLPPGKRLIEPFAGSAALFLNAEYERYWVNDINPDLIALYQILQKEGKEFIHYAGCLFTPHNNTPKAYYRLRARFNTTADVAEKAALFVYLNRHGYNGLCRYSGSGIFNVPFGRYQRPYFPSKEMMAFHIKARRARFTCLDFRKVLARIRRGTIVYADPPYTPLSQTACFTHYSGNGFGPEEQKALTQSAQRLAKRGIPVLISNHDTPSVRQAYRNAQLTGFSVTRLISCKGTQRTPANEVLALF

SEQ ID NO: 2453 - protein, 266 aa, Escherichia coli
RAFLKWAGGKYPLLDDIKRHLPKGECLVEPFVGAGSVFLNTDFSRYILADINSDLISLYNIVKMRTDEYVQAARELFVPETNCAEVYYQFREEFNKSQDPFRRAVLFLYLNRYGYNGLCRYNLRGEFNVPFGRYKKPYFPEAELYHFAEKAQNAFFYCESYADSMARADDASVVYCDPPYAPLSATANFTAYHTNSFTLEQQAHLAEIAEGLVDRHIPVLISNHDTMLTREWYQRAKLHVVKVRRSISSNGGTRKKVDELLALYKP

SEQ ID NO: 2454 - protein, 266 aa, Shigella dysenteriae
RAFLKWAGGKYPLLDDIKRHLPKGECLVEPFVGAGSVFLNTDFSRYILADINSDLISLYNIVKMRTDEYVQAARELFVPETNCAEVYYQFREEFNKSQDPFRRAVLFLYLNRYGYNGLCRYNLRGEFNVPFGRYKKPYFPEAELYHFAEKAQNAFFYCESYADSMARADDASVVYCDPPYAPLSATANFTAYHTNSFTLEQQAHLAEIAEGLVERHIPVLISNHDTMLTRKWYQRAKLHVVKVRRSISSNGGTRKKVDELLALYKP

SEQ ID NO: 2455 - protein, 266 aa, Shigella flexneri
RAFLKWAGGKYPLLDDIKRHLPKGECLVEPFVGAGSVFLNTDFSRYILADINSDLISLYNIVKMRTDEYVQAARELFVPETNCAEVYYQFREEFNKSQDPFRRAVLFLYLNRYGYNGLCRYNLRGEFNVPFGRYKKPYFPEAELYHFAEKAQNAFFYCESYADSMERADDASVVYCDPPYAPLSATANFTAYHTNSFTLEQQAHLAEIAEGLVERHIPVLISNHDTMLTREWYQRAKLHVVKVRRSISSNGGTRKKVDELLALYKP

SEQ ID NO: 2456 - protein, 283 aa, Artificial
  Alicyclobacillus acidocaldarius mutated SEQ ID NO 2449
MSRLVRPRGEAAGMKPFLKWAGGKYRLLPYIQRALPPGRRLIEPFVGSGAVFLNTSYDAYVLSDINADVIALYRVLSLHGEAFIEACRRLFVPENNCPEVYYALRDEFNASRDLVRRAALFVYLNRHGYNGLCRYNAEGRFNVPFGRYKRPYFPEREMRYFCEKARRAEFLCVDFREVMRMAEPGDVVYCDPPYVPLSKTANFRQYAAQGFGEAEQRDLARIAEELADRGIPVLISNHLTPFTERAYRRAECKQLQVRRAISCQGARRGYAPEVLALFAPRSR

SEQ ID NO: 2457 - protein, 283 aa, Artificial
  Alicyclobacillus acidocaldarius mutated SEQ ID NO 2449
MSRLVRPRGEAAGMKPFLKWAGGKYRLLPYIQRALPPGRRLIEPFVGSGAVFLNTSYDAYVLSDINADVIALYRVLSLHGEAFIEACRRLFVPENNCPEVYYALRDEFNASRDLVRRAALFVYLNRHGYNGLCRYNAEGRFNVPFGRYKRPYFPEREMRYFCEKARRAEFLCIDFREVMRMAEPGDVVYCDPPYVPLSKTANFRQYAAQGFGEAEQRDLARIAEELADRGIPVLISNHLTPFTERAYRRAECRQLQVRRAISCQGARRGYAPEVLALFAPRSR

SEQ ID NO: 2458 - protein, 283 aa, Artificial
  Alicyclobacillus acidocaldarius mutated SEQ ID NO 2449
MSRLVRPRGDAAGMKPFLKWAGGKYRLLPYIQRALPPGRRLIEPFVGSGAVFLNTSYDAYVLSDINADVIALYRVLSLHGEAFIEACRRLFVPENNCPEVYYALRDEFNASRDLVRRAALFVYLNRHGYNGLCRYNAEGRFNVPFGRYKRPYFPEREMRYFCEKARRAEFLCVDFREVMRMAEPGDVVYCDPPYVPLSKTANFRQYAAQGFGEAEQRDLARIAEELADRGIPVLISNHLTPFTERAYRRAECRQLQVRRAISCQGARRGYAPEVLALFAPRSR

SEQ ID NO: 2459 - protein, 283 aa, Artificial
  Alicyclobacillus acidocaldarius mutated SEQ ID NO 2449
MSRLVRPRGEAAGMKPFLKWAGGKYRLLPYIQRALPPGRRLIEPFVGSGAVFLNTSYDAYVLSDINADVIALYRVLSLHGEAFIEACRRLFVPENNCPEVYYALRDEFNASRDLVRRAALFVYLNRHGYNGLCRYNAEGRFNVPFGRYKRPYFPEREMKYFCEKARRAEFLCVDFREVMRMAEPGDVVYCDPPYVPLSKTANFRQYAAQGFGEAEQRDLARIAEELADRGIPVLISNHLTPFTERAYRRAECRQLQVRRAISCQGARRGYAPEVLALFAPRSR

SEQ ID NO: 2460 - protein, 283 aa, Artificial
  Alicyclobacillus acidocaldarius mutated SEQ ID NO 2449
MSRLVRPRGEAAGMKPFLKWAGGKYRLLPYIQRALPPGRRLIEPFVGSGAVFLNTSYDAYVLSDINADVIALYRVLSLHGEAFIEACRRLFVPENNCPEVYYALRDEFNASRDLVRRAALFVYLNRHGYNGLCRYNAEGRFNVPFGRYKRPYFPEREMRYFCEKARRAEFLCVDFREVMRMAEPGDVVYCDPPYVPLSKTANFRQYAAQGFGEAEQRDLARIAEELADRGIPVLISNHLTPFTERAYRRAECRQLQVRRAISCQGARRGYAPEVLALFAPKSR

SEQ ID NO: 2461 - DNA, 852 bp, Artificial
  Alicyclobacillus acidocaldarius mutated SEQ ID NO 2450
atgagccgcctggtgcggccgcgaggggaggcggcgggcatgaagccttttctgaagtgggcggggggcaaataccgccttctaccttacatccaacgtgcgctgccgcctggccggaggttgatcgagccgtttgtcggctccggagccgtgttcctgaataccagctacgacgcctacgtgttgtcggatatcaacgcggacgtgatcgccctgtaccgcgtgctgagcctgcacggagaggcgtttatcgaggcgtgcaggcgcctgtttgtgcccgagaacaactgtccggaggtgtactacgcgctcagggatgagttcaatgcctcgcgcgacctcgtgaggcgcgccgccctgtttgtctacctgaaccggcacgggtacaacgggctctgcaggtacaacgcggaagggcgtttcaacgtgccgttcggccgatacaagcgaccctattttcccgagcgggagatgcggtatttctgcgagaaggccaggcgcgccgagtttttgtgcgtcgacttccgagaggtgatgcgcatggctgagcctggcgacgtcgtgtactgcgatccaccgtatgtcccgctctcgaaaacggcaaacttccgccagtacgcggcgcagggcttcggagaagcggagcagcgcgatctcgcccgcatcgcggaggagcttgccgatcgcgggatcccggtgctcatctccaaccacctgacgcccttcacggagcgagcgtatcgccgcgcggagtgtaaacaactgcaggttcgccgagccattagctgccagggcgctcggcgaggatatgcgccggaggtgctcgcgctgttcgcgccgcgatcgcgttga

SEQ ID NO: 2462 - DNA, 852 bp, Artificial
  Alicyclobacillus acidocaldarius mutated SEQ ID NO 2450
atgagccgcctggtgcggccgcgaggggaggcggcgggcatgaagccttttctgaagtgggcggggggcaaataccgccttctaccttacatccaacgtgcgctgccgcctggccggaggttgatcgagccgtttgtcggctccggagccgtgttcctgaataccagctacgacgcctacgtgttgtcggatatcaacgcggacgtgatcgccctgtaccgcgtgctgagcctgcacggagaggcgtttatcgaggcgtgcaggcgcctgtttgtgcccgagaacaactgtccggaggtgtactacgcgctcagggatgagttcaatgcctcgcgcgacctcgtgaggcgcgccgccctgtttgtctacctgaaccggcacgggtacaacgggctctgcaggtacaacgcggaagggcgtttcaacgtgccgttcggccgatacaagcgaccctattttcccgagcgggagatgcggtatttctgcgagaaggccaggcgcgccgagtttttgtgcattgacttccgagaggtgatgcgcatggctgagcctggcgacgtcgtgtactgcgatccaccgtatgtcccgctctcgaaaacggcaaacttccgccagtacgcggcgcagggcttcggagaagcggagcagcgcgatctcgcccgcatcgcggaggagcttgccgatcgcgggatcccggtgctcatctccaaccacctgacgcccttcacggagcgagcgtatcgccgcgcggagtgtcgacaactgcaggttcgccgagccattagctgccagggcgctcggcgaggatatgcgccggaggtgctcgcgctgttcgcgccgcgatcgcgttga

SEQ ID NO: 2463 - DNA, 852 bp, Artificial
  Alicyclobacillus acidocaldarius mutated SEQ ID NO 2450
atgagccgcctggtgcggccgcgaggggatgcggcgggcatgaagccttttctgaagtgggcggggggcaaataccgccttctaccttacatccaacgtgcgctgccgcctggccggaggttgatcgagccgtttgtcggctccggagccgtgttcctgaataccagctacgacgcctacgtgttgtcggatatcaacgcggacgtgatcgccctgtaccgcgtgctgagcctgcacggagaggcgtttatcgaggcgtgcaggcgcctgtttgtgcccgagaacaactgtccggaggtgtactacgcgctcagggatgagttcaatgcctcgcgcgacctcgtgaggcgcgccgccctgtttgtctacctgaaccggcacgggtacaacgggctctgcaggtacaacgcggaagggcgtttcaacgtgccgttcggccgatacaagcgaccctattttcccgagcgggagatgcggtatttctgcgagaaggccaggcgcgccgagtttttgtgcgtcgacttccgagaggtgatgcgcatggctgagcctggcgacgtcgtgtactgcgatccaccgtatgtcccgctctcgaaaacggcaaacttccgccagtacgcggcgcagggcttcggagaagcggagcagcgcgatctcgcccgcatcgcggaggagcttgccgatcgcgggatcccggtgctcatctccaaccacctgacgcccttcacggagcgagcgtatcgccgcgcggagtgtcgacaactgcaggttcgccgagccattagctgccagggcgctcggcgaggatatgcgccggaggtgctcgcgctgttcgcgccgcgatcgcgttga

SEQ ID NO: 2464 - DNA, 852 bp, Artificial
  Alicyclobacillus acidocaldarius mutated SEQ ID NO 2450
atgagccgcctggtgcggccgcgaggggaggcggcgggcatgaagccttttctgaagtgggcggggggcaaataccgccttctaccttacatccaacgtgcgctgccgcctggccggaggttgatcgagccgtttgtcggctccggagccgtgttcctgaataccagctacgacgcctacgtgttgtcggatatcaacgcggacgtgatcgccctgtaccgcgtgctgagcctgcacggagaggcgtttatcgaggcgtgcaggcgcctgtttgtgcccgagaacaactgtccggaggtgtactacgcgctcagggatgagttcaatgcctcgcgcgacctcgtgaggcgcgccgccctgtttgtctacctgaaccggcacgggtacaacgggctctgcaggtacaacgcggaagggcgtttcaacgtgccgttcggccgatacaagcgaccctattttcccgagcgggagatgaaatatttctgcgagaaggccaggcgcgccgagtttttgtgcgtcgacttccgagaggtgatgcgcatggctgagcctggcgacgtcgtgtactgcgatccaccgtatgtcccgctctcgaaaacggcaaacttccgccagtacgcggcgcagggcttcggagaagcggagcagcgcgatctcgcccgcatcgcggaggagcttgccgatcgcgggatcccggtgctcatctccaaccacctgacgcccttcacggagcgagcgtatcgccgcgcggagtgtcgacaactgcaggttcgccgagccattagctgccagggcgctcggcgaggatatgcgccggaggtgctcgcgctgttcgcgccgcgatcgcgttga

SEQ ID NO: 2465 - DNA, 852 bp, Artificial
  Alicyclobacillus acidocaldarius mutated SEQ ID NO 2450
atgagccgcctggtgcggccgcgaggggaggcggcgggcatgaagccttttctgaagtgggcggggggcaaataccgccttctaccttacatccaacgtgcgctgccgcctggccggaggttgatcgagccgtttgtcggctccggagccgtgttcctgaataccagctacgacgcctacgtgttgtcggatatcaacgcggacgtgatcgccctgtaccgcgtgctgagcctgcacggagaggcgtttatcgaggcgtgcaggcgcctgtttgtgcccgagaacaactgtccggaggtgtactacgcgctcagggatgagttcaatgcctcgcgcgacctcgtgaggcgcgccgccctgtttgtctacctgaaccggcacgggtacaacgggctctgcaggtacaacgcggaagggcgtttcaacgtgccgttcggccgatacaagcgaccctattttcccgagcgggagatgcggtatttctgcgagaaggccaggcgcgccgagtttttgtgcgtcgacttccgagaggtgatgcgcatggctgagcctggcgacgtcgtgtactgcgatccaccgtatgtcccgctctcgaaaacggcaaacttccgccagtacgcggcgcagggcttcggagaagcggagcagcgcgatctcgcccgcatcgcggaggagcttgccgatcgcgggatcccggtgctcatctccaaccacctgacgcccttcacggagcgagcgtatcgccgcgcggagtgtcgacaactgcaggttcgccgagccattagctgccagggcgctcggcgaggatatgcgccggaggtgctcgcgctgttcgcgccgaaatcgcgttga

SEQ ID NO: 2466 - protein, 236 aa, Alicyclobacillus acidocaldarius
MPARVAALYDIHGNLAALDAVLQEVERAGADALVFGGDLAFGPQPRQVLERVMSLGGPVSFVRGNTDREVAERHGVEQGVRGWIAEVNAWCHDQLTPDQREFLLSQKAHVTLHVEGLGDVLFVHGSPRSDEEAIRRDTPEAEILPMVAHVGESIIVCGHTHIQFDRMVAGKRVVNAGSVGLPSAARGACWALIGPEIELRETLYDFERAAAEIRKSGAPKAGEFADDILNPPVAGP

SEQ ID NO: 2467 - DNA, 711 bp, Alicyclobacillus acidocaldarius
atgcccgctcgagtcgcggctttgtatgacatccacgggaacttggctgccttggacgcggtgctccaagaggtcgagcgcgccggcgcggacgcgttggtgtttgggggcgatctcgccttcggaccgcagccccggcaggtgctggaacgggtgatgtcgctcggcggccctgtttctttcgtccgcggcaacaccgaccgggaggtcgccgagcgccacggcgtggagcaaggcgtgcggggctggattgcggaagtgaacgcgtggtgtcatgaccagctcacgccggatcaacgcgagttcttgctcagtcagaaggctcacgtgacgcttcatgtggaggggctcggcgacgtactcttcgtccatggatcgccgagaagtgacgaggaggccattcggcgggacacgccagaagcggagatcttgccgatggtggcgcatgtgggcgagtccatcatcgtctgtgggcacacgcacatccagtttgaccggatggtggcgggcaagcgcgtcgtgaacgcgggcagcgtcggccttccgagcgcagcgcggggcgcgtgctgggcgctcatcggccccgagatcgaattgcgggagacgctgtacgacttcgagcgtgccgcagcggaaatccggaagtcgggcgctcccaaggcgggagagtttgcggatgacattttgaatccgcccgtcgcggggccttag

SEQ ID NO: 2468 - protein, 227 aa, Streptomyces cattleya
MTNRTAVLSDIHGVLPALEAVLAEPEVRAADRVVLTGDIACGPQPAEVLDLLTALGDRVTWVAGNADRELVEFRRGVRETIPDPIGPWAARQLRPDHLELLASLPLSVRLPVAGLGTVLFCHATPRDDEEVVVVDSRPDRWREVFDGLGPDVDAVICGHTHMPFVRLAHGRLVVNPGSVGMPYGRSGAHWALLGPGVDLRRTPYDTDAAIARLTRDCGYPAIAEWAD

SEQ ID NO: 2469 - protein, 224 aa, Janibacter  HTCC2649
RVAVLSDVHGVLPVLEAVLAEPDVASADLIVVTGDHTAGPMPVETLDALTALDGRVVLVRGNADREAVAIRSGDDSPHPEALWAAHALREDQIAVLSALPHPVTIDIAGFGEVLFCHGSPRDDDEVVLVDSPPTAWQNALSIVPDTVQTIVCGHTHMPFVRLVDRRTVINPGSIGMPYGRAGGAWALLDRGQVSLRHTEIDLDAVCARIVAESGYPDRAAWADE

SEQ ID NO: 2470 - protein, 231 aa, Lactobacillus casei
KIAALYDIHGNYPALKEVLKQVKKLSPDLVVLGGDLIAGPMPLETLSLLKHVSTTFKTVGIMGNNDQDIVDIYAKKRVGLSRKATEQLTWIANQLSYKQVSFLRNLLPSISIGNYFFCHAVKNDNTTVFSPQQNKAYIETLFKGVQESYIICGHTHIQFELSLPNKKIINAGSIGMPFSNQFGAQWLWLDDNRIEYKRTIFNQQAAIQLISQTEYPFKNEFIANNLRSTIS

SEQ ID NO: 2471 - protein, 178 aa, Burkholderia vietnamiensis
KIAALSDIHGNLAALDAVLDDVRRRGADVIVNLGDIVSGALHPAETADRLIALDLPTIRGNHERQLLERTRDAMGLSDRWAHDTLHERHRAWLAALPERATLGDDVLLVHGTPASDLDYFLETVTRDGCRAATPDEIAQRAEDEPASLILCGHTHVPRVARLADGRTIVNPGSVGLPA

SEQ ID NO: 2472 - protein, 180 aa, Desulfatibacillum alkenivorans
RIALISDIHGNDIALETVLKDMKSAGGIDQIICLGDVANLGPDPCSVVARLRDVNCPCVLGNHDAFLFDRDLIHQYTEVDYIIEAVDWCRDQLTQDDIDWMGDFHRVLEVLMDKAGSLIAFHGSPLSHMDNILSRTPDAEVDRLIQGLNGEILACGHTHIQMLRQHRGRLIINPGSVGLP

SEQ ID NO: 2473 - protein, 236 aa, Artificial
  Alicyclobacillus acidocaldarius mutated SEQ ID NO 2466
MPARVAALYDIHGNLAALDAVLQEVERAGADALVFGGDLAFGPQPRQVIERVMSLGGPVSFVRGNTDREVAERHGVEQGVRGWIAEVNAWCHDQLTPDQREFLLSQKAHVTLHVEGLGDVLFVHGSPRSDEEAIRRDTPEAEILPMVAHVGESIIVCGHTHIQFDRMVAGKRVVNAGSVGLPSAARGACWALIGPEIELRETLYDFERAAAEIRKSGAPKAGEFADDILNPPVAGP

SEQ ID NO: 2474 - protein, 236 aa, Artificial
  Alicyclobacillus acidocaldarius mutated SEQ ID NO 2466
MPARVAALYDIHGNLAALDAVLQEVERAGADALVFGGDLAFGPQPRQVLERVMSLGGPVSFVRGNTDREVAERHGVEQGVRGWIAEVNAWCHDQLTPDQKEFLLSQKAHVTLHVEGLGDVLFVHGSPRSDEEAIRRDTPEAEILPMVAHVGESIIVCGHTHIQFDRMVAGKRVVNAGSVGLPSAARGACWALIGPEIELRETLYDFERAAAEIRKSGAPKAGEFADDILNPPVAGP

SEQ ID NO: 2475 - protein, 236 aa, Artificial
  Alicyclobacillus acidocaldarius mutated SEQ ID NO 2466
MPARVAALYDIHGNLAALDAVLQEVERAGADALVFGGDLAFGPQPRQVLERVMSLGGPVSFVRGNTDREVAERHGVEQGVRGWIAEVNAWCHDQLTPDQREFLLSQKAHVTLHVEGLGDVLFVHGSPRSDEEAIRRDTPEAEILPMVAHVGESIIVCGHTHIQFDRMVAGKRVVNAGSVGLPSAARGACWALIGPEIELRETLYDFERAAAEIRKSGAPKAGDFADDILNPPVAGP

SEQ ID NO: 2476 - protein, 236 aa, Artificial
  Alicyclobacillus acidocaldarius mutated SEQ ID NO 2466
MPARVAALYDIHGNLAALDAVLQEVERAGADALVFGGDLAFGPQPRQVLERVMSLGGPVSFVRGNTDREVAERHGVEQGVRGWLAEVNAWCHDQLTPDQREFLLSQKAHVTLHVEGLGDVLFVHGSPRSDEEAIRRDTPEAEILPMVAHVGESIIVCGHTHIQFDRMVAGKRVVNAGSVGLPSAARGACWALIGPEIELRETLYDFERAAAEIRKSGAPKAGEFADDILNPPVAGP

SEQ ID NO: 2477 - protein, 236 aa, Artificial
  Alicyclobacillus acidocaldarius mutated SEQ ID NO 2466
MPARVAALYDIHGNLAALDAVLQEVERAGADALVFGGDLAFGPQPRQVLERVMSLGGPVSFVRGNTDREVAERHGVEQGVRGWIAEVNAWCHDQLTPDQREFLLSQKAHVTLHVEGLGDVLFVHGSPRSDEEAIRRDTPEAEILPMVAHVGESIIVCGHTHIQFDRMVAGKRVVNAGSVGLPSAARGACWALLGPEIELRETLYDFERAAAEIRKSGAPKAGEFADDILNPPVAGP

SEQ ID NO: 2478 - DNA, 711 bp, Artificial
  Alicyclobacillus acidocaldarius mutated SEQ ID NO 2467
atgcccgctcgagtcgcggctttgtatgacatccacgggaacttggctgccttggacgcggtgctccaagaggtcgagcgcgccggcgcggacgcgttggtgtttgggggcgatctcgccttcggaccgcagccccggcaggtgattgaacgggtgatgtcgctcggcggccctgtttctttcgtccgcggcaacaccgaccgggaggtcgccgagcgccacggcgtggagcaaggcgtgcggggctggattgcggaagtgaacgcgtggtgtcatgaccagctcacgccggatcaacgcgagttcttgctcagtcagaaggctcacgtgacgcttcatgtggaggggctcggcgacgtactcttcgtccatggatcgccgagaagtgacgaggaggccattcggcgggacacgccagaagcggagatcttgccgatggtggcgcatgtgggcgagtccatcatcgtctgtgggcacacgcacatccagtttgaccggatggtggcgggcaagcgcgtcgtgaacgcgggcagcgtcggccttccgagcgcagcgcggggcgcgtgctgggcgctcatcggccccgagatcgaattgcgggagacgctgtacgacttcgagcgtgccgcagcggaaatccggaagtcgggcgctcccaaggcgggagagtttgcggatgacattttgaatccgcccgtcgcggggccttag

SEQ ID NO: 2479 - DNA, 711 bp, Artificial
  Alicyclobacillus acidocaldarius mutated SEQ ID NO 2467
atgcccgctcgagtcgcggctttgtatgacatccacgggaacttggctgccttggacgcggtgctccaagaggtcgagcgcgccggcgcggacgcgttggtgtttgggggcgatctcgccttcggaccgcagccccggcaggtgctggaacgggtgatgtcgctcggcggccctgtttctttcgtccgcggcaacaccgaccgggaggtcgccgagcgccacggcgtggagcaaggcgtgcggggctggattgcggaagtgaacgcgtggtgtcatgaccagctcacgccggatcaaaaagagttcttgctcagtcagaaggctcacgtgacgcttcatgtggaggggctcggcgacgtactcttcgtccatggatcgccgagaagtgacgaggaggccattcggcgggacacgccagaagcggagatcttgccgatggtggcgcatgtgggcgagtccatcatcgtctgtgggcacacgcacatccagtttgaccggatggtggcgggcaagcgcgtcgtgaacgcgggcagcgtcggccttccgagcgcagcgcggggcgcgtgctgggcgctcatcggccccgagatcgaattgcgggagacgctgtacgacttcgagcgtgccgcagcggaaatccggaagtcgggcgctcccaaggcgggagagtttgcggatgacattttgaatccgcccgtcgcggggccttag

SEQ ID NO: 2480 - DNA, 711 bp, Artificial
  Alicyclobacillus acidocaldarius mutated SEQ ID NO 2467
atgcccgctcgagtcgcggctttgtatgacatccacgggaacttggctgccttggacgcggtgctccaagaggtcgagcgcgccggcgcggacgcgttggtgtttgggggcgatctcgccttcggaccgcagccccggcaggtgctggaacgggtgatgtcgctcggcggccctgtttctttcgtccgcggcaacaccgaccgggaggtcgccgagcgccacggcgtggagcaaggcgtgcggggctggattgcggaagtgaacgcgtggtgtcatgaccagctcacgccggatcaacgcgagttcttgctcagtcagaaggctcacgtgacgcttcatgtggaggggctcggcgacgtactcttcgtccatggatcgccgagaagtgacgaggaggccattcggcgggacacgccagaagcggagatcttgccgatggtggcgcatgtgggcgagtccatcatcgtctgtgggcacacgcacatccagtttgaccggatggtggcgggcaagcgcgtcgtgaacgcgggcagcgtcggccttccgagcgcagcgcggggcgcgtgctgggcgctcatcggccccgagatcgaattgcgggagacgctgtacgacttcgagcgtgccgcagcggaaatccggaagtcgggcgctcccaaggcgggagattttgcggatgacattttgaatccgcccgtcgcggggccttag

SEQ ID NO: 2481 - DNA, 711 bp, Artificial
  Alicyclobacillus acidocaldarius mutated SEQ ID NO 2467
atgcccgctcgagtcgcggctttgtatgacatccacgggaacttggctgccttggacgcggtgctccaagaggtcgagcgcgccggcgcggacgcgttggtgtttgggggcgatctcgccttcggaccgcagccccggcaggtgctggaacgggtgatgtcgctcggcggccctgtttctttcgtccgcggcaacaccgaccgggaggtcgccgagcgccacggcgtggagcaaggcgtgcggggctggttagcggaagtgaacgcgtggtgtcatgaccagctcacgccggatcaacgcgagttcttgctcagtcagaaggctcacgtgacgcttcatgtggaggggctcggcgacgtactcttcgtccatggatcgccgagaagtgacgaggaggccattcggcgggacacgccagaagcggagatcttgccgatggtggcgcatgtgggcgagtccatcatcgtctgtgggcacacgcacatccagtttgaccggatggtggcgggcaagcgcgtcgtgaacgcgggcagcgtcggccttccgagcgcagcgcggggcgcgtgctgggcgctcatcggccccgagatcgaattgcgggagacgctgtacgacttcgagcgtgccgcagcggaaatccggaagtcgggcgctcccaaggcgggagagtttgcggatgacattttgaatccgcccgtcgcggggccttag

SEQ ID NO: 2482 - DNA, 711 bp, Artificial
  Alicyclobacillus acidocaldarius mutated SEQ ID NO 2467
atgcccgctcgagtcgcggctttgtatgacatccacgggaacttggctgccttggacgcggtgctccaagaggtcgagcgcgccggcgcggacgcgttggtgtttgggggcgatctcgccttcggaccgcagccccggcaggtgctggaacgggtgatgtcgctcggcggccctgtttctttcgtccgcggcaacaccgaccgggaggtcgccgagcgccacggcgtggagcaaggcgtgcggggctggattgcggaagtgaacgcgtggtgtcatgaccagctcacgccggatcaacgcgagttcttgctcagtcagaaggctcacgtgacgcttcatgtggaggggctcggcgacgtactcttcgtccatggatcgccgagaagtgacgaggaggccattcggcgggacacgccagaagcggagatcttgccgatggtggcgcatgtgggcgagtccatcatcgtctgtgggcacacgcacatccagtttgaccggatggtggcgggcaagcgcgtcgtgaacgcgggcagcgtcggccttccgagcgcagcgcggggcgcgtgctgggcgctcttaggccccgagatcgaattgcgggagacgctgtacgacttcgagcgtgccgcagcggaaatccggaagtcgggcgctcccaaggcgggagagtttgcggatgacattttgaatccgcccgtcgcggggccttag

SEQ ID NO: 2483 - protein, 463 aa, Alicyclobacillus acidocaldarius
MRNAMAAEETLWRDREAEAALRMPPHNLEAEQAVLGAMLISPDAVVEAMEILEADDFYRSAHQAIYRAIREVYEAGDPVDIITVASRLRTYGDVLDAVGGPEYLADLAAMMPTALHVVHYAEIVREKALLRRIISAGTRIAEAAYEPDASAMEVLADAERLVLELSQHQRTRDFTHISDVLQTTFERIEQLYESDGNITGVPTGYSDLDRMTSGFQKSDLIIVAARPSVGKTAFALNIAQNVAVRAGLPVAIFSLEMSKDQLVQRMLCAEAFIDGHKLRNGTLDDEDWPKLSMGVTTLSNSPIYIDDTPGITVPEMRSKLRRLKLEHGLGFVVIDYLQLIHGRRMAGENRQQEISDISRSLKQLARELEVPILALAQLSRSVEQRQDKRPMLSDIRESGSIEQDADVVAFLYRDDYYNPDTENPNVVEVIIAKQRNGPTGKIELVFLKNFNKFVNLERAHAEP

SEQ ID NO: 2484 - DNA, 1392 bp, Alicyclobacillus acidocaldarius
gtgagaaacgccatggcggcagaggagacgctgtggcgcgatagggaggctgaggcggcacttcgcatgccgccgcacaacctggaggcggagcaggcggttcttggcgccatgctcatttcgcctgacgcggtcgtcgaagcgatggagatcctcgaggcggacgacttctatcgctccgcccaccaggccatctaccgcgctatccgcgaggtgtacgaggcgggcgatccggtcgacatcatcacggtggcgtcgcggctgcgcacgtacggcgacgtcctcgacgcggtcggtgggccggagtatctggccgatctcgccgcgatgatgcccaccgcgcttcacgtcgtgcattacgccgagatcgtccgggagaaggcgctgctcaggcggatcatctccgcgggcacgcgcatcgcggaggcggcgtacgagccggacgcgtctgcgatggaggtgctggcggatgcggagcggctggtgctcgagctcagccagcaccagcggacgcgggatttcacccacatctccgacgtgctgcagacgacgttcgaacggatcgagcagctgtacgagagcgacggcaacatcaccggcgtgcccaccggctacagcgatctcgaccggatgacgagcggctttcagaagtcggatctcatcattgtcgcggcgcgcccttcggtggggaagacggcgtttgccctcaatatcgcgcaaaatgtcgccgtccgggccggactgccggtcgccatcttctcgctcgagatgtcgaaggatcagcttgtgcagcgcatgctttgcgcggaggcgttcatcgatggccacaagctccggaacggaaccctcgatgatgaggattggccgaagctgtccatgggcgtgaccacgctcagcaattcgcccatctacatcgacgacacgccgggcatcacggtgcccgagatgcggagcaagcttaggcgcctcaagctggagcacgggctcgggtttgtcgtgatcgactacctgcagctcatccacgggcggcggatggccggggagaaccgccagcaggagatctccgacatttcgcgttcgctcaagcagttggcgcgcgagctcgaggtgccgattctcgccctggcccagctcagccgatccgtggagcagcgccaggacaagcgcccgatgctgtcggatatccgagagtcgggatccatcgaacaggacgcggacgtggtggcctttctgtaccgcgatgactactacaaccccgacacggagaatccgaacgtcgtcgaggtcatcatcgccaagcagcgcaacgggccgacgggcaaaatcgagctcgtgttcctgaagaacttcaacaagttcgtgaatctcgaacgtgcacacgcggagccatga

SEQ ID NO: 2485 - protein, 436 aa, Bacillus coagulans
RIPPQNIEAEQAVLGAIFLEPSAFITASEILTAEDFYRNAHQKIFQVFAKLNDAGKAVDLVTVAEELSATRQLEDAGGLSYLSELAASVPTAANIAYYAGIVAEKALLRRLIRTATHIAQEGYTREDDVDELLDEAERSIMEVAQRKNAGDFKHIKDVLVSTYDNIEMLHNRKGDVTGIPTGFYELDRMTAGFQRNDLIIVAARPSVGKTAFALNIAQNVGTKTEENVAIFSLEMGAEQLVMRMLCAEGNIDAQRLRTGALTDEDWRKLTMAMGSLSNSGIYIDDTPGVRVTEIRSKCRRLKQEHGLGMVVIDYLQLIQGSARSRENRQQEVSEISRSLKALARELEVPVIALSQLSRGVEQRQDKRPMMSDIRESGSIEQDADIVAFLYREDYYEQDTENKNIIEIIIAKQRNGPVGTVQLAFIKEYNKFVNLER

SEQ ID NO: 2486 - protein, 436 aa, Bacillus subtilis
RLPPQNIEAEQAVLGAIFLQPSALTLASEVLIPDDFYRMSHQKIYNAMLVLGDRGEPVDLVTVTSELANTDLLEEVGGISYLTDIANSVPTAANIEYYAKIVEEKSILRRLIRTATTIAQDGYTREDEVEDLLSEAEKTIMEVAQRKNTSAFQNIKDVLVQTYDNIEQLYNRKGDITGIPTGFTELDRMTAGFQRNDLIIVAARPSVGKTAFALNIAQNVATKTDESVAIFSLEMGAEQLVMRMLCAEGNINAQNLRTGNLTEEDWGKLTMAMGSLSNSGIYIDDTPGIRVSEIRAKCRRLKQESGLGMILIDYLQLIQGSGRSKDNRQQEVSEISRELKSIARELQVPVIALSQLSRGVEQRQDKRPMMSDIRESGSIEQDADIVAFLYRDDYYDKETENKNIIEIIIAKQRNGPVGTVSLAFVKEYNKFVNLER

SEQ ID NO: 2487 - protein, 436 aa, Bacillus pumilus
RLPPQNIEAEQAVLGAVFLEPSALTLASEVLIPEDFYRMSHQKIYNAMLVLGDRGEPVDLVTVTSELANTDLLEEVGGISYLTDIANSVPTAANIEYYAKIVEEKSILRRLIRTATTIAQDGYTREDEVEDLLSDAEKTIMEVAQRKNSGAFQNIKDVLVQTYDNIEQLHNRKGDITGIPTGFSELDRMTAGFQRNDLIIVAARPSVGKTAFALNIAQNVATKTDESVAIFSLEMGSEQLVMRMLCAEGNINAQNLRTGNLTEEDWGKLTMAMGSLSNSGIFIDDTPGIRVSEIRSKCRRLKQENGLGMILIDYLQLIQGSGRSSDNRQQEVSEISRALKSLARELEVPVIALSQLSRGVEQRQDKRPMMSDIRESGSIEQDADIVAFLYRDDYYDKESENKNIIEIIIAKQRNGPVGTVSLAFVKEYNKFVNLER

SEQ ID NO: 2488 - protein, 440 aa, Bacillus halodurans
RTPPQNIEAEQAVLGAIFLEDHALVTASERLAPEDFYRAAHQRIYQVMLDLAEKGEPVDLVTVTAELQDRKALDDVGGVAYLGDLANAVPTAANVEYYSKIVEEKSLLRRLIRVATNIAQEGYASEEEVDAILDDAEKTILDVAQRKNSSAFISIKDVLVETYDKIEMLQNQKGEITGIPTGFKDLDRMTAGFQRNDLIIVAARPSVGKTAFALNISQNVATKTDENVAIFSLEMGASQLVQRMLCAEGNIDAQRMRTGALTEEDWQKLTMAMGSLARAGIYIDDTPGIKVNEIRAKCRRLKQEKGLGMILIDYLQLIQGNGRSGENRQQEVSEISRSLKGLARELEVPVIALSQLSRGVESRQDKRPMMSDIRESGSIEQDADIVAFLYRDDYYDKETENQNIIEIIIAKQRNGPVGTVELAFIKEYNKFVNLDRHHDE

SEQ ID NO: 2489 - protein, 436 aa, Bacillus amyloliquefaciens
RLPPQNIEAEQAVLGAVFLQPSALTLASEVLIPDDFYRMSHQKIYNAMLVLGDRGEPVDLVTVTSELANTDLLEEVGGVSYLTDIANSVPTAANIEYYAKIVEEKSILRRLIRTATSIAQDGYTREDEVEDLLSDAEKTIMEVAQRKNSGAFQNIKDVLVQTYDNIEQLHNRKGDITGIPTGFIELDRMTAGFQRNDLIIVAARPSVGKTAFALNIAQNVATKTDESVAIFSLEMGAEQLVMRMLCAEGNINAQNLRTGNLTEEDWGKLTMAMGSLSNSGIFIDDTPGIRVSEIRSKCRRLKQENGLGMILIDYLQLIQGSGRSSDNRQQEVSEISRALKALARELEVPVIALSQLSRGVEQRQDKRPMMSDIRESGSIEQDADIVAFLYRDDYYDKESENKNIIEIIIAKQRNGPVGTVSLAFVKEYNKFVNLER

SEQ ID NO: 2490 - protein, 463 aa, Artificial
  Alicyclobacillus acidocaldarius mutated SEQ ID NO 2483
MRNAMAAEETLWRDREAEAALRMPPHNLEAEQAVLGAMLISPDAVVEAMEILEADDFYRSAHQAIYRAIREVYEAGDPVDIITVASRLRTYGDVLDAVGGPEYLADLAAMMPTALHVVHYAEIVREKALLRRIISAGTRIAEAAYEPDASAMEVLADAERLVLELSQHQRTRDFTHISDVLQTTFERIEQLYESDGNITGVPTGYSDLDRMTSGFQKSDLIIVAARPSVGKTAFALNIAQNVAVRAGLPVAIFSLEMSKDQLVQRMLCAEAFIDGHKLRNGTLDDEDWPKLSMGVTTLSNSPIYIDDTPGITVPEMRSKLRRLKLEHGLGFVVIDYLQLIHGRRMAGENRQQEISDISRSLKNLARELEVPILALAQLSRSVEQRQDKRPMLSDIRESGSIEQDADVVAFLYRDDYYNPDTENPNVVEVIIAKQRNGPTGKIELVFLKNFNKFVNLERAHAEP

SEQ ID NO: 2491 - protein, 463 aa, Artificial
  Alicyclobacillus acidocaldarius mutated SEQ ID NO 2483
MRNAMAAEETLWREREAEAALRMPPHNLEAEQAVLGAMLISPDAVVEAMEILEADDFYRSAHQAIYRAIREVYEAGDPVDIITVASRLRTYGDVLDAVGGPEYLADLAAMMPTALHVVHYAEIVREKALLRRIISAGTRIAEAAYEPDASAMEVLADAERLVLELSQHQRTRDFTHISDVLQTTFERIEQLYESDGNITGVPTGYSDLDRMTSGFQKSDLIIVAARPSVGKTAFALNIAQNVAVRAGLPVAIFSLEMSKDQLVQRMLCAEAFIDGHKLRNGTLDDEDWPKLSMGVTTLSNSPIYIDDTPGITVPEMRSKLRRLKLEHGLGFVVIDYLQLIHGRRMAGENRQQEISDISRSLKQLARELEVPILALAQLSRSVEQRQDKRPMLSDIRESGSIEQDADVVAFLYRDDYYNPDTENPNVVEVIIAKQRNGPTGKIELVFLKNFNKFVNLERAHAEP

SEQ ID NO: 2492 - protein, 463 aa, Artificial
  Alicyclobacillus acidocaldarius mutated SEQ ID NO 2483
MRNAMAAEETLWRDREAEAALRMPPHNLEAEQAVLGAMLISPDAVVEAMEILEADDFYRSAHQAIYRAIKEVYEAGDPVDIITVASRLRTYGDVLDAVGGPEYLADLAAMMPTALHVVHYAEIVREKALLRRIISAGTRIAEAAYEPDASAMEVLADAERLVLELSQHQRTRDFTHISDVLQTTFERIEQLYESDGNITGVPTGYSDLDRMTSGFQKSDLIIVAARPSVGKTAFALNIAQNVAVRAGLPVAIFSLEMSKDQLVQRMLCAEAFIDGHKLRNGTLDDEDWPKLSMGVTTLSNSPIYIDDTPGITVPEMRSKLRRLKLEHGLGFVVIDYLQLIHGRRMAGENRQQEISDISRSLKQLARELEVPILALAQLSRSVEQRQDKRPMLSDIRESGSIEQDADVVAFLYRDDYYNPDTENPNVVEVIIAKQRNGPTGKIELVFLKNFNKFVNLERAHAEP

SEQ ID NO: 2493 - protein, 463 aa, Artificial
  Alicyclobacillus acidocaldarius mutated SEQ ID NO 2483
MRNAMAAEETLWRDKEAEAALRMPPHNLEAEQAVLGAMLISPDAVVEAMEILEADDFYRSAHQAIYRAIREVYEAGDPVDIITVASRLRTYGDVLDAVGGPEYLADLAAMMPTALHVVHYAEIVREKALLRRIISAGTRIAEAAYEPDASAMEVLADAERLVLELSQHQRTRDFTHISDVLQTTFERIEQLYESDGNITGVPTGYSDLDRMTSGFQKSDLIIVAARPSVGKTAFALNIAQNVAVRAGLPVAIFSLEMSKDQLVQRMLCAEAFIDGHKLRNGTLDDEDWPKLSMGVTTLSNSPIYIDDTPGITVPEMRSKLRRLKLEHGLGFVVIDYLQLIHGRRMAGENRQQEISDISRSLKQLARELEVPILALAQLSRSVEQRQDKRPMLSDIRESGSIEQDADVVAFLYRDDYYNPDTENPNVVEVIIAKQRNGPTGKIELVFLKNFNKFVNLERAHAEP

SEQ ID NO: 2494 - protein, 463 aa, Artificial
  Alicyclobacillus acidocaldarius mutated SEQ ID NO 2483
MRNAMAAEETLWRDREAEAALRMPPHNLEAEQAVLGAMLISPDAVIEAMEILEADDFYRSAHQAIYRAIREVYEAGDPVDIITVASRLRTYGDVLDAVGGPEYLADLAAMMPTALHVVHYAEIVREKALLRRIISAGTRIAEAAYEPDASAMEVLADAERLVLELSQHQRTRDFTHISDVLQTTFERIEQLYESDGNITGVPTGYSDLDRMTSGFQKSDLIIVAARPSVGKTAFALNIAQNVAVRAGLPVAIFSLEMSKDQLVQRMLCAEAFIDGHKLRNGTLDDEDWPKLSMGVTTLSNSPIYIDDTPGITVPEMRSKLRRLKLEHGLGFVVIDYLQLIHGRRMAGENRQQEISDISRSLKQLARELEVPILALAQLSRSVEQRQDKRPMLSDIRESGSIEQDADVVAFLYRDDYYNPDTENPNVVEVIIAKQRNGPTGKIELVFLKNFNKFVNLERAHAEP

SEQ ID NO: 2495 - DNA, 1392 bp, Artificial
  Alicyclobacillus acidocaldarius mutated SEQ ID NO 2484
gtgagaaacgccatggcggcagaggagacgctgtggcgcgatagggaggctgaggcggcacttcgcatgccgccgcacaacctggaggcggagcaggcggttcttggcgccatgctcatttcgcctgacgcggtcgtcgaagcgatggagatcctcgaggcggacgacttctatcgctccgcccaccaggccatctaccgcgctatccgcgaggtgtacgaggcgggcgatccggtcgacatcatcacggtggcgtcgcggctgcgcacgtacggcgacgtcctcgacgcggtcggtgggccggagtatctggccgatctcgccgcgatgatgcccaccgcgcttcacgtcgtgcattacgccgagatcgtccgggagaaggcgctgctcaggcggatcatctccgcgggcacgcgcatcgcggaggcggcgtacgagccggacgcgtctgcgatggaggtgctggcggatgcggagcggctggtgctcgagctcagccagcaccagcggacgcgggatttcacccacatctccgacgtgctgcagacgacgttcgaacggatcgagcagctgtacgagagcgacggcaacatcaccggcgtgcccaccggctacagcgatctcgaccggatgacgagcggctttcagaagtcggatctcatcattgtcgcggcgcgcccttcggtggggaagacggcgtttgccctcaatatcgcgcaaaatgtcgccgtccgggccggactgccggtcgccatcttctcgctcgagatgtcgaaggatcagcttgtgcagcgcatgctttgcgcggaggcgttcatcgatggccacaagctccggaacggaaccctcgatgatgaggattggccgaagctgtccatgggcgtgaccacgctcagcaattcgcccatctacatcgacgacacgccgggcatcacggtgcccgagatgcggagcaagcttaggcgcctcaagctggagcacgggctcgggtttgtcgtgatcgactacctgcagctcatccacgggcggcggatggccggggagaaccgccagcaggagatctccgacatttcgcgttcgctcaagaatttggcgcgcgagctcgaggtgccgattctcgccctggcccagctcagccgatccgtggagcagcgccaggacaagcgcccgatgctgtcggatatccgagagtcgggatccatcgaacaggacgcggacgtggtggcctttctgtaccgcgatgactactacaaccccgacacggagaatccgaacgtcgtcgaggtcatcatcgccaagcagcgcaacgggccgacgggcaaaatcgagctcgtgttcctgaagaacttcaacaagttcgtgaatctcgaacgtgcacacgcggagccatga

SEQ ID NO: 2496 - DNA, 1392 bp, Artificial
  Alicyclobacillus acidocaldarius mutated SEQ ID NO 2484
gtgagaaacgccatggcggcagaggagacgctgtggcgcgaaagggaggctgaggcggcacttcgcatgccgccgcacaacctggaggcggagcaggcggttcttggcgccatgctcatttcgcctgacgcggtcgtcgaagcgatggagatcctcgaggcggacgacttctatcgctccgcccaccaggccatctaccgcgctatccgcgaggtgtacgaggcgggcgatccggtcgacatcatcacggtggcgtcgcggctgcgcacgtacggcgacgtcctcgacgcggtcggtgggccggagtatctggccgatctcgccgcgatgatgcccaccgcgcttcacgtcgtgcattacgccgagatcgtccgggagaaggcgctgctcaggcggatcatctccgcgggcacgcgcatcgcggaggcggcgtacgagccggacgcgtctgcgatggaggtgctggcggatgcggagcggctggtgctcgagctcagccagcaccagcggacgcgggatttcacccacatctccgacgtgctgcagacgacgttcgaacggatcgagcagctgtacgagagcgacggcaacatcaccggcgtgcccaccggctacagcgatctcgaccggatgacgagcggctttcagaagtcggatctcatcattgtcgcggcgcgcccttcggtggggaagacggcgtttgccctcaatatcgcgcaaaatgtcgccgtccgggccggactgccggtcgccatcttctcgctcgagatgtcgaaggatcagcttgtgcagcgcatgctttgcgcggaggcgttcatcgatggccacaagctccggaacggaaccctcgatgatgaggattggccgaagctgtccatgggcgtgaccacgctcagcaattcgcccatctacatcgacgacacgccgggcatcacggtgcccgagatgcggagcaagcttaggcgcctcaagctggagcacgggctcgggtttgtcgtgatcgactacctgcagctcatccacgggcggcggatggccggggagaaccgccagcaggagatctccgacatttcgcgttcgctcaagcagttggcgcgcgagctcgaggtgccgattctcgccctggcccagctcagccgatccgtggagcagcgccaggacaagcgcccgatgctgtcggatatccgagagtcgggatccatcgaacaggacgcggacgtggtggcctttctgtaccgcgatgactactacaaccccgacacggagaatccgaacgtcgtcgaggtcatcatcgccaagcagcgcaacgggccgacgggcaaaatcgagctcgtgttcctgaagaacttcaacaagttcgtgaatctcgaacgtgcacacgcggagccatga

SEQ ID NO: 2497 - DNA, 1392 bp, Artificial
  Alicyclobacillus acidocaldarius mutated SEQ ID NO 2484
gtgagaaacgccatggcggcagaggagacgctgtggcgcgatagggaggctgaggcggcacttcgcatgccgccgcacaacctggaggcggagcaggcggttcttggcgccatgctcatttcgcctgacgcggtcgtcgaagcgatggagatcctcgaggcggacgacttctatcgctccgcccaccaggccatctaccgcgctatcaaagaggtgtacgaggcgggcgatccggtcgacatcatcacggtggcgtcgcggctgcgcacgtacggcgacgtcctcgacgcggtcggtgggccggagtatctggccgatctcgccgcgatgatgcccaccgcgcttcacgtcgtgcattacgccgagatcgtccgggagaaggcgctgctcaggcggatcatctccgcgggcacgcgcatcgcggaggcggcgtacgagccggacgcgtctgcgatggaggtgctggcggatgcggagcggctggtgctcgagctcagccagcaccagcggacgcgggatttcacccacatctccgacgtgctgcagacgacgttcgaacggatcgagcagctgtacgagagcgacggcaacatcaccggcgtgcccaccggctacagcgatctcgaccggatgacgagcggctttcagaagtcggatctcatcattgtcgcggcgcgcccttcggtggggaagacggcgtttgccctcaatatcgcgcaaaatgtcgccgtccgggccggactgccggtcgccatcttctcgctcgagatgtcgaaggatcagcttgtgcagcgcatgctttgcgcggaggcgttcatcgatggccacaagctccggaacggaaccctcgatgatgaggattggccgaagctgtccatgggcgtgaccacgctcagcaattcgcccatctacatcgacgacacgccgggcatcacggtgcccgagatgcggagcaagcttaggcgcctcaagctggagcacgggctcgggtttgtcgtgatcgactacctgcagctcatccacgggcggcggatggccggggagaaccgccagcaggagatctccgacatttcgcgttcgctcaagcagttggcgcgcgagctcgaggtgccgattctcgccctggcccagctcagccgatccgtggagcagcgccaggacaagcgcccgatgctgtcggatatccgagagtcgggatccatcgaacaggacgcggacgtggtggcctttctgtaccgcgatgactactacaaccccgacacggagaatccgaacgtcgtcgaggtcatcatcgccaagcagcgcaacgggccgacgggcaaaatcgagctcgtgttcctgaagaacttcaacaagttcgtgaatctcgaacgtgcacacgcggagccatga

SEQ ID NO: 2498 - DNA, 1392 bp, Artificial
  Alicyclobacillus acidocaldarius mutated SEQ ID NO 2484
gtgagaaacgccatggcggcagaggagacgctgtggcgcgataaagaggctgaggcggcacttcgcatgccgccgcacaacctggaggcggagcaggcggttcttggcgccatgctcatttcgcctgacgcggtcgtcgaagcgatggagatcctcgaggcggacgacttctatcgctccgcccaccaggccatctaccgcgctatccgcgaggtgtacgaggcgggcgatccggtcgacatcatcacggtggcgtcgcggctgcgcacgtacggcgacgtcctcgacgcggtcggtgggccggagtatctggccgatctcgccgcgatgatgcccaccgcgcttcacgtcgtgcattacgccgagatcgtccgggagaaggcgctgctcaggcggatcatctccgcgggcacgcgcatcgcggaggcggcgtacgagccggacgcgtctgcgatggaggtgctggcggatgcggagcggctggtgctcgagctcagccagcaccagcggacgcgggatttcacccacatctccgacgtgctgcagacgacgttcgaacggatcgagcagctgtacgagagcgacggcaacatcaccggcgtgcccaccggctacagcgatctcgaccggatgacgagcggctttcagaagtcggatctcatcattgtcgcggcgcgcccttcggtggggaagacggcgtttgccctcaatatcgcgcaaaatgtcgccgtccgggccggactgccggtcgccatcttctcgctcgagatgtcgaaggatcagcttgtgcagcgcatgctttgcgcggaggcgttcatcgatggccacaagctccggaacggaaccctcgatgatgaggattggccgaagctgtccatgggcgtgaccacgctcagcaattcgcccatctacatcgacgacacgccgggcatcacggtgcccgagatgcggagcaagcttaggcgcctcaagctggagcacgggctcgggtttgtcgtgatcgactacctgcagctcatccacgggcggcggatggccggggagaaccgccagcaggagatctccgacatttcgcgttcgctcaagcagttggcgcgcgagctcgaggtgccgattctcgccctggcccagctcagccgatccgtggagcagcgccaggacaagcgcccgatgctgtcggatatccgagagtcgggatccatcgaacaggacgcggacgtggtggcctttctgtaccgcgatgactactacaaccccgacacggagaatccgaacgtcgtcgaggtcatcatcgccaagcagcgcaacgggccgacgggcaaaatcgagctcgtgttcctgaagaacttcaacaagttcgtgaatctcgaacgtgcacacgcggagccatga

SEQ ID NO: 2499 - DNA, 1392 bp, Artificial
  Alicyclobacillus acidocaldarius mutated SEQ ID NO 2484
gtgagaaacgccatggcggcagaggagacgctgtggcgcgatagggaggctgaggcggcacttcgcatgccgccgcacaacctggaggcggagcaggcggttcttggcgccatgctcatttcgcctgacgcggtcattgaagcgatggagatcctcgaggcggacgacttctatcgctccgcccaccaggccatctaccgcgctatccgcgaggtgtacgaggcgggcgatccggtcgacatcatcacggtggcgtcgcggctgcgcacgtacggcgacgtcctcgacgcggtcggtgggccggagtatctggccgatctcgccgcgatgatgcccaccgcgcttcacgtcgtgcattacgccgagatcgtccgggagaaggcgctgctcaggcggatcatctccgcgggcacgcgcatcgcggaggcggcgtacgagccggacgcgtctgcgatggaggtgctggcggatgcggagcggctggtgctcgagctcagccagcaccagcggacgcgggatttcacccacatctccgacgtgctgcagacgacgttcgaacggatcgagcagctgtacgagagcgacggcaacatcaccggcgtgcccaccggctacagcgatctcgaccggatgacgagcggctttcagaagtcggatctcatcattgtcgcggcgcgcccttcggtggggaagacggcgtttgccctcaatatcgcgcaaaatgtcgccgtccgggccggactgccggtcgccatcttctcgctcgagatgtcgaaggatcagcttgtgcagcgcatgctttgcgcggaggcgttcatcgatggccacaagctccggaacggaaccctcgatgatgaggattggccgaagctgtccatgggcgtgaccacgctcagcaattcgcccatctacatcgacgacacgccgggcatcacggtgcccgagatgcggagcaagcttaggcgcctcaagctggagcacgggctcgggtttgtcgtgatcgactacctgcagctcatccacgggcggcggatggccggggagaaccgccagcaggagatctccgacatttcgcgttcgctcaagcagttggcgcgcgagctcgaggtgccgattctcgccctggcccagctcagccgatccgtggagcagcgccaggacaagcgcccgatgctgtcggatatccgagagtcgggatccatcgaacaggacgcggacgtggtggcctttctgtaccgcgatgactactacaaccccgacacggagaatccgaacgtcgtcgaggtcatcatcgccaagcagcgcaacgggccgacgggcaaaatcgagctcgtgttcctgaagaacttcaacaagttcgtgaatctcgaacgtgcacacgcggagccatga

SEQ ID NO: 2500 - protein, 163 aa, Alicyclobacillus acidocaldarius; identical to SEQ ID NO: 1616

SEQ ID NO: 2501 - DNA, 492 bp, Alicyclobacillus acidocaldarius; identical to SEQ ID NO: 1617

SEQ ID NO: 2502 - protein, 105 aa, Pelotomaculum thermopropionicum; identical to SEQ ID NO: 1618

SEQ ID NO: 2503 - protein, 88 aa, Bacillus halodurans; identical to SEQ ID NO: 1619

SEQ ID NO: 2504 - protein, 164 aa, Bacillus cereus; identical to SEQ ID NO: 1620

SEQ ID NO: 2505 - protein, 164 aa, Geobacillus kaustophilus; identical to SEQ ID NO: 1621

SEQ ID NO: 2506 - protein, 108 aa, Symbiobacterium thermophilum; identical to SEQ ID NO: 1622

SEQ ID NO: 2507 - protein, 163 aa, Artificial
  Alicyclobacillus acidocaldarius mutated SEQ ID NO 2500
MNAEGTSMLNRVILIGRLTADPELRYTNNGTAVASFTLAVDRMRSGPNGERQTDFINVVVWQKQAEIVAQYLQKGRLAAVDGRLQIRSYDNRDGQRVRVAEVVAETVRFLDRGPDQAQGSGYSAAGAQTRQQKPTPSSAPPFEDDPFADDSQLIDISEDDLPF

SEQ ID NO: 2508 - protein, 163 aa, Artificial
  Alicyclobacillus acidocaldarius mutated SEQ ID NO 2500
MNAEGTSMLNRVILIGRLTADPELRYTNNGTAVASFTLAVDRMRSGPNGERQTDFINVVVWQKQAEIVAQYLQKGRLAAVDGRLQIRSYDNRDGQRVRVAEVVAETVRFLDRGPDNAQGSGYSAAGAQTRQQRPTPSSAPPFEDDPFADDSQLIDISEDDLPF

SEQ ID NO: 2509 - protein, 163 aa, Artificial
  Alicyclobacillus acidocaldarius mutated SEQ ID NO 2500
MNAEGTSMLNRVILIGRLTADPELRYTNNGTAVASFTLAVDRMRSGPNGERQTDFINVVVWQKQAEIVAQYLQKGRLAAVDGRLQIRSYDNRDGQRVRVAEVVAETVRFLDRGPDQAQGSGYSAAGAQTRQQRPTPSSAPPFEDDPFADDSQLIEISEDDLPF

SEQ ID NO: 2510 - protein, 163 aa, Artificial
  Alicyclobacillus acidocaldarius mutated SEQ ID NO 2500
MNAEGTSMLNRVILIGRLTADPELRYTNNGTAVASFTLAVDRMKSGPNGERQTDFINVVVWQKQAEIVAQYLQKGRLAAVDGRLQIRSYDNRDGQRVRVAEVVAETVRFLDRGPDQAQGSGYSAAGAQTRQQRPTPSSAPPFEDDPFADDSQLIDISEDDLPF

SEQ ID NO: 2511 - protein, 163 aa, Artificial
  Alicyclobacillus acidocaldarius mutated SEQ ID NO 2500
MNAEGTSMLNRVILIGRLTADPELRYTNNGTAVASFTLAVDRMRSGPNGERQTDFINVVVWQKQAEIVAQYLQKGRLAAVDGRLQIRSYENRDGQRVRVAEVVAETVRFLDRGPDQAQGSGYSAAGAQTRQQRPTPSSAPPFEDDPFADDSQLIDISEDDLPF

SEQ ID NO: 2512 - DNA, 492 bp, Artificial
  Alicyclobacillus acidocaldarius mutated SEQ ID NO 2501
gtgaacgcggaggggacgagcatgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaagtggtcgccgaaacggtgaggttcctggaccgcggtccggatcaggcccaggggtcgggctacagtgcggccggcgcgcaaactcggcagcagaaaccgacgccttcgtcggcgcctccgtttgaagacgatccgttcgcggatgacagtcagttgatcgatatctccgaagatgatcttccgttttga

SEQ ID NO: 2513 - DNA, 492 bp, Artificial
  Alicyclobacillus acidocaldarius mutated SEQ ID NO 2501
gtgaacgcggaggggacgagcatgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaagtggtcgccgaaacggtgaggttcctggaccgcggtccggataatgcccaggggtcgggctacagtgcggccggcgcgcaaactcggcagcagcggccgacgccttcgtcggcgcctccgtttgaagacgatccgttcgcggatgacagtcagttgatcgatatctccgaagatgatcttccgttttga

SEQ ID NO: 2514 - DNA, 492 bp, Artificial
  Alicyclobacillus acidocaldarius mutated SEQ ID NO 2501
gtgaacgcggaggggacgagcatgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgatcgaaatctccgaagatgatcttccgttttga

SEQ ID NO: 2515 - DNA, 492 bp, Artificial
  Alicyclobacillus acidocaldarius mutated SEQ ID NO 2501
gtgaacgcggaggggacgagcatgctgaaccgagtgattctgatcggccgcctgacggcggatccggaattgcgatacaccaacaacggcacggccgtcgcgtcgttcacgctcgccgtggaccgcatgaaatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgacaatcgcgacgggcagcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgatcgatatctccgaagatgatcttccgttttga

SEQ ID NO: 2516 - DNA, 492 bp, Artificial
  Alicyclobacillus acidocaldarius mutated SEQ ID NO 2501
gtgaacgcggaggggacgagcatgctgaaccgagtgattctgatcggccgcctgacggcggatccggaattgcgatacaccaacaacggcacggccgtcgcgtcgttcacgctcgccgtggaccgcatgcgatctggaccgaacggtgaacgccagaccgatttcatcaacgtcgtggtgtggcagaagcaggccgagatcgtggcgcaatatctccagaaggggagactcgcggcggtcgacggcaggctgcagatccggagctacgaaaatcgcgacgggcagcgcgttcgcgtggccgaagtggtcgccgaaacggtgaggttcctggaccgcggtccggatcaggcccaggggtcgggctacagtgcggccggcgcgcaaactcggcagcagcggccgacgccttcgtcggcgcctccgtttgaagacgatccgttcgcggatgacagtcagttgatcgatatctccgaagatgatcttccgttttga

SEQ ID NO: 2517 - protein, 785 aa, Alicyclobacillus acidocaldarius
MQMVHPSDTSTGLMERTGQGELRSGRASHALEEWRDRVKTFTVEKRDGRIEPLSLDKIFAFLKRGCEAAEGCDPERLAADVWPQLRDGMRTSEIARVAIQAAVEKTSVAEPGWQFVAARLLLFDAYKQASRNRGYRHLGYGDFYQLIVELERIGRYGTYIRQHYSEDEIAELAAYIKPERDYLFNYVGLKQLLDRYAIRNLDNGIMELPQELFMGVSMHLAMKEKDKVAWAKRFYDMLSTLQATVATPTLSNARKPFHQLSSCFIDMPEDDLVSIYATDEAFARVSKFGGGMGIYVGKIRARGSAIRNHPGASGGVVPWIRNFNNTAVSCNQLGMRAGAAAVYLDVWHKDILDFLQLRTNNGDERMKAHDIFPGVCIPDLFMRRVEERGMWYLFCPYEVRKVMGFSLEDSWGEEFERRYEACVENPNLPRVEIPAIEIMKRIMQSAFETGTPFIFFRDTANRLNPNKHAGMVYCSNLCTEIIQNMSPSRRIEETEEGGIITMKTEAGDFVVCNLSSLNLGRCRDLDSIREIVRRQIRAMDNVIDLNHYPVPQAAVTNRKYRAVGLGVSGYHQYLAEKGIPWESEAHVKHADELFEWINFFAIEASMELAREKGPYPLFEGSDWQTGRYFDLRGYRTRPGGPDWDGLRREVAEHGVRNAYLVAIAPTSSTSLIAGSTAGIDPVYARFFLEEKKNGVVPQTAPNLNDKTFWYYKEAHTIDQRWSIEACAARQRHVDQSQSFNLYITPGISARQFLDLYLLAWKRGLKTVYYVRSKSVEVEDCVACSS

SEQ ID NO: 2518 - DNA, 2358 bp, Alicyclobacillus acidocaldarius
atgcagatggtacacccaagcgacacatccacaggactgatggaacggacgggtcaaggtgagctgcgttcagggcgagcgagccatgcgctggaggagtggcgcgatcgcgtcaagaccttcacggtggaaaagcgggacggacggattgagccgctgtccttagacaaaatcttcgcatttttgaagcgcggctgcgaagcggccgaggggtgcgatccggagcgcctggcggcggacgtgtggccacagctccgggacgggatgcggacgtcggaaattgcgcgcgtcgcgattcaagcggcggtggaaaagacaagcgtcgccgaacccggctggcagtttgtcgcggctcgattgttgcttttcgacgcatacaagcaggcgtcgcgcaaccgaggttatcgtcacctgggttacggggacttttatcagctgatcgtcgagctggagcgaatcgggcggtacggcacgtacatacggcagcactacagcgaggacgagatcgccgagttggccgcctacatcaagccggagcgagattacctgtttaactacgtgggtctgaagcaactgctggatcgctacgcgattcgcaacctggacaacggaatcatggagctgccgcaggagctgttcatgggcgtgtccatgcacctcgccatgaaggagaaggacaaggtcgcctgggcgaagcggttctacgacatgttgtccacgcttcaggccacagtggccacgcccacgctcagcaacgcgcgaaaaccgttccatcaactgagctcttgcttcatcgacatgcccgaggacgatctcgtcagcatctacgccacggacgaggcctttgcgcgcgtctcgaagttcggcggcggcatgggaatctacgtgggcaagattcgggcccgcggatcggccatccggaatcatccgggggcgtcgggcggcgtggtgccttggatccgcaacttcaacaacacggccgtgagctgcaaccagctcggcatgcgcgctggcgcggccgccgtctacctcgacgtctggcacaaggacatcctggacttcctgcagctgcgcacgaacaacggcgacgagcggatgaaggcgcacgacatcttcccgggcgtgtgcatcccggatctcttcatgcggcgcgtggaggagcgcggcatgtggtacctgttctgcccgtacgaggtccgcaaggtcatgggcttctccctggaagacagctggggcgaggaatttgagcggcggtatgaggcgtgcgtggagaatccaaatctgccgcgcgtggagatcccggccatcgaaatcatgaagcggatcatgcagtccgcgttcgagacgggaacgccgttcatcttcttccgcgacacggccaatcgcctcaatccgaacaagcacgcgggcatggtctactgtagcaatttgtgcacggagatcattcaaaacatgagcccgtcgcgccggatcgaagagacggaagagggcgggatcatcacgatgaagacggaagctggcgatttcgtcgtctgcaacctgtcctcgctgaacctggggcggtgccgggatctcgacagcatccgcgagatcgtgcgccggcagattcgcgccatggacaacgtgatcgatctgaaccattaccccgtgccgcaggcggccgtcacgaaccgcaagtaccgggcggtgggcctcggggtgagcggttatcaccaatatctcgcggagaagggcatcccgtgggaatcggaggcccacgtgaagcacgccgacgagctgttcgagtggatcaacttcttcgccatcgaggcgtccatggagctggcgcgcgaaaaaggaccgtacccgctgttcgagggctccgattggcaaaccgggcggtacttcgacctgcgcgggtaccggacgcgcccgggcggaccggactgggatggcctgcgccgcgaggtcgccgagcacggcgtgcgcaacgcgtatcttgtggccatcgcgccgaccagcagcacgagcctgattgcgggcagcacggcgggcatcgacccggtgtacgcgcggtttttcctcgaggagaagaaaaacggcgtcgtaccgcagaccgcgcccaatctgaacgacaagacgttctggtactacaaggaagctcacaccatcgatcagcgctggagcattgaagcgtgcgcggcgcggcagcggcacgtggaccagagccaatcgttcaatctgtacatcacgccgggcatcagcgcgcggcaattcctcgacctatacctgttggcctggaagcggggactgaagactgtgtattacgtccgcagcaagtcggtcgaagtcgaggattgcgtcgcatgttcgtcttga

SEQ ID NO: 2519 - protein, 722 aa, Symbiobacterium thermophilum
PERASEFIAELRPLLHATTDRSQQMDLAARLAAEKTSVEEPDWQYVAARLYLQKLYGEAARNRGYHQPGYGDFYELVRQLHAMGDEAGNRVYGAYMIEAYSEEEIRELGRYIRPERDELFTYVGLLHLADRYLIKGFHGEILELPQERYMHIAMHLASVESDRVTWAKRFYDVLSRQEMTVATPTFRNAATPLPQLSSCFIDTVDDSLQSIYDTNQSFAQVSKHGGGMGIYIGKLRARGSAIRGRKGAAAGVIPWVRNYNDTAVAVDQLGARKGAVSIWLDVWHKEIFEFLALKLNNGDDRMRAHDIFPGVCVPDAFMRAVEQDADWHLFCPHEVRTEMGFSLEDAWGEEWERRYRLCVEAAHADKLDATVVRARQVAKAMLKSQYETGGPFLFFRDTVNRLNPNKHAGMVYCSNLCTEIAQNQSPTRLIEKTDDGEVITYRWQPGDFVVCNLASINLSKVHTEEKIAEVVPLAIRMLDNVIDLNFYPVPQAKITNKKYRAIGLGVHGYHQMLAELGIHWESEDHLRKADEVFELLNYYAVKTSIELAAEKGCYPLCKGSDWETGEYFALRGYESDRWQALRRQAAEVGLRNAYLLAIAPTSSTSLLCGTTASVDPIYDRVYNEGKKDQVIPLAAPGLSPKTYLYYKPAHQIDQTWSIRAAGVRQRHIDQSQSFNLYIRPDIKGRDFLNLYMQAWKNGLKTVYYVRSRSLEVTEAECEACQA

SEQ ID NO: 2520 - protein, 759 aa, Clostridium botulinum
IKKRDGQYEPLQVEKTKKMVKLACEGIEGCDPLELELDSRIQFRDGMTTKEIQRTLIQTAIEKVIQNSKDNNGNNIKKTNANWQYVAARLLCFDLYKEAKISRHYNSFGYGDYYQLVKKLVKIKLYGEYLIQNYSDEEIKELAKYIVPERDELFNYEGLKLLNDRYLIKGNNGEILELPQERFMTIAMHLAIPEGDKKVFYAKKFYDLLSELKVTVATPTLGNAGTPFYQLSSCFISVVGDNLWSIYDVNQKFAQVSKHGGALGIYTGKIRALNSEIRGHKNASGGVVPWIRLYNDTAVAVDQLGKRKGGAAITLDIWHKDIFDFLDLKTNNGDDRRKAHDIFPSVSIPDLFMKRLEKRESWSLFDPYIVEKIMGYKLEDYFDDEDRKEFTNKYLECERNTNIPRDTVPTLDIMKKLMKSAVETGTPFIFFRDTVNKANPNKHKGMIYSSNLCHEIAQNMSESRLLEEEIIDGNGYSEIVQRVKAGDMVTCNLNSINLSKVKKEEFNECIPFQIRMLDNVISLNKLPVKEAKVTSDKYRAIGLGTSGYHHFLANNKIRWESDEHIKVADEIYEEIAYIAIKSSMELAKEKGSYPAFKDSEWETGKYFERRGYNSERWKKLQSNIKKYGMRNGYITAIAPTGSTSNIANTTAGIDPVFKKFFMEEKKGSFTPKTAPDLNEENFWYYKEAHTIDQQWSIKACAVRQKHIDQAQSFNLYITPEIKAKEILNMYIESWKQGVKTIYYVRNKSLEMDECTSCSS

SEQ ID NO: 2521 - protein, 759 aa, Clostridium botulinum
IKKRDGQYEPLQVEKTKKMVKLACEGIEGCDPLELELDSRIQFRDGMTTKEIQRTLIQTAIEKVIQNSKDNNGNNIKKTNANWQYVAARLLCFDLYKEAKISRHYNSFGYGDYYELVKKLVKIKLYGEYLIQNYSDEEIKELAKYIVPERDELFNYEGLKLLNDRYLIKGHNGEILELPQERFMTIAMHLAIPEGDKKVFYAKKFYDLLSELKVTVATPTLGNAGTPFYQLSSCFISVVGDNLWSIYDVNQKFAQVSKHGGALGIYTGKIRALNSEIRGHKNASGGVVPWIRLYNDTAVAVDQLGKRKGGAAITLDIWHKDIFDFLDLKTNNGDDRRKAHDIFPSVSIPDLFMKRLEKRESWSLFDPYIVEKIMGYKLEDYFDDEDRREFTNKYLECERNTNIPRDTVPTLDIMKKLMKSAVETGTPFIFFRDTVNKANPNKHKGMIYSSNLCHEIAQNMSESRLLEEEIIDGNGYPEVVQRVKAGDMVTCNLNSINLSKVKKEEFNECIPFQIRMLDNVISLNKLPVKEAKVTSDKYRAIGLGTSGYHHFLANNKIRWESDEHIKVADEIYEEIAYIAIKSSMELAKEKGSYPAFKDSEWETGKYFERRGYNSERWKKLQSNIKKYGMRNGYITAIAPTGSTSNIANTTAGIDPVFKKFFMEEKKGSFTPKTAPDLNEENFWYYKEAHTIDQQWSIKACAVRQKHIDQAQSFNLYITPEIKAKEILNMYMESWKQGVKTIYYVRNKSLEMDECTSCSS

SEQ ID NO: 2522 - protein, 759 aa, Clostridium botulinum
IKKRDGQYEPLQVEKTKKMVKLACEGIEGCDPLELELDSRIQFRDGMTTKEIQRTLIQTAIEKVIQNSKDNNGNNIKKTNANWQYVAARLLCFDLYKEAKISRHYNSFGYGDYYELVKKLVKIKLYGEYLIQNYSDEEIKELAKYIVPERDELFNYEGLKLLNDRYLIKGHNGEILELPQERFMTIAMHLAIPEGDKKVFYAKKFYDILSELKVTVATPTLGNAGTPFYQLSSCFISVVGDNLWSIYDVNQKFAQVSKHGGALGIYTGKIRALNSEIRGHKNASGGVVPWIRLYNDTAVAVDQLGKRKGGAAITLDIWHKDIFDFLDLKTNNGDDRRKAHDIFPSVSIPDLFMKRLEKRESWSLFDPYIVEKIMGYKLEDYFDDEDRREFTNKYLECERNTNIPRDTVPTLDIMKKLMKSAVETGTPFIFFRDTVNKANPNKHKGMIYSSNLCHEIAQNMSESRLLEEEIIDGNGYSEIVQRVKAGDMVTCNLNSINLSKVKKEEFNECIPFQIRMLDNVISLNKLPVKEAKVTSDKYRAIGLGTSGYHHFLANNKIRWESDEHIKVADEIYEEIAYIAIKSSMELAKEKGSYPAFKDSEWETGKYFERRGYNSERWKKLQSNIKKYGMRNGYITAIAPTGSTSNIANTTAGIDPVFKKFFMEEKKGSFTPKTAPDLNEENFWYYKEAHTIDQQWSIKACAVRQKHIDQAQSFNLYITPEIKAKEILNMYMESWKQGVKTIYYVRNKSLEMDECTSCSS

SEQ ID NO: 2523 - protein, 759 aa, Clostridium botulinum
IKKRDGQYESLQVEKTKKMVKLACEGIEGCDPLELELDSRIQFRDGMTTKEIQRTLIQTAIEKVIQNSKDNNGNNIKKTNANWQYVAARLLCFDLYKEAKISRHYNSFGYGDYYELVKKLVKMKLYGEYLIQNYSDEEIKELAKYIVPERDELFNYEGLKLLNDRYLIKGHNGEILELPQERFMTIAMHLAIPEGDKKVFYAKKFYDLLSELKVTVATPTLGNAGTPFYQLSSCFISVVGDNLWSIYDVNQKFAQVSKHGGALGIYTGKIRALNSEIRGHKNASGGVVPWIRLYNDTAVAVDQLGKRKGGAAITLDIWHKDIFDFLDLKTNNGDDRRKAHDIFPSVSIPDLFMKRLEKRESWSLFDPYIVEKIMGYKLEDYFDDEDCREFTNKYLECERNTNIPRDTVPTLDIMKKLMKSAVETGTPFIFFRDTVNKANPNKHKGMIYSSNLCHEIAQNMSESQLLEEEIIDENGYPEVVQRVKAGDMVTCNLNSINLSKVKKEEFSECIPLQIRMLDNVISLNKLPVKEAKVTSDKYRAIGLGTSGYHHFLANNKISWESDEHIKVADEIYEEIAYIAIESSMELAKEKGSYPAFKGSEWETGKYFERRGYNSERWKKLQSNIKKYGMRNGYITAIAPTGSTSNIANTTAGIDPVFKKFFMEEKKGSFTPKTAPDLNEENFWYYKEAHTIDQQWSIKACAVRQKHIDQAQSFNLYITPEIKAKEILNMYMESWRQGVKTIYYVRNRSLEMDECTSCSS

SEQ ID NO: 2524 - protein, 785 aa, Artificial
  Alicyclobacillus acidocaldarius mutated SEQ ID NO 2517
MQMVHPSDTSTGLMERTGQGELRSGRASHALEEWRDRVKTFTVEKRDGRIEPLSLDKIFAFLKRGCEAADGCDPERLAADVWPQLRDGMRTSEIARVAIQAAVEKTSVAEPGWQFVAARLLLFDAYKQASRNRGYRHLGYGDFYQLIVELERIGRYGTYIRQHYSEDEIAELAAYIKPERDYLFNYVGLKQLLDRYAIRNLDNGIMELPQELFMGVSMHLAMKEKDKVAWAKRFYDMLSTLQATVATPTLSNARKPFHQLSSCFIDMPEDDLVSIYATDEAFARVSKFGGGMGIYVGKIRARGSAIRNHPGASGGVVPWIRNFNNTAVSCNQLGMRAGAAAVYLDVWHKDILDFLQLRTNNGDERMKAHDIFPGVCIPDLFMRRVEERGMWYLFCPYEVRKVMGFSLEDSWGEEFERRYEACVENPNLPRVEIPAIEIMKRIMQSAFETGTPFIFFRDTANRLNPNKHAGMVYCSNLCTEIIQNMSPSRRIEETEEGGIITMKTEAGDFVVCNLSSLNLGRCRDLDSIREIVRRQIRAMDNVIDLNHYPVPQAAVTNRKYRAVGLGVSGYHQYLAEKGIPWESEAHVKHADELFEWINFFAIEASMELAREKGPYPLFEGSDWQTGRYFDLRGYRTRPGGPDWDGLRREVAEHGVRNAYLVAIAPTSSTSLIAGSTAGIDPVYARFFLEEKKNGVVPQTAPNLNDKTFWYYKEAHTIDQRWSIEACAARQRHVDQSQSFNLYITPGISARQFLDLYLLAWKRGLKTVYYVRSKSVEVEDCVACSS

SEQ ID NO: 2525 - protein, 785 aa, Artificial
  Alicyclobacillus acidocaldarius mutated SEQ ID NO 2517
MQMVHPSDTSTGLMERTGQGELRSGRASHALEEWRDRVKTFTVEKRDGRIEPLSLDKIFAFLKRGCEAAEGCDPERLAADVWPQLRDGMRTSEIARVAIQAAVEKTSVAEPGWQFVAARLLLFDAYKQASRNRGYRHLGYGDFYQLIVELERIGRYGTYIRQHYSEDEIAELAAYIKPERDYLFNYVGLKQLLDRYAIRNLDNGIMELPQELFMGVSMHLAMKEKDKVAWAKRFYDMLSTLQATVATPTLSNARKPFHQLSSCFIDMPEDDLVSIYATDEAFARVSKFGGGMGIYVGKIRARGSAIRNHPGASGGVVPWIRNFNNTAVSCNQLGMRAGAAAVYLDVWHKDILDFLQLRTNNGDERMKAHDIFPGVCIPDLFMRRVEERGMWYLFCPYEVRKVMGFSLEDSWGEEFERRYEACVENPNLPRVEIPAIEIMKRIMQSAFETGTPFIFFRDTANRLNPNKHAGMVYCSNLCTEIIQNMSPSRRIEETEEGGIITMKTEAGDFVVCNLSSLNLGRCRDLDSIREIVRRQIRAMDNVIDLNHYPVPQAAVTNRKYRAVGLGVSGYHQYLAEKGIPWESEAHVKHADELFEWINFFAIEASMELAREKGPYPLFEGSDWQTGRYFDLRGYRTRPGGPDWDGLRREVAEHGVRNAYLVAIAPTSSTSLIAGSTAGIDPVYARFFLEEKKNGVVPQTAPNLNDKTFWYYKEAHTIDQRWSIEACAARQRHVDQSQSFNLYITPGISARQFLDLYLIAWKRGLKTVYYVRSKSVEVEDCVACSS

SEQ ID NO: 2526 - protein, 785 aa, Artificial
  Alicyclobacillus acidocaldarius mutated SEQ ID NO 2517
MQMVHPSDTSTGLMERTGQGELRSGRASHALEEWRDRVKTFTVEKRDGRIEPLSLDKIFAFLKRGCEAAEGCDPERLAADVWPQLRDGMRTSEIARVAIQAAVEKTSIAEPGWQFVAARLLLFDAYKQASRNRGYRHLGYGDFYQLIVELERIGRYGTYIRQHYSEDEIAELAAYIKPERDYLFNYVGLKQLLDRYAIRNLDNGIMELPQELFMGVSMHLAMKEKDKVAWAKRFYDMLSTLQATVATPTLSNARKPFHQLSSCFIDMPEDDLVSIYATDEAFARVSKFGGGMGIYVGKIRARGSAIRNHPGASGGVVPWIRNFNNTAVSCNQLGMRAGAAAVYLDVWHKDILDFLQLRTNNGDERMKAHDIFPGVCIPDLFMRRVEERGMWYLFCPYEVRKVMGFSLEDSWGEEFERRYEACVENPNLPRVEIPAIEIMKRIMQSAFETGTPFIFFRDTANRLNPNKHAGMVYCSNLCTEIIQNMSPSRRIEETEEGGIITMKTEAGDFVVCNLSSLNLGRCRDLDSIREIVRRQIRAMDNVIDLNHYPVPQAAVTNRKYRAVGLGVSGYHQYLAEKGIPWESEAHVKHADELFEWINFFAIEASMELAREKGPYPLFEGSDWQTGRYFDLRGYRTRPGGPDWDGLRREVAEHGVRNAYLVAIAPTSSTSLIAGSTAGIDPVYARFFLEEKKNGVVPQTAPNLNDKTFWYYKEAHTIDQRWSIEACAARQRHVDQSQSFNLYITPGISARQFLDLYLLAWKRGLKTVYYVRSKSVEVEDCVACSS

SEQ ID NO: 2527 - protein, 785 aa, Artificial
  Alicyclobacillus acidocaldarius mutated SEQ ID NO 2517
MQMVHPSDTSTGLMERTGQGELRSGRASHALEEWRDRVKTFTVEKRDGRIEPLSLDKIFAFLKRGCEAAEGCDPERLAADVWPQLRDGMRTSEIARVAIQAAVEKTSVAEPGWQFVAARLLLFDAYKQASRNRGYRHLGYGDFYQLIVELDRIGRYGTYIRQHYSEDEIAELAAYIKPERDYLFNYVGLKQLLDRYAIRNLDNGIMELPQELFMGVSMHLAMKEKDKVAWAKRFYDMLSTLQATVATPTLSNARKPFHQLSSCFIDMPEDDLVSIYATDEAFARVSKFGGGMGIYVGKIRARGSAIRNHPGASGGVVPWIRNFNNTAVSCNQLGMRAGAAAVYLDVWHKDILDFLQLRTNNGDERMKAHDIFPGVCIPDLFMRRVEERGMWYLFCPYEVRKVMGFSLEDSWGEEFERRYEACVENPNLPRVEIPAIEIMKRIMQSAFETGTPFIFFRDTANRLNPNKHAGMVYCSNLCTEIIQNMSPSRRIEETEEGGIITMKTEAGDFVVCNLSSLNLGRCRDLDSIREIVRRQIRAMDNVIDLNHYPVPQAAVTNRKYRAVGLGVSGYHQYLAEKGIPWESEAHVKHADELFEWINFFAIEASMELAREKGPYPLFEGSDWQTGRYFDLRGYRTRPGGPDWDGLRREVAEHGVRNAYLVAIAPTSSTSLIAGSTAGIDPVYARFFLEEKKNGVVPQTAPNLNDKTFWYYKEAHTIDQRWSIEACAARQRHVDQSQSFNLYITPGISARQFLDLYLLAWKRGLKTVYYVRSKSVEVEDCVACSS

SEQ ID NO: 2528 - protein, 785 aa, Artificial
  Alicyclobacillus acidocaldarius mutated SEQ ID NO 2517
MQMVHPSDTSTGLMERTGQGELRSGRASHALEEWRDRVKTFTVEKRDGRIEPLSLDKIFAFLKRGCEAAEGCDPERLAADVWPQLRDGMRTSEIARVAIQAAVEKTSVAEPGWQFVAARLLLFDAYKQASRNRGYRHLGYGDFYQLIVELERIGRYGTYIRQHYSEDEIAELAAYIKPERDYLFNYVGLKQLLDRYAIRNLDNGIMELPQELFMGVSMHLAMKEKDKVAWAKRFYDMLSTLQATVATPTLSNARKPFHQLSSCFIDMPEDDLVSIYATDEAFARVSKFGGGMGIYVGKIRARGSAIRNHPGASGGVVPWIRNFNNTAVSCNQLGMRAGAAAVYLDVWHKDILDFLQLRTNNGDERMKAHDIFPGVCIPDLFMRRVEERGMWYLFCPYEVRKIMGFSLEDSWGEEFERRYEACVENPNLPRVEIPAIEIMKRIMQSAFETGTPFIFFRDTANRLNPNKHAGMVYCSNLCTEIIQNMSPSRRIEETEEGGIITMKTEAGDFVVCNLSSLNLGRCRDLDSIREIVRRQIRAMDNVIDLNHYPVPQAAVTNRKYRAVGLGVSGYHQYLAEKGIPWESEAHVKHADELFEWINFFAIEASMELAREKGPYPLFEGSDWQTGRYFDLRGYRTRPGGPDWDGLRREVAEHGVRNAYLVAIAPTSSTSLIAGSTAGIDPVYARFFLEEKKNGVVPQTAPNLNDKTFWYYKEAHTIDQRWSIEACAARQRHVDQSQSFNLYITPGISARQFLDLYLLAWKRGLKTVYYVRSKSVEVEDCVACSS

SEQ ID NO: 2529 - DNA, 2358 bp, Artificial
  Alicyclobacillus acidocaldarius mutated SEQ ID NO 2518
atgcagatggtacacccaagcgacacatccacaggactgatggaacggacgggtcaaggtgagctgcgttcagggcgagcgagccatgcgctggaggagtggcgcgatcgcgtcaagaccttcacggtggaaaagcgggacggacggattgagccgctgtccttagacaaaatcttcgcatttttgaagcgcggctgcgaagcggccgatgggtgcgatccggagcgcctggcggcggacgtgtggccacagctccgggacgggatgcggacgtcggaaattgcgcgcgtcgcgattcaagcggcggtggaaaagacaagcgtcgccgaacccggctggcagtttgtcgcggctcgattgttgcttttcgacgcatacaagcaggcgtcgcgcaaccgaggttatcgtcacctgggttacggggacttttatcagctgatcgtcgagctggagcgaatcgggcggtacggcacgtacatacggcagcactacagcgaggacgagatcgccgagttggccgcctacatcaagccggagcgagattacctgtttaactacgtgggtctgaagcaactgctggatcgctacgcgattcgcaacctggacaacggaatcatggagctgccgcaggagctgttcatgggcgtgtccatgcacctcgccatgaaggagaaggacaaggtcgcctgggcgaagcggttctacgacatgttgtccacgcttcaggccacagtggccacgcccacgctcagcaacgcgcgaaaaccgttccatcaactgagctcttgcttcatcgacatgcccgaggacgatctcgtcagcatctacgccacggacgaggcctttgcgcgcgtctcgaagttcggcggcggcatgggaatctacgtgggcaagattcgggcccgcggatcggccatccggaatcatccgggggcgtcgggcggcgtggtgccttggatccgcaacttcaacaacacggccgtgagctgcaaccagctcggcatgcgcgctggcgcggccgccgtctacctcgacgtctggcacaaggacatcctggacttcctgcagctgcgcacgaacaacggcgacgagcggatgaaggcgcacgacatcttcccgggcgtgtgcatcccggatctcttcatgcggcgcgtggaggagcgcggcatgtggtacctgttctgcccgtacgaggtccgcaaggtcatgggcttctccctggaagacagctggggcgaggaatttgagcggcggtatgaggcgtgcgtggagaatccaaatctgccgcgcgtggagatcccggccatcgaaatcatgaagcggatcatgcagtccgcgttcgagacgggaacgccgttcatcttcttccgcgacacggccaatcgcctcaatccgaacaagcacgcgggcatggtctactgtagcaatttgtgcacggagatcattcaaaacatgagcccgtcgcgccggatcgaagagacggaagagggcgggatcatcacgatgaagacggaagctggcgatttcgtcgtctgcaacctgtcctcgctgaacctggggcggtgccgggatctcgacagcatccgcgagatcgtgcgccggcagattcgcgccatggacaacgtgatcgatctgaaccattaccccgtgccgcaggcggccgtcacgaaccgcaagtaccgggcggtgggcctcggggtgagcggttatcaccaatatctcgcggagaagggcatcccgtgggaatcggaggcccacgtgaagcacgccgacgagctgttcgagtggatcaacttcttcgccatcgaggcgtccatggagctggcgcgcgaaaaaggaccgtacccgctgttcgagggctccgattggcaaaccgggcggtacttcgacctgcgcgggtaccggacgcgcccgggcggaccggactgggatggcctgcgccgcgaggtcgccgagcacggcgtgcgcaacgcgtatcttgtggccatcgcgccgaccagcagcacgagcctgattgcgggcagcacggcgggcatcgacccggtgtacgcgcggtttttcctcgaggagaagaaaaacggcgtcgtaccgcagaccgcgcccaatctgaacgacaagacgttctggtactacaaggaagctcacaccatcgatcagcgctggagcattgaagcgtgcgcggcgcggcagcggcacgtggaccagagccaatcgttcaatctgtacatcacgccgggcatcagcgcgcggcaattcctcgacctatacctgttggcctggaagcggggactgaagactgtgtattacgtccgcagcaagtcggtcgaagtcgaggattgcgtcgcatgttcgtcttga

SEQ ID NO: 2530 - DNA, 2358 bp, Artificial
  Alicyclobacillus acidocaldarius mutated SEQ ID NO 2518
atgcagatggtacacccaagcgacacatccacaggactgatggaacggacgggtcaaggtgagctgcgttcagggcgagcgagccatgcgctggaggagtggcgcgatcgcgtcaagaccttcacggtggaaaagcgggacggacggattgagccgctgtccttagacaaaatcttcgcatttttgaagcgcggctgcgaagcggccgaggggtgcgatccggagcgcctggcggcggacgtgtggccacagctccgggacgggatgcggacgtcggaaattgcgcgcgtcgcgattcaagcggcggtggaaaagacaagcgtcgccgaacccggctggcagtttgtcgcggctcgattgttgcttttcgacgcatacaagcaggcgtcgcgcaaccgaggttatcgtcacctgggttacggggacttttatcagctgatcgtcgagctggagcgaatcgggcggtacggcacgtacatacggcagcactacagcgaggacgagatcgccgagttggccgcctacatcaagccggagcgagattacctgtttaactacgtgggtctgaagcaactgctggatcgctacgcgattcgcaacctggacaacggaatcatggagctgccgcaggagctgttcatgggcgtgtccatgcacctcgccatgaaggagaaggacaaggtcgcctgggcgaagcggttctacgacatgttgtccacgcttcaggccacagtggccacgcccacgctcagcaacgcgcgaaaaccgttccatcaactgagctcttgcttcatcgacatgcccgaggacgatctcgtcagcatctacgccacggacgaggcctttgcgcgcgtctcgaagttcggcggcggcatgggaatctacgtgggcaagattcgggcccgcggatcggccatccggaatcatccgggggcgtcgggcggcgtggtgccttggatccgcaacttcaacaacacggccgtgagctgcaaccagctcggcatgcgcgctggcgcggccgccgtctacctcgacgtctggcacaaggacatcctggacttcctgcagctgcgcacgaacaacggcgacgagcggatgaaggcgcacgacatcttcccgggcgtgtgcatcccggatctcttcatgcggcgcgtggaggagcgcggcatgtggtacctgttctgcccgtacgaggtccgcaaggtcatgggcttctccctggaagacagctggggcgaggaatttgagcggcggtatgaggcgtgcgtggagaatccaaatctgccgcgcgtggagatcccggccatcgaaatcatgaagcggatcatgcagtccgcgttcgagacgggaacgccgttcatcttcttccgcgacacggccaatcgcctcaatccgaacaagcacgcgggcatggtctactgtagcaatttgtgcacggagatcattcaaaacatgagcccgtcgcgccggatcgaagagacggaagagggcgggatcatcacgatgaagacggaagctggcgatttcgtcgtctgcaacctgtcctcgctgaacctggggcggtgccgggatctcgacagcatccgcgagatcgtgcgccggcagattcgcgccatggacaacgtgatcgatctgaaccattaccccgtgccgcaggcggccgtcacgaaccgcaagtaccgggcggtgggcctcggggtgagcggttatcaccaatatctcgcggagaagggcatcccgtgggaatcggaggcccacgtgaagcacgccgacgagctgttcgagtggatcaacttcttcgccatcgaggcgtccatggagctggcgcgcgaaaaaggaccgtacccgctgttcgagggctccgattggcaaaccgggcggtacttcgacctgcgcgggtaccggacgcgcccgggcggaccggactgggatggcctgcgccgcgaggtcgccgagcacggcgtgcgcaacgcgtatcttgtggccatcgcgccgaccagcagcacgagcctgattgcgggcagcacggcgggcatcgacccggtgtacgcgcggtttttcctcgaggagaagaaaaacggcgtcgtaccgcagaccgcgcccaatctgaacgacaagacgttctggtactacaaggaagctcacaccatcgatcagcgctggagcattgaagcgtgcgcggcgcggcagcggcacgtggaccagagccaatcgttcaatctgtacatcacgccgggcatcagcgcgcggcaattcctcgacctatacctgattgcctggaagcggggactgaagactgtgtattacgtccgcagcaagtcggtcgaagtcgaggattgcgtcgcatgttcgtcttga

SEQ ID NO: 2531 - DNA, 2358 bp, Artificial
  Alicyclobacillus acidocaldarius mutated SEQ ID NO 2518
atgcagatggtacacccaagcgacacatccacaggactgatggaacggacgggtcaaggtgagctgcgttcagggcgagcgagccatgcgctggaggagtggcgcgatcgcgtcaagaccttcacggtggaaaagcgggacggacggattgagccgctgtccttagacaaaatcttcgcatttttgaagcgcggctgcgaagcggccgaggggtgcgatccggagcgcctggcggcggacgtgtggccacagctccgggacgggatgcggacgtcggaaattgcgcgcgtcgcgattcaagcggcggtggaaaagacaagcattgccgaacccggctggcagtttgtcgcggctcgattgttgcttttcgacgcatacaagcaggcgtcgcgcaaccgaggttatcgtcacctgggttacggggacttttatcagctgatcgtcgagctggagcgaatcgggcggtacggcacgtacatacggcagcactacagcgaggacgagatcgccgagttggccgcctacatcaagccggagcgagattacctgtttaactacgtgggtctgaagcaactgctggatcgctacgcgattcgcaacctggacaacggaatcatggagctgccgcaggagctgttcatgggcgtgtccatgcacctcgccatgaaggagaaggacaaggtcgcctgggcgaagcggttctacgacatgttgtccacgcttcaggccacagtggccacgcccacgctcagcaacgcgcgaaaaccgttccatcaactgagctcttgcttcatcgacatgcccgaggacgatctcgtcagcatctacgccacggacgaggcctttgcgcgcgtctcgaagttcggcggcggcatgggaatctacgtgggcaagattcgggcccgcggatcggccatccggaatcatccgggggcgtcgggcggcgtggtgccttggatccgcaacttcaacaacacggccgtgagctgcaaccagctcggcatgcgcgctggcgcggccgccgtctacctcgacgtctggcacaaggacatcctggacttcctgcagctgcgcacgaacaacggcgacgagcggatgaaggcgcacgacatcttcccgggcgtgtgcatcccggatctcttcatgcggcgcgtggaggagcgcggcatgtggtacctgttctgcccgtacgaggtccgcaaggtcatgggcttctccctggaagacagctggggcgaggaatttgagcggcggtatgaggcgtgcgtggagaatccaaatctgccgcgcgtggagatcccggccatcgaaatcatgaagcggatcatgcagtccgcgttcgagacgggaacgccgttcatcttcttccgcgacacggccaatcgcctcaatccgaacaagcacgcgggcatggtctactgtagcaatttgtgcacggagatcattcaaaacatgagcccgtcgcgccggatcgaagagacggaagagggcgggatcatcacgatgaagacggaagctggcgatttcgtcgtctgcaacctgtcctcgctgaacctggggcggtgccgggatctcgacagcatccgcgagatcgtgcgccggcagattcgcgccatggacaacgtgatcgatctgaaccattaccccgtgccgcaggcggccgtcacgaaccgcaagtaccgggcggtgggcctcggggtgagcggttatcaccaatatctcgcggagaagggcatcccgtgggaatcggaggcccacgtgaagcacgccgacgagctgttcgagtggatcaacttcttcgccatcgaggcgtccatggagctggcgcgcgaaaaaggaccgtacccgctgttcgagggctccgattggcaaaccgggcggtacttcgacctgcgcgggtaccggacgcgcccgggcggaccggactgggatggcctgcgccgcgaggtcgccgagcacggcgtgcgcaacgcgtatcttgtggccatcgcgccgaccagcagcacgagcctgattgcgggcagcacggcgggcatcgacccggtgtacgcgcggtttttcctcgaggagaagaaaaacggcgtcgtaccgcagaccgcgcccaatctgaacgacaagacgttctggtactacaaggaagctcacaccatcgatcagcgctggagcattgaagcgtgcgcggcgcggcagcggcacgtggaccagagccaatcgttcaatctgtacatcacgccgggcatcagcgcgcggcaattcctcgacctatacctgttggcctggaagcggggactgaagactgtgtattacgtccgcagcaagtcggtcgaagtcgaggattgcgtcgcatgttcgtcttga

SEQ ID NO: 2532 - DNA, 2358 bp, Artificial
  Alicyclobacillus acidocaldarius mutated SEQ ID NO 2518
atgcagatggtacacccaagcgacacatccacaggactgatggaacggacgggtcaaggtgagctgcgttcagggcgagcgagccatgcgctggaggagtggcgcgatcgcgtcaagaccttcacggtggaaaagcgggacggacggattgagccgctgtccttagacaaaatcttcgcatttttgaagcgcggctgcgaagcggccgaggggtgcgatccggagcgcctggcggcggacgtgtggccacagctccgggacgggatgcggacgtcggaaattgcgcgcgtcgcgattcaagcggcggtggaaaagacaagcgtcgccgaacccggctggcagtttgtcgcggctcgattgttgcttttcgacgcatacaagcaggcgtcgcgcaaccgaggttatcgtcacctgggttacggggacttttatcagctgatcgtcgagctggatcgaatcgggcggtacggcacgtacatacggcagcactacagcgaggacgagatcgccgagttggccgcctacatcaagccggagcgagattacctgtttaactacgtgggtctgaagcaactgctggatcgctacgcgattcgcaacctggacaacggaatcatggagctgccgcaggagctgttcatgggcgtgtccatgcacctcgccatgaaggagaaggacaaggtcgcctgggcgaagcggttctacgacatgttgtccacgcttcaggccacagtggccacgcccacgctcagcaacgcgcgaaaaccgttccatcaactgagctcttgcttcatcgacatgcccgaggacgatctcgtcagcatctacgccacggacgaggcctttgcgcgcgtctcgaagttcggcggcggcatgggaatctacgtgggcaagattcgggcccgcggatcggccatccggaatcatccgggggcgtcgggcggcgtggtgccttggatccgcaacttcaacaacacggccgtgagctgcaaccagctcggcatgcgcgctggcgcggccgccgtctacctcgacgtctggcacaaggacatcctggacttcctgcagctgcgcacgaacaacggcgacgagcggatgaaggcgcacgacatcttcccgggcgtgtgcatcccggatctcttcatgcggcgcgtggaggagcgcggcatgtggtacctgttctgcccgtacgaggtccgcaaggtcatgggcttctccctggaagacagctggggcgaggaatttgagcggcggtatgaggcgtgcgtggagaatccaaatctgccgcgcgtggagatcccggccatcgaaatcatgaagcggatcatgcagtccgcgttcgagacgggaacgccgttcatcttcttccgcgacacggccaatcgcctcaatccgaacaagcacgcgggcatggtctactgtagcaatttgtgcacggagatcattcaaaacatgagcccgtcgcgccggatcgaagagacggaagagggcgggatcatcacgatgaagacggaagctggcgatttcgtcgtctgcaacctgtcctcgctgaacctggggcggtgccgggatctcgacagcatccgcgagatcgtgcgccggcagattcgcgccatggacaacgtgatcgatctgaaccattaccccgtgccgcaggcggccgtcacgaaccgcaagtaccgggcggtgggcctcggggtgagcggttatcaccaatatctcgcggagaagggcatcccgtgggaatcggaggcccacgtgaagcacgccgacgagctgttcgagtggatcaacttcttcgccatcgaggcgtccatggagctggcgcgcgaaaaaggaccgtacccgctgttcgagggctccgattggcaaaccgggcggtacttcgacctgcgcgggtaccggacgcgcccgggcggaccggactgggatggcctgcgccgcgaggtcgccgagcacggcgtgcgcaacgcgtatcttgtggccatcgcgccgaccagcagcacgagcctgattgcgggcagcacggcgggcatcgacccggtgtacgcgcggtttttcctcgaggagaagaaaaacggcgtcgtaccgcagaccgcgcccaatctgaacgacaagacgttctggtactacaaggaagctcacaccatcgatcagcgctggagcattgaagcgtgcgcggcgcggcagcggcacgtggaccagagccaatcgttcaatctgtacatcacgccgggcatcagcgcgcggcaattcctcgacctatacctgttggcctggaagcggggactgaagactgtgtattacgtccgcagcaagtcggtcgaagtcgaggattgcgtcgcatgttcgtcttga

SEQ ID NO: 2533 - DNA, 2358 bp, Artificial
  Alicyclobacillus acidocaldarius mutated SEQ ID NO 2518
atgcagatggtacacccaagcgacacatccacaggactgatggaacggacgggtcaaggtgagctgcgttcagggcgagcgagccatgcgctggaggagtggcgcgatcgcgtcaagaccttcacggtggaaaagcgggacggacggattgagccgctgtccttagacaaaatcttcgcatttttgaagcgcggctgcgaagcggccgaggggtgcgatccggagcgcctggcggcggacgtgtggccacagctccgggacgggatgcggacgtcggaaattgcgcgcgtcgcgattcaagcggcggtggaaaagacaagcgtcgccgaacccggctggcagtttgtcgcggctcgattgttgcttttcgacgcatacaagcaggcgtcgcgcaaccgaggttatcgtcacctgggttacggggacttttatcagctgatcgtcgagctggagcgaatcgggcggtacggcacgtacatacggcagcactacagcgaggacgagatcgccgagttggccgcctacatcaagccggagcgagattacctgtttaactacgtgggtctgaagcaactgctggatcgctacgcgattcgcaacctggacaacggaatcatggagctgccgcaggagctgttcatgggcgtgtccatgcacctcgccatgaaggagaaggacaaggtcgcctgggcgaagcggttctacgacatgttgtccacgcttcaggccacagtggccacgcccacgctcagcaacgcgcgaaaaccgttccatcaactgagctcttgcttcatcgacatgcccgaggacgatctcgtcagcatctacgccacggacgaggcctttgcgcgcgtctcgaagttcggcggcggcatgggaatctacgtgggcaagattcgggcccgcggatcggccatccggaatcatccgggggcgtcgggcggcgtggtgccttggatccgcaacttcaacaacacggccgtgagctgcaaccagctcggcatgcgcgctggcgcggccgccgtctacctcgacgtctggcacaaggacatcctggacttcctgcagctgcgcacgaacaacggcgacgagcggatgaaggcgcacgacatcttcccgggcgtgtgcatcccggatctcttcatgcggcgcgtggaggagcgcggcatgtggtacctgttctgcccgtacgaggtccgcaagattatgggcttctccctggaagacagctggggcgaggaatttgagcggcggtatgaggcgtgcgtggagaatccaaatctgccgcgcgtggagatcccggccatcgaaatcatgaagcggatcatgcagtccgcgttcgagacgggaacgccgttcatcttcttccgcgacacggccaatcgcctcaatccgaacaagcacgcgggcatggtctactgtagcaatttgtgcacggagatcattcaaaacatgagcccgtcgcgccggatcgaagagacggaagagggcgggatcatcacgatgaagacggaagctggcgatttcgtcgtctgcaacctgtcctcgctgaacctggggcggtgccgggatctcgacagcatccgcgagatcgtgcgccggcagattcgcgccatggacaacgtgatcgatctgaaccattaccccgtgccgcaggcggccgtcacgaaccgcaagtaccgggcggtgggcctcggggtgagcggttatcaccaatatctcgcggagaagggcatcccgtgggaatcggaggcccacgtgaagcacgccgacgagctgttcgagtggatcaacttcttcgccatcgaggcgtccatggagctggcgcgcgaaaaaggaccgtacccgctgttcgagggctccgattggcaaaccgggcggtacttcgacctgcgcgggtaccggacgcgcccgggcggaccggactgggatggcctgcgccgcgaggtcgccgagcacggcgtgcgcaacgcgtatcttgtggccatcgcgccgaccagcagcacgagcctgattgcgggcagcacggcgggcatcgacccggtgtacgcgcggtttttcctcgaggagaagaaaaacggcgtcgtaccgcagaccgcgcccaatctgaacgacaagacgttctggtactacaaggaagctcacaccatcgatcagcgctggagcattgaagcgtgcgcggcgcggcagcggcacgtggaccagagccaatcgttcaatctgtacatcacgccgggcatcagcgcgcggcaattcctcgacctatacctgttggcctggaagcggggactgaagactgtgtattacgtccgcagcaagtcggtcgaagtcgaggattgcgtcgcatgttcgtcttga

SEQ ID NO: 2534 - protein, 345 aa, Alicyclobacillus acidocaldarius
MQLKRTRLFNAEGDRDWGKRRIIGGNTTNMIELNNIKYEWAYKLYRAMMNNFWIPEEIPLADDARQYDLLSDDERRSYNKVLSFLIFMDSLLTHNLPNINEYITAPEVNLCLTVHAFQEAVHSQSYGYVLDSVVNPATRDQIYNEWRNDDHLLRRNQFITDLFEEFIENPTDRNLMKTIVANYILEGVYFYAGFGFFFVLGRQGKMLGTVSEIKFIQRDELTHLAIFRNLYHEIIRENPGIVTPDMEEEFVEMMRTAVQHEIAWGQYVTQGKIVGLTDALIDAYIKYLANLRLQSLNLPILYPEIKEHPMPWMDSFAAINSHKTDFFEQRVTNYTKAGNLNWDDL

SEQ ID NO: 2535 - DNA, 1038 bp, Alicyclobacillus acidocaldarius
atgcaattgaaacggacgaggctgtttaacgcagagggcgatcgcgactggggcaagcggcgaatcatcggcgggaacaccaccaacatgatcgagctcaacaacatcaagtatgagtgggcctataagctctatcgggccatgatgaataatttctggattccggaagaaatcccgcttgctgatgacgctcgccaatacgatttgttgagcgacgacgaacgaagaagttacaacaaggtcctgtcctttctcatcttcatggacagcctgttgacgcacaatctgcccaatatcaacgagtacatcaccgcgcccgaggtcaacctgtgcctcaccgtgcacgccttccaggaggcggtgcattcgcagtcgtacggctacgtgctcgattccgtggtgaatccggccacgcgcgatcagatctacaacgaatggcgaaatgacgatcacctgctccggcgaaatcagttcatcactgacctgtttgaagagttcatcgagaacccgacggaccgaaatctgatgaagaccatcgtcgcgaactacatcttggagggcgtatacttctacgcggggtttggcttcttcttcgtgctcgggcgtcagggcaagatgctcggcacggtctctgagattaagttcattcagcgagacgagctgacgcatctcgcgattttccgcaacctgtatcacgagatcatccgcgaaaatccgggaattgtcacacccgacatggaagaagagttcgtggagatgatgcgcacggcggtgcagcacgaaatcgcgtggggacagtacgtgacgcaggggaagatcgtggggctgacggacgcgctcatcgacgcgtacatcaaatatcttgcgaatctccggcttcagtcgctgaacctgcccatcctgtatccggagatcaaagaacatccgatgccttggatggacagctttgcagccatcaactcacacaagaccgatttcttcgaacagcgcgtgacgaactacacgaaagctggcaatctcaactgggacgatctgtga

SEQ ID NO: 2536 - protein, 336 aa, Clostridium novyi
IFNENGNRGTESMINGNTTNLREWNRIKYNWANELYRTMLNNFWIPEEISLNEDVKQFPYLTDGERNAFDKIISFLNFLDSVQSENLPNISRYITAPEVSSLLNVQTFQEEIHAQSYSYILDTVTNPITRDKIYDQWREDKNLLERNKFIAGIYQSFNENPTTENFLRTIMANYILEGIYFYSGFSFFYTLARQGKMTATSTIFKYINRDEITHLILFQNIIKELKNENPDIFTESIMEEFRMMMKMGVEHEIKWGQYVTNNEILGINDNLIEKYIKYLSNLRLNAIGLEVLYPEITEHPMEWIENFSKLNNTKTDFFEAKVTNYTKAAAFDFDDL

SEQ ID NO: 2537 - protein, 336 aa, Clostridium botulinum
IFNENGNRGTESIINGSTTNLREWNRIKYNWANELYRNMLNNFWIPEEISLNEDVKQFSYLTDGERNAFDKIISFLNFLDSIQSENLPNISRYITAPEVSSILNIQAFQEEIHAQSYSYILDTVTNPITRDKIYDQWREDKNLLERNKFIAGIYQRFNENPTTENFLRTIMANYILEGIYFYSGFSFFYTLARQGKMTATSTIFKYINRDEITHLILFQNIIKELKNENLDIFTESIIEEFRMMMKTGVEHEIKWGQYVTNNEILGINNNLIEKYIKYLSNLRLNAIGLEVLYPEITEHPMEWIENFSKLNNTKTDFFEAKVTNYTKAAAFDFDDL

SEQ ID NO: 2538 - protein, 341 aa, Clostridium phytofermentans
MEKKKIFNEYGDRGTDCLIKGNTTNLREWNRIKYDWARLIYRTMLNNFWIPEEISLQEDVKQFPYLTDGERNAFDKIIAFLNFLDSIQSENLPNISRYITAPEVSSLLNVQAFQEEIHAQSYSYILDTVTNPVTRDRIYDIWREDKYLLERNKFIANIYQRFSDEPSDENFVRVVFANYILEGIYFYSGFSFFYTLARQGKMTATSTIFKYINRDEITHLVLFQNIMKELRVEQKEMFTKGLEEELREMMRTGVEHEIAWGQYVTDNQILGINNELIDQYIKYLSNQRLRAVGLEILYPEITKHPMEWIESFSNINSTKTDFFEAKVTNYTKAAVFDFDDL

SEQ ID NO: 2539 - protein, 336 aa, Clostridium botulinum
IFNEKGQRGTESMINGNTTNLREWNRIKYSWASDFYRTMLNNFWIPEEISLNEDIKQFPYLTDGERNAFDKIISFLNFLDSVQSENLPNISRYITAAEVSSLLNIQTFQEEIHAQSYSYILDTVTNPITRDKIYDQWREDEHLLERNKFIAGIYEKFNKEPEIHNFLRAIMANYILEGIYFYSGFSFFYTLARQGKMTATSTIFKYINRDEVTHLVLFQNIIKELKNENSHIFTEELEEEFRQMMRMGVEHEIQWGQYVTNNEILGLNDELIEKYIKYLSNLRLVAIGLKPLYPEINKHPMEWIDSFSKLNSTKTDFFEAKVTNYTKAAAFDFDDL

SEQ ID NO: 2540 - protein, 336 aa, Clostridium botulinum
IFNEKGQRGTESMINGNTTNLREWNRIKYSWASDFYRTMLNNFWIPEEISLNEDIKQFPYLTDGERNAFDKIISFLNFLDSVQSENLPNISRYITAAEVSSLLNIQTFQEEIHAQSYSYILDTVTNPITRDKIYDQWREDEHLLERNKFIAGIYEKFNKEPEIHNFLRAIMANYILEGIYFYSGFSFFYTLARQGKMTATSTIFKYINRDEVTHLVLFQNIIKELKNENLHIFTEELEEEFRQMMRMGVEHEIQWGQYVTNNEILGLNDELIEKYIKYLSNLRLVAIGLKPLYPEINKHPMEWIDSFSKLNSTKTDFFEAKVTNYTKAAAFDFDDL

SEQ ID NO: 2541 - protein, 345 aa, Artificial
  Alicyclobacillus acidocaldarius mutated SEQ ID NO 2534
MQLKRTRLFNAEGDRDWGKRRIIGGNTTNMIEINNIKYEWAYKLYRAMMNNFWIPEEIPLADDARQYDLLSDDERRSYNKVLSFLIFMDSLLTHNLPNINEYITAPEVNLCLTVHAFQEAVHSQSYGYVLDSVVNPATRDQIYNEWRNDDHLLRRNQFITDLFEEFIENPTDRNLMKTIVANYILEGVYFYAGFGFFFVLGRQGKMLGTVSEIKFIQRDELTHLAIFRNLYHEIIRENPGIVTPDMEEEFVEMMRTAVQHEIAWGQYVTQGKIVGLTDALIDAYIKYLANLRLQSLNLPILYPEIKEHPMPWMDSFAAINSHKTDFFEQRVTNYTKAGNLNWDDL

SEQ ID NO: 2542 - protein, 345 aa, Artificial
  Alicyclobacillus acidocaldarius mutated SEQ ID NO 2534
MQLKRTRLFNAEGDRDWGKRRIIGGNTTNMLELNNIKYEWAYKLYRAMMNNFWIPEEIPLADDARQYDLLSDDERRSYNKVLSFLIFMDSLLTHNLPNINEYITAPEVNLCLTVHAFQEAVHSQSYGYVLDSVVNPATRDQIYNEWRNDDHLLRRNQFITDLFEEFIENPTDRNLMKTIVANYILEGVYFYAGFGFFFVLGRQGKMLGTVSEIKFIQRDELTHLAIFRNLYHEIIRENPGIVTPDMEEEFVEMMRTAVQHEIAWGQYVTQGKIVGLTDALIDAYIKYLANLRLQSLNLPILYPEIKEHPMPWMDSFAAINSHKTDFFEQRVTNYTKAGNLNWDDL

SEQ ID NO: 2543 - protein, 345 aa, Artificial
  Alicyclobacillus acidocaldarius mutated SEQ ID NO 2534
MQLKRTRLFNAEGDRDWGKRRIIGGNTTNMIELNNIKYEWAYKLYRAMMNNFWIPEEIPLADDARQYDLLSDDERRSYNKVLSFLIFMDSLLTHNLPNINEYITAPEVNLCLTVHAFQEAVHSQSYGYVLDSVVNPATRDQIYNEWRNDDHLLRRNQFITDLFEEFIENPTDRNLMKTIVANYILEGVYFYAGFGFFFVLGRQGKMLGTVSEIKFIQRDELTHLAIFRNLYHEIIKENPGIVTPDMEEEFVEMMRTAVQHEIAWGQYVTQGKIVGLTDALIDAYIKYLANLRLQSLNLPILYPEIKEHPMPWMDSFAAINSHKTDFFEQRVTNYTKAGNLNWDDL

SEQ ID NO: 2544 - protein, 345 aa, Artificial
  Alicyclobacillus acidocaldarius mutated SEQ ID NO 2534
MQLKRTRLFNADGDRDWGKRRIIGGNTTNMIELNNIKYEWAYKLYRAMMNNFWIPEEIPLADDARQYDLLSDDERRSYNKVLSFLIFMDSLLTHNLPNINEYITAPEVNLCLTVHAFQEAVHSQSYGYVLDSVVNPATRDQIYNEWRNDDHLLRRNQFITDLFEEFIENPTDRNLMKTIVANYILEGVYFYAGFGFFFVLGRQGKMLGTVSEIKFIQRDELTHLAIFRNLYHEIIRENPGIVTPDMEEEFVEMMRTAVQHEIAWGQYVTQGKIVGLTDALIDAYIKYLANLRLQSLNLPILYPEIKEHPMPWMDSFAAINSHKTDFFEQRVTNYTKAGNLNWDDL

SEQ ID NO: 2545 - protein, 345 aa, Artificial
  Alicyclobacillus acidocaldarius mutated SEQ ID NO 2534
MQLKKTRLFNAEGDRDWGKRRIIGGNTTNMIELNNIKYEWAYKLYRAMMNNFWIPEEIPLADDARQYDLLSDDERRSYNKVLSFLIFMDSLLTHNLPNINEYITAPEVNLCLTVHAFQEAVHSQSYGYVLDSVVNPATRDQIYNEWRNDDHLLRRNQFITDLFEEFIENPTDRNLMKTIVANYILEGVYFYAGFGFFFVLGRQGKMLGTVSEIKFIQRDELTHLAIFRNLYHEIIRENPGIVTPDMEEEFVEMMRTAVQHEIAWGQYVTQGKIVGLTDALIDAYIKYLANLRLQSLNLPILYPEIKEHPMPWMDSFAAINSHKTDFFEQRVTNYTKAGNLNWDDL

SEQ ID NO: 2546 - DNA, 1038 bp, Artificial
  Alicyclobacillus acidocaldarius mutated SEQ ID NO 2535
atgcaattgaaacggacgaggctgtttaacgcagagggcgatcgcgactggggcaagcggcgaatcatcggcgggaacaccaccaacatgatcgagattaacaacatcaagtatgagtgggcctataagctctatcgggccatgatgaataatttctggattccggaagaaatcccgcttgctgatgacgctcgccaatacgatttgttgagcgacgacgaacgaagaagttacaacaaggtcctgtcctttctcatcttcatggacagcctgttgacgcacaatctgcccaatatcaacgagtacatcaccgcgcccgaggtcaacctgtgcctcaccgtgcacgccttccaggaggcggtgcattcgcagtcgtacggctacgtgctcgattccgtggtgaatccggccacgcgcgatcagatctacaacgaatggcgaaatgacgatcacctgctccggcgaaatcagttcatcactgacctgtttgaagagttcatcgagaacccgacggaccgaaatctgatgaagaccatcgtcgcgaactacatcttggagggcgtatacttctacgcggggtttggcttcttcttcgtgctcgggcgtcagggcaagatgctcggcacggtctctgagattaagttcattcagcgagacgagctgacgcatctcgcgattttccgcaacctgtatcacgagatcatccgcgaaaatccgggaattgtcacacccgacatggaagaagagttcgtggagatgatgcgcacggcggtgcagcacgaaatcgcgtggggacagtacgtgacgcaggggaagatcgtggggctgacggacgcgctcatcgacgcgtacatcaaatatcttgcgaatctccggcttcagtcgctgaacctgcccatcctgtatccggagatcaaagaacatccgatgccttggatggacagctttgcagccatcaactcacacaagaccgatttcttcgaacagcgcgtgacgaactacacgaaagctggcaatctcaactgggacgatctgtga

SEQ ID NO: 2547 - DNA, 1038 bp, Artificial
  Alicyclobacillus acidocaldarius mutated SEQ ID NO 2535
atgcaattgaaacggacgaggctgtttaacgcagagggcgatcgcgactggggcaagcggcgaatcatcggcgggaacaccaccaacatgttagagctcaacaacatcaagtatgagtgggcctataagctctatcgggccatgatgaataatttctggattccggaagaaatcccgcttgctgatgacgctcgccaatacgatttgttgagcgacgacgaacgaagaagttacaacaaggtcctgtcctttctcatcttcatggacagcctgttgacgcacaatctgcccaatatcaacgagtacatcaccgcgcccgaggtcaacctgtgcctcaccgtgcacgccttccaggaggcggtgcattcgcagtcgtacggctacgtgctcgattccgtggtgaatccggccacgcgcgatcagatctacaacgaatggcgaaatgacgatcacctgctccggcgaaatcagttcatcactgacctgtttgaagagttcatcgagaacccgacggaccgaaatctgatgaagaccatcgtcgcgaactacatcttggagggcgtatacttctacgcggggtttggcttcttcttcgtgctcgggcgtcagggcaagatgctcggcacggtctctgagattaagttcattcagcgagacgagctgacgcatctcgcgattttccgcaacctgtatcacgagatcatccgcgaaaatccgggaattgtcacacccgacatggaagaagagttcgtggagatgatgcgcacggcggtgcagcacgaaatcgcgtggggacagtacgtgacgcaggggaagatcgtggggctgacggacgcgctcatcgacgcgtacatcaaatatcttgcgaatctccggcttcagtcgctgaacctgcccatcctgtatccggagatcaaagaacatccgatgccttggatggacagctttgcagccatcaactcacacaagaccgatttcttcgaacagcgcgtgacgaactacacgaaagctggcaatctcaactgggacgatctgtga

SEQ ID NO: 2548 - DNA, 1038 bp, Artificial
  Alicyclobacillus acidocaldarius mutated SEQ ID NO 2535
atgcaattgaaacggacgaggctgtttaacgcagagggcgatcgcgactggggcaagcggcgaatcatcggcgggaacaccaccaacatgatcgagctcaacaacatcaagtatgagtgggcctataagctctatcgggccatgatgaataatttctggattccggaagaaatcccgcttgctgatgacgctcgccaatacgatttgttgagcgacgacgaacgaagaagttacaacaaggtcctgtcctttctcatcttcatggacagcctgttgacgcacaatctgcccaatatcaacgagtacatcaccgcgcccgaggtcaacctgtgcctcaccgtgcacgccttccaggaggcggtgcattcgcagtcgtacggctacgtgctcgattccgtggtgaatccggccacgcgcgatcagatctacaacgaatggcgaaatgacgatcacctgctccggcgaaatcagttcatcactgacctgtttgaagagttcatcgagaacccgacggaccgaaatctgatgaagaccatcgtcgcgaactacatcttggagggcgtatacttctacgcggggtttggcttcttcttcgtgctcgggcgtcagggcaagatgctcggcacggtctctgagattaagttcattcagcgagacgagctgacgcatctcgcgattttccgcaacctgtatcacgagatcatcaaagaaaatccgggaattgtcacacccgacatggaagaagagttcgtggagatgatgcgcacggcggtgcagcacgaaatcgcgtggggacagtacgtgacgcaggggaagatcgtggggctgacggacgcgctcatcgacgcgtacatcaaatatcttgcgaatctccggcttcagtcgctgaacctgcccatcctgtatccggagatcaaagaacatccgatgccttggatggacagctttgcagccatcaactcacacaagaccgatttcttcgaacagcgcgtgacgaactacacgaaagctggcaatctcaactgggacgatctgtga

SEQ ID NO: 2549 - DNA, 1038 bp, Artificial
  Alicyclobacillus acidocaldarius mutated SEQ ID NO 2535
atgcaattgaaacggacgaggctgtttaacgcagatggcgatcgcgactggggcaagcggcgaatcatcggcgggaacaccaccaacatgatcgagctcaacaacatcaagtatgagtgggcctataagctctatcgggccatgatgaataatttctggattccggaagaaatcccgcttgctgatgacgctcgccaatacgatttgttgagcgacgacgaacgaagaagttacaacaaggtcctgtcctttctcatcttcatggacagcctgttgacgcacaatctgcccaatatcaacgagtacatcaccgcgcccgaggtcaacctgtgcctcaccgtgcacgccttccaggaggcggtgcattcgcagtcgtacggctacgtgctcgattccgtggtgaatccggccacgcgcgatcagatctacaacgaatggcgaaatgacgatcacctgctccggcgaaatcagttcatcactgacctgtttgaagagttcatcgagaacccgacggaccgaaatctgatgaagaccatcgtcgcgaactacatcttggagggcgtatacttctacgcggggtttggcttcttcttcgtgctcgggcgtcagggcaagatgctcggcacggtctctgagattaagttcattcagcgagacgagctgacgcatctcgcgattttccgcaacctgtatcacgagatcatccgcgaaaatccgggaattgtcacacccgacatggaagaagagttcgtggagatgatgcgcacggcggtgcagcacgaaatcgcgtggggacagtacgtgacgcaggggaagatcgtggggctgacggacgcgctcatcgacgcgtacatcaaatatcttgcgaatctccggcttcagtcgctgaacctgcccatcctgtatccggagatcaaagaacatccgatgccttggatggacagctttgcagccatcaactcacacaagaccgatttcttcgaacagcgcgtgacgaactacacgaaagctggcaatctcaactgggacgatctgtga

SEQ ID NO: 2550 - DNA, 1038 bp, Artificial
  Alicyclobacillus acidocaldarius mutated SEQ ID NO 2535
atgcaattgaaaaaaacgaggctgtttaacgcagagggcgatcgcgactggggcaagcggcgaatcatcggcgggaacaccaccaacatgatcgagctcaacaacatcaagtatgagtgggcctataagctctatcgggccatgatgaataatttctggattccggaagaaatcccgcttgctgatgacgctcgccaatacgatttgttgagcgacgacgaacgaagaagttacaacaaggtcctgtcctttctcatcttcatggacagcctgttgacgcacaatctgcccaatatcaacgagtacatcaccgcgcccgaggtcaacctgtgcctcaccgtgcacgccttccaggaggcggtgcattcgcagtcgtacggctacgtgctcgattccgtggtgaatccggccacgcgcgatcagatctacaacgaatggcgaaatgacgatcacctgctccggcgaaatcagttcatcactgacctgtttgaagagttcatcgagaacccgacggaccgaaatctgatgaagaccatcgtcgcgaactacatcttggagggcgtatacttctacgcggggtttggcttcttcttcgtgctcgggcgtcagggcaagatgctcggcacggtctctgagattaagttcattcagcgagacgagctgacgcatctcgcgattttccgcaacctgtatcacgagatcatccgcgaaaatccgggaattgtcacacccgacatggaagaagagttcgtggagatgatgcgcacggcggtgcagcacgaaatcgcgtggggacagtacgtgacgcaggggaagatcgtggggctgacggacgcgctcatcgacgcgtacatcaaatatcttgcgaatctccggcttcagtcgctgaacctgcccatcctgtatccggagatcaaagaacatccgatgccttggatggacagctttgcagccatcaactcacacaagaccgatttcttcgaacagcgcgtgacgaactacacgaaagctggcaatctcaactgggacgatctgtga

SEQ ID NO: 2551 - protein, 282 aa, Alicyclobacillus acidocaldarius
MDLWARSRPRSDSVSPHALPNGALSARGGERMEPSGRQGGNSDYLSAPFVAVPCDLLRRFAQLGLHPHELVVLLQILASGQTEGTTELSPHELGERCGMSSKEVMACVERLVTEGFLAIGERYDDQGAHVTYFDLQPLWDKLKGRRRMVQPPPAEKDLVSLFEEEFGRPLSSLECDQLRAWLGEHGYPEWLVVEALKESVLANKYSFRYIDRVLYNWQKNNVRSRQDLEQYRAQYRERQAQWRGEPQAGQSKPRSRPASPRTAAREPVRDERYASFYELFPD

SEQ ID NO: 2552 - DNA, 849 bp, Alicyclobacillus acidocaldarius
atggatctgtgggctcgatcacgtccgagaagcgattctgtttccccgcatgctctaccgaatggcgccttaagcgcaaggggaggcgagcgaatggaaccttcgggccggcaaggtggcaacagcgactacctgagtgctccgtttgtcgccgtgccgtgcgatcttctgcggcgcttcgctcagctcggcctgcacccgcatgagctcgtcgtgctgttgcagatcctcgcgagcgggcagacggagggcacgacggaactatccccgcacgaactgggcgagcgctgtggcatgtcgagcaaagaggtcatggcgtgtgtggagcggctcgtcacggaaggttttctcgccatcggcgagcggtacgacgatcagggggcgcacgtgacctacttcgatctgcagccgctatgggacaagctgaaggggcgccggcgcatggtgcagcctccgcctgccgagaaggatctcgtcagcctgttcgaggaggaattcggccgtcccctctcctccctggagtgcgaccagctcagggcgtggctcggcgaacacggctaccccgagtggctcgtcgtcgaagcgctgaaagaaagcgtgttggccaacaaatatagttttcgctacatcgatcgggtcctgtacaactggcagaagaacaacgttcgctcgcggcaagatctcgaacagtaccgcgcgcaataccgcgaaagacaggctcaatggcgtggcgagccccaggccggccagtcgaagccgagatcgcgacccgcctctccgcgcacagctgcacgcgagcccgtgcgcgacgagcgatacgccagtttctatgaactctttcccgactga

SEQ ID NO: 2553 - protein, 189 aa, Geobacillus kaustophilus
AEWLAQGSIAVPKLLLGHYKQLGLGEGELVLLLHMQSFFEEGVLFPTPAELAERMTVSAAECMEMVRRLLQKGMIAIEEHTDEQGIRNEKYTLEPLWEKLVHHLYTQAAQQGELGRQEEEESLYTVFEQEFGRPLSPFECETLAMWIDQDGHEPAIIKAALREAVLSGKLNFRYIDRILFEWKKNGIRT

SEQ ID NO: 2554 - protein, 189 aa, Geobacillus thermodenitrificans
AEWLAQGSVVVPKLLLDHYKQLGLSEGELVLLLHMQSFLEEGIVFPTPAELAEKMTVSAAECMEMVRRLLQKGMVGIEEHTDERGVRGEKYTLEPLWEQLVHHLYAQTVKDGQIGQQKEEESLYTIFEQEFGRPLSPFECETLSMWIDQDGHEPAIIKAALREAVLSGKLNFRYIDRILFEWKKNGIRT

SEQ ID NO: 2555 - protein, 180 aa, Bacillus amyloliquefaciens
SIPNLLLTHYRQLGLNETELILLLKIKMHLEKGSYFPTPFELQSGMSISAEECTSCLRMFIQKGFLFIEECEDHNGIKFEKYSLQPLWAKLYDYMQHSQNETQERTSEREQKSLYTIFEEEFGRPLSPLECETLAIWQDQDQHDAILIKHALKEAVLSGKLSFRYIDRILFEWKKNGFKT

SEQ ID NO: 2556 - protein, 181 aa, Bacillus coagulans
LTVPQLLLKKYKQLGLNETELVLLLQVYSFLKEGNAFPTPEDLAGRLTIPESMCVSILRRLIQHQFLSIEEGEGEGGILYEKYSIMPLWAKLADEFIYEKKQDELEKSVNEETDLYTTFEQEFGRPLSPLECETLAMWIDQDGQSPDLIKAALREAVISGKLNFRYIDRILFEWKKNGIRT

SEQ ID NO: 2557 - protein, 179 aa, Bacillus subtilis
IPNLLLTHYKQLGLNETELILLLKIKMHLEKGSYFPTPNQLQEGMSISVEECTNRLRMFIQKGFLFIEECEDQNGIKFEKYSLQPLWGKLYEYIQLAQTQTQERKAEGEQKSLYTIFEEEFARPLSPLECETLAIWQDQDQHDAQLIKHALKEAVLSGKLSFRYIDRILFEWKKNGLKT

SEQ ID NO: 2558 - protein, 282 aa, Artificial
  Alicyclobacillus acidocaldarius mutated SEQ ID NO 2551
MDLWARSRPRSDSVSPHALPNGALSARGGERMEPSGRQGGNSDYISAPFVAVPCDLLRRFAQLGLHPHELVVLLQILASGQTEGTTELSPHELGERCGMSSKEVMACVERLVTEGFLAIGERYDDQGAHVTYFDLQPLWDKLKGRRRMVQPPPAEKDLVSLFEEEFGRPLSSLECDQLRAWLGEHGYPEWLVVEALKESVLANKYSFRYIDRVLYNWQKNNVRSRQDLEQYRAQYRERQAQWRGEPQAGQSKPRSRPASPRTAAREPVRDERYASFYELFPD

SEQ ID NO: 2559 - protein, 282 aa, Artificial
  Alicyclobacillus acidocaldarius mutated SEQ ID NO 2551
MDLWARSRPRSDSVSPHALPNGALSARGGERMEPSGRQGGNSDYLSAPFVAVPCDLLRRFAQLGLHPHELVVLLQILASGQTEGTTELSPHELGERCGMSSKEVMACVERLVTEGFLAIGERYDDQGAHVTYFDLQPLWDKLKGRRRMVQPPPAEKDLVSLFEEEFGRPLSSLECDQLRAWLGEHGYPEWLVVEALKESVLANKYSFRYIDRVLYNWQKNNVRSRQDLENYRAQYRERQAQWRGEPQAGQSKPRSRPASPRTAAREPVRDERYASFYELFPD

SEQ ID NO: 2560 - protein, 282 aa, Artificial
  Alicyclobacillus acidocaldarius mutated SEQ ID NO 2551
MDLWARSRPRSDSVSPHALPNGALSARGGERMEPSGRQGGNSDYLSAPFVAVPCDLLRRFAQLGLHPHELVVLLQILASGQTEGTTELSPHELGERCGMSSKEVMACVERLVTEGFLAIGERYDDQGAHVTYFDLQPLWDKLKGRRRMVQPPPAEKDLVSLFEEEFGRPLSSLECDQLRAWLGEHGYPEWLVVEALKESVLANKYSFRYIDRVLYNWQKNNVRSRQDIEQYRAQYRERQAQWRGEPQAGQSKPRSRPASPRTAAREPVRDERYASFYELFPD

SEQ ID NO: 2561 - protein, 282 aa, Artificial
  Alicyclobacillus acidocaldarius mutated SEQ ID NO 2551
MDLWARSRPRSDSVSPHALPNGALSARGGERMEPSGRQGGNSDYLSAPFVAVPCDLLRRFAQLGLHPHELVVLLQILASGQTEGTTELSPHELGERCGMSSKEVMACVERLVTEGFLAIGERYDDQGAHVTYFDLQPLWDKLKGRRRMVNPPPAEKDLVSLFEEEFGRPLSSLECDQLRAWLGEHGYPEWLVVEALKESVLANKYSFRYIDRVLYNWQKNNVRSRQDLEQYRAQYRERQAQWRGEPQAGQSKPRSRPASPRTAAREPVRDERYASFYELFPD

SEQ ID NO: 2562 - protein, 282 aa, Artificial
  Alicyclobacillus acidocaldarius mutated SEQ ID NO 2551
MDLWARSRPRSDSVSPHALPNGALSARGGERMEPSGRQGGNSDYLSAPFVAVPCDLLRRFAQLGLHPHELVVLLQILASGQTEGTTELSPHELGERCGMSSKEVMACVERLVTEGFLAIGERYDDQGAHVTYFDLQPLWDKLKGRRRMVQPPPAEKDLVSLFEEEFGRPLSSLECDQLRAWLGEHGYPEWLVVEALKESVLANKYSFRYIDRVLYNWQKNNVRSRQDLEQYRAQYRERQAQWRGDPQAGQSKPRSRPASPRTAAREPVRDERYASFYELFPD

SEQ ID NO: 2563 - DNA, 849 bp, Artificial
  Alicyclobacillus acidocaldarius mutated SEQ ID NO 2552
atggatctgtgggctcgatcacgtccgagaagcgattctgtttccccgcatgctctaccgaatggcgccttaagcgcaaggggaggcgagcgaatggaaccttcgggccggcaaggtggcaacagcgactacattagtgctccgtttgtcgccgtgccgtgcgatcttctgcggcgcttcgctcagctcggcctgcacccgcatgagctcgtcgtgctgttgcagatcctcgcgagcgggcagacggagggcacgacggaactatccccgcacgaactgggcgagcgctgtggcatgtcgagcaaagaggtcatggcgtgtgtggagcggctcgtcacggaaggttttctcgccatcggcgagcggtacgacgatcagggggcgcacgtgacctacttcgatctgcagccgctatgggacaagctgaaggggcgccggcgcatggtgcagcctccgcctgccgagaaggatctcgtcagcctgttcgaggaggaattcggccgtcccctctcctccctggagtgcgaccagctcagggcgtggctcggcgaacacggctaccccgagtggctcgtcgtcgaagcgctgaaagaaagcgtgttggccaacaaatatagttttcgctacatcgatcgggtcctgtacaactggcagaagaacaacgttcgctcgcggcaagatctcgaacagtaccgcgcgcaataccgcgaaagacaggctcaatggcgtggcgagccccaggccggccagtcgaagccgagatcgcgacccgcctctccgcgcacagctgcacgcgagcccgtgcgcgacgagcgatacgccagtttctatgaactctttcccgactga

SEQ ID NO: 2564 - DNA, 849 bp, Artificial
  Alicyclobacillus acidocaldarius mutated SEQ ID NO 2552
atggatctgtgggctcgatcacgtccgagaagcgattctgtttccccgcatgctctaccgaatggcgccttaagcgcaaggggaggcgagcgaatggaaccttcgggccggcaaggtggcaacagcgactacctgagtgctccgtttgtcgccgtgccgtgcgatcttctgcggcgcttcgctcagctcggcctgcacccgcatgagctcgtcgtgctgttgcagatcctcgcgagcgggcagacggagggcacgacggaactatccccgcacgaactgggcgagcgctgtggcatgtcgagcaaagaggtcatggcgtgtgtggagcggctcgtcacggaaggttttctcgccatcggcgagcggtacgacgatcagggggcgcacgtgacctacttcgatctgcagccgctatgggacaagctgaaggggcgccggcgcatggtgcagcctccgcctgccgagaaggatctcgtcagcctgttcgaggaggaattcggccgtcccctctcctccctggagtgcgaccagctcagggcgtggctcggcgaacacggctaccccgagtggctcgtcgtcgaagcgctgaaagaaagcgtgttggccaacaaatatagttttcgctacatcgatcgggtcctgtacaactggcagaagaacaacgttcgctcgcggcaagatctcgaaaattaccgcgcgcaataccgcgaaagacaggctcaatggcgtggcgagccccaggccggccagtcgaagccgagatcgcgacccgcctctccgcgcacagctgcacgcgagcccgtgcgcgacgagcgatacgccagtttctatgaactctttcccgactga

SEQ ID NO: 2565 - DNA, 849 bp, Artificial
  Alicyclobacillus acidocaldarius mutated SEQ ID NO 2552
atggatctgtgggctcgatcacgtccgagaagcgattctgtttccccgcatgctctaccgaatggcgccttaagcgcaaggggaggcgagcgaatggaaccttcgggccggcaaggtggcaacagcgactacctgagtgctccgtttgtcgccgtgccgtgcgatcttctgcggcgcttcgctcagctcggcctgcacccgcatgagctcgtcgtgctgttgcagatcctcgcgagcgggcagacggagggcacgacggaactatccccgcacgaactgggcgagcgctgtggcatgtcgagcaaagaggtcatggcgtgtgtggagcggctcgtcacggaaggttttctcgccatcggcgagcggtacgacgatcagggggcgcacgtgacctacttcgatctgcagccgctatgggacaagctgaaggggcgccggcgcatggtgcagcctccgcctgccgagaaggatctcgtcagcctgttcgaggaggaattcggccgtcccctctcctccctggagtgcgaccagctcagggcgtggctcggcgaacacggctaccccgagtggctcgtcgtcgaagcgctgaaagaaagcgtgttggccaacaaatatagttttcgctacatcgatcgggtcctgtacaactggcagaagaacaacgttcgctcgcggcaagatattgaacagtaccgcgcgcaataccgcgaaagacaggctcaatggcgtggcgagccccaggccggccagtcgaagccgagatcgcgacccgcctctccgcgcacagctgcacgcgagcccgtgcgcgacgagcgatacgccagtttctatgaactctttcccgactga

SEQ ID NO: 2566 - DNA, 849 bp, Artificial
  Alicyclobacillus acidocaldarius mutated SEQ ID NO 2552
atggatctgtgggctcgatcacgtccgagaagcgattctgtttccccgcatgctctaccgaatggcgccttaagcgcaaggggaggcgagcgaatggaaccttcgggccggcaaggtggcaacagcgactacctgagtgctccgtttgtcgccgtgccgtgcgatcttctgcggcgcttcgctcagctcggcctgcacccgcatgagctcgtcgtgctgttgcagatcctcgcgagcgggcagacggagggcacgacggaactatccccgcacgaactgggcgagcgctgtggcatgtcgagcaaagaggtcatggcgtgtgtggagcggctcgtcacggaaggttttctcgccatcggcgagcggtacgacgatcagggggcgcacgtgacctacttcgatctgcagccgctatgggacaagctgaaggggcgccggcgcatggtgaatcctccgcctgccgagaaggatctcgtcagcctgttcgaggaggaattcggccgtcccctctcctccctggagtgcgaccagctcagggcgtggctcggcgaacacggctaccccgagtggctcgtcgtcgaagcgctgaaagaaagcgtgttggccaacaaatatagttttcgctacatcgatcgggtcctgtacaactggcagaagaacaacgttcgctcgcggcaagatctcgaacagtaccgcgcgcaataccgcgaaagacaggctcaatggcgtggcgagccccaggccggccagtcgaagccgagatcgcgacccgcctctccgcgcacagctgcacgcgagcccgtgcgcgacgagcgatacgccagtttctatgaactctttcccgactga

SEQ ID NO: 2567 - DNA, 849 bp, Artificial
  Alicyclobacillus acidocaldarius mutated SEQ ID NO 2552
atggatctgtgggctcgatcacgtccgagaagcgattctgtttccccgcatgctctaccgaatggcgccttaagcgcaaggggaggcgagcgaatggaaccttcgggccggcaaggtggcaacagcgactacctgagtgctccgtttgtcgccgtgccgtgcgatcttctgcggcgcttcgctcagctcggcctgcacccgcatgagctcgtcgtgctgttgcagatcctcgcgagcgggcagacggagggcacgacggaactatccccgcacgaactgggcgagcgctgtggcatgtcgagcaaagaggtcatggcgtgtgtggagcggctcgtcacggaaggttttctcgccatcggcgagcggtacgacgatcagggggcgcacgtgacctacttcgatctgcagccgctatgggacaagctgaaggggcgccggcgcatggtgcagcctccgcctgccgagaaggatctcgtcagcctgttcgaggaggaattcggccgtcccctctcctccctggagtgcgaccagctcagggcgtggctcggcgaacacggctaccccgagtggctcgtcgtcgaagcgctgaaagaaagcgtgttggccaacaaatatagttttcgctacatcgatcgggtcctgtacaactggcagaagaacaacgttcgctcgcggcaagatctcgaacagtaccgcgcgcaataccgcgaaagacaggctcaatggcgtggcgatccccaggccggccagtcgaagccgagatcgcgacccgcctctccgcgcacagctgcacgcgagcccgtgcgcgacgagcgatacgccagtttctatgaactctttcccgactga

SEQ ID NO: 2568 - protein, 338 aa, Alicyclobacillus acidocaldarius; identical to SEQ ID NO: 1735

SEQ ID NO: 2569 - DNA, 1017 bp, Alicyclobacillus acidocaldarius; identical to SEQ ID NO: 1736

SEQ ID NO: 2570 - protein, 281 aa, Anaeromyxobacter  K; identical to SEQ ID NO: 1737

SEQ ID NO: 2571 - protein, 281 aa, Anaeromyxobacter dehalogenans; identical to SEQ ID NO: 1738

SEQ ID NO: 2572 - protein, 273 aa, Syntrophomonas wolfei; identical to SEQ ID NO: 1739

SEQ ID NO: 2573 - protein, 281 aa, Anaeromyxobacter dehalogenans; identical to SEQ ID NO: 1740

SEQ ID NO: 2574 - protein, 259 aa, Clostridium cellulolyticum; identical to SEQ ID NO: 1741

SEQ ID NO: 2575 - protein, 338 aa, Artificial
  Alicyclobacillus acidocaldarius mutated SEQ ID NO 2568
MLEMGSKGRKNGIQVSSLIATGSSAHARREVKRMKRHESPPTLTHGDKIYFPAAGLCKRDYMTYLAQIGEHLVRHLRHRPVTLVRCPDGVAGRRFYQRHLPPHAPPSLPRREVQGERPLIAIPDVETLLYYGNLGAIEFHAGLHLVQGPQAGCPTALTFDLDPSDPRDFERVRELALCLREVLRGLGLDGVAKTTGASGLQVLVPLEEPLPYAVTRPVVNFVAAYCASRWPDLATTEKRVRHRGRRVYVDAPQHGPTRTLIAAYSVRAVEKALVSAPITWAELEYGVSPDAFDLHVVPDRLERVGDWLELAARHPASRVRAIHDALPPPWRQTRVRSV

SEQ ID NO: 2576 - protein, 338 aa, Artificial
  Alicyclobacillus acidocaldarius mutated SEQ ID NO 2568
MLEMGSKGRKNGIQISSLIATGSSAHARREVKRMKRHESPPTLTHGDKIYFPAAGLCKRDYMTYLAQIGEHLVRHLRHRPVTLVRCPDGVAGRRFYQRHLPPHAPPSLPRREVQGERPLIAIPDVETLLYYGNLGAIEFHAGLHLVQGPQAGCPTALTFDLDPSDPRDFERVRELALCLREVLRGLGLDGVAKTTGASGLQVLVPLEEPLPYAVTRPVVNFVAAYCASRWPDLATTERRVRHRGRRVYVDAPQHGPTRTLIAAYSVRAVEKALVSAPITWAELEYGVSPDAFDLHVVPDRLERVGDWLELAARHPASRVRAIHDALPPPWRQTRVRSV

SEQ ID NO: 2577 - protein, 338 aa, Artificial
  Alicyclobacillus acidocaldarius mutated SEQ ID NO 2568
MLEMGSKGRKNGIQVSSLIATGSSAHARREVKRMKRHESPPTLTHGDKIYFPAAGLCKRDYMTYLANIGEHLVRHLRHRPVTLVRCPDGVAGRRFYQRHLPPHAPPSLPRREVQGERPLIAIPDVETLLYYGNLGAIEFHAGLHLVQGPQAGCPTALTFDLDPSDPRDFERVRELALCLREVLRGLGLDGVAKTTGASGLQVLVPLEEPLPYAVTRPVVNFVAAYCASRWPDLATTERRVRHRGRRVYVDAPQHGPTRTLIAAYSVRAVEKALVSAPITWAELEYGVSPDAFDLHVVPDRLERVGDWLELAARHPASRVRAIHDALPPPWRQTRVRSV

SEQ ID NO: 2578 - protein, 338 aa, Artificial
  Alicyclobacillus acidocaldarius mutated SEQ ID NO 2568
MLEMGSKGRKNGIQVSSLIATGSSAHARREVKRMKRHESPPTLTHGDKIYFPAAGLCKRDYMTYLAQIGEHLVRHLRHRPVTLVRCPDGVAGRRFYQRHLPPHAPPSLPRREIQGERPLIAIPDVETLLYYGNLGAIEFHAGLHLVQGPQAGCPTALTFDLDPSDPRDFERVRELALCLREVLRGLGLDGVAKTTGASGLQVLVPLEEPLPYAVTRPVVNFVAAYCASRWPDLATTERRVRHRGRRVYVDAPQHGPTRTLIAAYSVRAVEKALVSAPITWAELEYGVSPDAFDLHVVPDRLERVGDWLELAARHPASRVRAIHDALPPPWRQTRVRSV

SEQ ID NO: 2579 - protein, 338 aa, Artificial
  Alicyclobacillus acidocaldarius mutated SEQ ID NO 2568
MLEMGSKGRKNGIQVSSLIATGSSAHARREVKRMKRHESPPTLTHGDKIYFPAAGLCKRDYMTYLAQIGEHLVRHLRHRPVTLVRCPDGVAGRRFYQRHLPPHAPPSLPRREVQGERPLIAIPDVETLLYYGNLGAIEFHAGLHLVQGPQAGCPTALTFDLDPSDPRDFERVRELALCLREVLRGLGLDGVAKTTGASGLQVLVPLEEPLPYAVTRPVVNFVAAYCASRWPDLATTERRVRHRGRRVYVDAPQHGPTRTLIAAYSVRAVEKALVSAPITWAELEYGVSPDAFDLHVVPDRLERVGDWLELAARHPASRVRALHDALPPPWRQTRVRSV

SEQ ID NO: 2580 - DNA, 1017 bp, Artificial
  Alicyclobacillus acidocaldarius mutated SEQ ID NO 2569
gtgcttgaaatgggttcgaaaggccgaaagaacggcatccaggtttcctccctgatagcgacgggttcgtctgcgcacgctaggcgagaggtgaagcgcatgaagcgccatgaaagtccgccgacgctcacccatggggacaagatctacttccctgccgcggggctctgcaagcgcgactatatgacctatcttgcccaaatcggcgagcacttggtccgacatctgcgccatcggcccgtcacgttggttcggtgcccggacggcgtggccggccgccgattttatcagcggcatcttccgccacacgcacctccgagcctgccgcgcagagaggtccaaggcgaacgcccgttgattgccatcccggacgtcgagacgctcttatactacggaaacttgggcgccatcgagttccacgcgggtctgcatctcgtccaaggtcctcaagcgggatgcccgacggcgctcacgttcgatctcgacccttccgatccgcgcgacttcgagcgcgtgcgagagctcgcgctgtgcctgcgcgaggtgcttcgcggcctcggcctcgacggcgtggcgaagaccacgggggcgtccggcctgcaggtgttggtcccgcttgaggagccgctcccgtacgccgtcacgcggccggtggtcaacttcgtcgcggcgtactgtgcgtcgcgctggccggatctggccaccaccgagaaacgcgtgcgccatcggggccgccgggtgtacgtggacgcgccgcagcacgggccgacgcgcacgctgatcgcggcgtacagcgtgcgcgcggtggagaaagcgctggtgtcggcgcccatcacatgggcagaactggaatacggggtgtcgcccgacgcgtttgatctccacgtggtgcctgacagattggagcgggtgggcgattggctggagctcgcggcgcgtcaccccgcctctcgcgtacgggccatccacgacgcgctccccccgccttggcgacaaacgcgcgtccgttcagtataa

SEQ ID NO: 2581 - DNA, 1017 bp, Artificial
  Alicyclobacillus acidocaldarius mutated SEQ ID NO 2569
gtgcttgaaatgggttcgaaaggccgaaagaacggcatccagatttcctccctgatagcgacgggttcgtctgcgcacgctaggcgagaggtgaagcgcatgaagcgccatgaaagtccgccgacgctcacccatggggacaagatctacttccctgccgcggggctctgcaagcgcgactatatgacctatcttgcccaaatcggcgagcacttggtccgacatctgcgccatcggcccgtcacgttggttcggtgcccggacggcgtggccggccgccgattttatcagcggcatcttccgccacacgcacctccgagcctgccgcgcagagaggtccaaggcgaacgcccgttgattgccatcccggacgtcgagacgctcttatactacggaaacttgggcgccatcgagttccacgcgggtctgcatctcgtccaaggtcctcaagcgggatgcccgacggcgctcacgttcgatctcgacccttccgatccgcgcgacttcgagcgcgtgcgagagctcgcgctgtgcctgcgcgaggtgcttcgcggcctcggcctcgacggcgtggcgaagaccacgggggcgtccggcctgcaggtgttggtcccgcttgaggagccgctcccgtacgccgtcacgcggccggtggtcaacttcgtcgcggcgtactgtgcgtcgcgctggccggatctggccaccaccgagaggcgcgtgcgccatcggggccgccgggtgtacgtggacgcgccgcagcacgggccgacgcgcacgctgatcgcggcgtacagcgtgcgcgcggtggagaaagcgctggtgtcggcgcccatcacatgggcagaactggaatacggggtgtcgcccgacgcgtttgatctccacgtggtgcctgacagattggagcgggtgggcgattggctggagctcgcggcgcgtcaccccgcctctcgcgtacgggccatccacgacgcgctccccccgccttggcgacaaacgcgcgtccgttcagtataa

SEQ ID NO: 2582 - DNA, 1017 bp, Artificial
  Alicyclobacillus acidocaldarius mutated SEQ ID NO 2569
gtgcttgaaatgggttcgaaaggccgaaagaacggcatccaggtttcctccctgatagcgacgggttcgtctgcgcacgctaggcgagaggtgaagcgcatgaagcgccatgaaagtccgccgacgctcacccatggggacaagatctacttccctgccgcggggctctgcaagcgcgactatatgacctatcttgccaatatcggcgagcacttggtccgacatctgcgccatcggcccgtcacgttggttcggtgcccggacggcgtggccggccgccgattttatcagcggcatcttccgccacacgcacctccgagcctgccgcgcagagaggtccaaggcgaacgcccgttgattgccatcccggacgtcgagacgctcttatactacggaaacttgggcgccatcgagttccacgcgggtctgcatctcgtccaaggtcctcaagcgggatgcccgacggcgctcacgttcgatctcgacccttccgatccgcgcgacttcgagcgcgtgcgagagctcgcgctgtgcctgcgcgaggtgcttcgcggcctcggcctcgacggcgtggcgaagaccacgggggcgtccggcctgcaggtgttggtcccgcttgaggagccgctcccgtacgccgtcacgcggccggtggtcaacttcgtcgcggcgtactgtgcgtcgcgctggccggatctggccaccaccgagaggcgcgtgcgccatcggggccgccgggtgtacgtggacgcgccgcagcacgggccgacgcgcacgctgatcgcggcgtacagcgtgcgcgcggtggagaaagcgctggtgtcggcgcccatcacatgggcagaactggaatacggggtgtcgcccgacgcgtttgatctccacgtggtgcctgacagattggagcgggtgggcgattggctggagctcgcggcgcgtcaccccgcctctcgcgtacgggccatccacgacgcgctccccccgccttggcgacaaacgcgcgtccgttcagtataa

SEQ ID NO: 2583 - DNA, 1017 bp, Artificial
  Alicyclobacillus acidocaldarius mutated SEQ ID NO 2569
gtgcttgaaatgggttcgaaaggccgaaagaacggcatccaggtttcctccctgatagcgacgggttcgtctgcgcacgctaggcgagaggtgaagcgcatgaagcgccatgaaagtccgccgacgctcacccatggggacaagatctacttccctgccgcggggctctgcaagcgcgactatatgacctatcttgcccaaatcggcgagcacttggtccgacatctgcgccatcggcccgtcacgttggttcggtgcccggacggcgtggccggccgccgattttatcagcggcatcttccgccacacgcacctccgagcctgccgcgcagagagattcaaggcgaacgcccgttgattgccatcccggacgtcgagacgctcttatactacggaaacttgggcgccatcgagttccacgcgggtctgcatctcgtccaaggtcctcaagcgggatgcccgacggcgctcacgttcgatctcgacccttccgatccgcgcgacttcgagcgcgtgcgagagctcgcgctgtgcctgcgcgaggtgcttcgcggcctcggcctcgacggcgtggcgaagaccacgggggcgtccggcctgcaggtgttggtcccgcttgaggagccgctcccgtacgccgtcacgcggccggtggtcaacttcgtcgcggcgtactgtgcgtcgcgctggccggatctggccaccaccgagaggcgcgtgcgccatcggggccgccgggtgtacgtggacgcgccgcagcacgggccgacgcgcacgctgatcgcggcgtacagcgtgcgcgcggtggagaaagcgctggtgtcggcgcccatcacatgggcagaactggaatacggggtgtcgcccgacgcgtttgatctccacgtggtgcctgacagattggagcgggtgggcgattggctggagctcgcggcgcgtcaccccgcctctcgcgtacgggccatccacgacgcgctccccccgccttggcgacaaacgcgcgtccgttcagtataa

SEQ ID NO: 2584 - DNA, 1017 bp, Artificial
  Alicyclobacillus acidocaldarius mutated SEQ ID NO 2569
gtgcttgaaatgggttcgaaaggccgaaagaacggcatccaggtttcctccctgatagcgacgggttcgtctgcgcacgctaggcgagaggtgaagcgcatgaagcgccatgaaagtccgccgacgctcacccatggggacaagatctacttccctgccgcggggctctgcaagcgcgactatatgacctatcttgcccaaatcggcgagcacttggtccgacatctgcgccatcggcccgtcacgttggttcggtgcccggacggcgtggccggccgccgattttatcagcggcatcttccgccacacgcacctccgagcctgccgcgcagagaggtccaaggcgaacgcccgttgattgccatcccggacgtcgagacgctcttatactacggaaacttgggcgccatcgagttccacgcgggtctgcatctcgtccaaggtcctcaagcgggatgcccgacggcgctcacgttcgatctcgacccttccgatccgcgcgacttcgagcgcgtgcgagagctcgcgctgtgcctgcgcgaggtgcttcgcggcctcggcctcgacggcgtggcgaagaccacgggggcgtccggcctgcaggtgttggtcccgcttgaggagccgctcccgtacgccgtcacgcggccggtggtcaacttcgtcgcggcgtactgtgcgtcgcgctggccggatctggccaccaccgagaggcgcgtgcgccatcggggccgccgggtgtacgtggacgcgccgcagcacgggccgacgcgcacgctgatcgcggcgtacagcgtgcgcgcggtggagaaagcgctggtgtcggcgcccatcacatgggcagaactggaatacggggtgtcgcccgacgcgtttgatctccacgtggtgcctgacagattggagcgggtgggcgattggctggagctcgcggcgcgtcaccccgcctctcgcgtacgggccttacacgacgcgctccccccgccttggcgacaaacgcgcgtccgttcagtataa

SEQ ID NO: 2585 - protein, 91 aa, Alicyclobacillus acidocaldarius; identical to SEQ ID NO: 1021

SEQ ID NO: 2586 - DNA, 276 bp, Alicyclobacillus acidocaldarius; identical to SEQ ID NO: 1022

SEQ ID NO: 2587 - protein, 90 aa, Bacillus cereus; identical to SEQ ID NO: 1023

SEQ ID NO: 2588 - protein, 90 aa, Bacillus weihenstephanensis; identical to SEQ ID NO: 1024

SEQ ID NO: 2589 - protein, 90 aa, Bacillus anthracis; identical to SEQ ID NO: 1025

SEQ ID NO: 2590 - protein, 90 aa, Bacillus cereus; identical to SEQ ID NO: 1026

SEQ ID NO: 2591 - protein, 89 aa, Lactobacillus salivarius; identical to SEQ ID NO: 1027

SEQ ID NO: 2592 - protein, 91 aa, Artificial; identical to SEQ ID NO: 1029
  Alicyclobacillus acidocaldarius mutated SEQ ID NO 2585

SEQ ID NO: 2593 - protein, 91 aa, Artificial
  Alicyclobacillus acidocaldarius mutated SEQ ID NO 2585
MNKRDLIRKTAEETGLSQKDCEAVINTLFDTIRRTVESGEKVQIIGFGTFELRERAARTARNPRTGEAVEVPARRVPAFKPGAELKQAVQV

SEQ ID NO: 2594 - protein, 91 aa, Artificial
  Alicyclobacillus acidocaldarius mutated SEQ ID NO 2585
MNKRDLIRKTAEETGLSQKDCEAVINTLFDTIRKTVESGEKVQIIGFGTFELRERAARTARNPRTGEAVEVPARRVPAFKPGAELKQAVQI

SEQ ID NO: 2595 - protein, 91 aa, Artificial; identical to SEQ ID NO: 1031
  Alicyclobacillus acidocaldarius mutated SEQ ID NO 2585

SEQ ID NO: 2596 - protein, 91 aa, Artificial; identical to SEQ ID NO: 1028
  Alicyclobacillus acidocaldarius mutated SEQ ID NO 2585

SEQ ID NO: 2597 - DNA, 276 bp, Artificial; identical to SEQ ID NO: 1034
  Alicyclobacillus acidocaldarius mutated SEQ ID NO 2586

SEQ ID NO: 2598 - DNA, 276 bp, Artificial
  Alicyclobacillus acidocaldarius mutated SEQ ID NO 2586
atgaacaaacgggacctcattcgaaaaaccgctgaagagacaggactatcccagaaagactgcgaagccgtgatcaacacgctctttgataccatccggcgtacggtagagtccggcgagaaagtccaaatcatcggctttggaacgttcgagttgcgtgagcgtgcggcccgtacagcgcgcaatccccggaccggtgaagcggtggaagttccggctcgtcgtgtcccggcattcaagccaggtgccgaactcaaacaggccgtgcaggtgtga

SEQ ID NO: 2599 - DNA, 276 bp, Artificial
  Alicyclobacillus acidocaldarius mutated SEQ ID NO 2586
atgaacaaacgggacctcattcgaaaaaccgctgaagagacaggactatcccagaaagactgcgaagccgtgatcaacacgctctttgataccatccggaagacggtagagtccggcgagaaagtccaaatcatcggctttggaacgttcgagttgcgtgagcgtgcggcccgtacagcgcgcaatccccggaccggtgaagcggtggaagttccggctcgtcgtgtcccggcattcaagccaggtgccgaactcaaacaggccgtgcagatttga

SEQ ID NO: 2600 - DNA, 276 bp, Artificial; identical to SEQ ID NO: 1036
  Alicyclobacillus acidocaldarius mutated SEQ ID NO 2586

SEQ ID NO: 2601 - DNA, 276 bp, Artificial; identical to SEQ ID NO: 1033
  Alicyclobacillus acidocaldarius mutated SEQ ID NO 2586

SEQ ID NO: 2602 - protein, 314 aa, Alicyclobacillus acidocaldarius; identical to SEQ ID NO: 1752

SEQ ID NO: 2603 - DNA, 945 bp, Alicyclobacillus acidocaldarius; identical to SEQ ID NO: 1753

SEQ ID NO: 2604 - protein, 322 aa, Natranaerobius thermophilus; identical to SEQ ID NO: 1754

SEQ ID NO: 2605 - protein, 296 aa, Symbiobacterium thermophilum; identical to SEQ ID NO: 1755

SEQ ID NO: 2606 - protein, 288 aa, Syntrophomonas wolfei; identical to SEQ ID NO: 1756

SEQ ID NO: 2607 - protein, 285 aa, Thermosinus carboxydivorans; identical to SEQ ID NO: 1757

SEQ ID NO: 2608 - protein, 303 aa, Arthrobacter aurescens; identical to SEQ ID NO: 1758

SEQ ID NO: 2609 - protein, 314 aa, Artificial
  Alicyclobacillus acidocaldarius mutated SEQ ID NO 2602
MPFFRPFEPISSTEVPVGDAWIAQVKWDGVRAVAEVSGDGVQIWNRHGRLRTDRYPEIASALRPFRGCAFDGEVVALTQGRPDFYRVLRRDRAVASHEIEQLVREIPVWYAVFDVVRMGGEWVGDWPLAKRLDWMLEHLSGVEHVLTSEGEVDTEALFAATKQLGLEGIVCKRVDSTYAPGGKDGRWVKVKHERNAIAAVGGVVYRDGAPNALMLGLFDDKARLFHVGNAGAGRLPRRAWRQLVERVLSHETSLQPFARAPKAVRTCRFAHPVVAVKVRFAEWTPRGTMRHPVLLAELDIPATPAACSFAQADP

SEQ ID NO: 2610 - protein, 314 aa, Artificial
  Alicyclobacillus acidocaldarius mutated SEQ ID NO 2602
MPFFRPFEPISSTEVPVGDAWIAQVKWDGVRAVAEVSGDGVQIWNRHGRLRTDRYPEIASALRPFRGCAFDGEVVALTQGRPDFYRVLRRDRAVASHEIEQLVREIPVWYAVFDVVRMGGEWVGDWPLAKRLDWMLEHLSGVEHVITSEGEVDTEALFAATKQLGLEGIVCKRVDSTYAPGGKDGRWVKVKHERNAIAAVGGVVYRDGAPNALMLGLFDDKARLFHVGNAGAGRLPRRAWRQLVERVLSHETSLQPFARAPKAVRTCRFAHPVVAVKVRFAEWTPKGTMRHPVLLAELDIPATPAACSFAQADP

SEQ ID NO: 2611 - protein, 314 aa, Artificial
  Alicyclobacillus acidocaldarius mutated SEQ ID NO 2602
MPFFKPFEPISSTEVPVGDAWIAQVKWDGVRAVAEVSGDGVQIWNRHGRLRTDRYPEIASALRPFRGCAFDGEVVALTQGRPDFYRVLRRDRAVASHEIEQLVREIPVWYAVFDVVRMGGEWVGDWPLAKRLDWMLEHLSGVEHVLTSEGEVDTEALFAATKQLGLEGIVCKRVDSTYAPGGKDGRWVKVKHERNAIAAVGGVVYRDGAPNALMLGLFDDKARLFHVGNAGAGRLPRRAWRQLVERVLSHETSLQPFARAPKAVRTCRFAHPVVAVKVRFAEWTPKGTMRHPVLLAELDIPATPAACSFAQADP

SEQ ID NO: 2612 - protein, 314 aa, Artificial
  Alicyclobacillus acidocaldarius mutated SEQ ID NO 2602
MPFFRPFEPISSTEVPVGDAWIAQVKWDGVRAVAEVSGDGVQIWNRHGRLRTDRYPEIASALRPFRGCAFDGEVVALTQGRPDFYRVLRRDRAVASHELEQLVREIPVWYAVFDVVRMGGEWVGDWPLAKRLDWMLEHLSGVEHVLTSEGEVDTEALFAATKQLGLEGIVCKRVDSTYAPGGKDGRWVKVKHERNAIAAVGGVVYRDGAPNALMLGLFDDKARLFHVGNAGAGRLPRRAWRQLVERVLSHETSLQPFARAPKAVRTCRFAHPVVAVKVRFAEWTPKGTMRHPVLLAELDIPATPAACSFAQADP

SEQ ID NO: 2613 - protein, 314 aa, Artificial
  Alicyclobacillus acidocaldarius mutated SEQ ID NO 2602
MPFFRPFEPISSTEVPVGDAWIAQVKWDGVRAVAEVSGDGVQIWNRHGRLRTDRYPEIASALRPFRGCAFDGEVVALTQGRPDFYRVLRRDKAVASHEIEQLVREIPVWYAVFDVVRMGGEWVGDWPLAKRLDWMLEHLSGVEHVLTSEGEVDTEALFAATKQLGLEGIVCKRVDSTYAPGGKDGRWVKVKHERNAIAAVGGVVYRDGAPNALMLGLFDDKARLFHVGNAGAGRLPRRAWRQLVERVLSHETSLQPFARAPKAVRTCRFAHPVVAVKVRFAEWTPKGTMRHPVLLAELDIPATPAACSFAQADP

SEQ ID NO: 2614 - DNA, 945 bp, Artificial
  Alicyclobacillus acidocaldarius mutated SEQ ID NO 2603
atgccgttctttcggcctttcgaacccatttcaagcaccgaggtgccggtgggagacgcgtggatcgcgcaggtcaaatgggacggggtgcgcgccgtggccgaggtgtcgggcgacggcgtgcaaatctggaaccgccacggacggcttcgaacggaccggtatccggagatcgcatcggcgctgcggccctttcgggggtgtgcgttcgacggcgaagtggtggcgctcacacagggaaggcccgacttttaccgggttcttcgcagggaccgggccgtcgcgtcgcacgagatcgagcaactcgtgcgcgagatccccgtatggtacgccgtgttcgatgtcgtgcggatgggcggggaatgggttggggattggccattggccaagcgactcgactggatgctcgagcatctctcgggcgtggaacatgtgctgacgagcgaaggcgaggtggacaccgaggcgctcttcgccgccacaaagcaactgggactcgagggaattgtgtgcaaacgcgtggactccacctacgcgcctggcggcaaagacgggcgctgggtcaaagtcaaacacgagcgaaacgccatcgcggccgttggcggcgtcgtgtaccgagacggcgccccgaatgcgctgatgctcggcctgtttgacgacaaggcacggctgtttcacgtcggcaacgcgggggccggtcgcctccctcgtcgagcatggcgccagctcgtcgagcgagtcctctcccacgagacatcgttgcaaccgttcgcccgcgcgcccaaggccgtgagaacgtgccgattcgcgcaccccgtcgtcgccgtgaaggttcgcttcgccgaatggacgccacgtgggaccatgcgccaccctgtcctcctcgccgagttggatatcccggcgacgcccgcggcgtgcagttttgcccaggccgacccgtga

SEQ ID NO: 2615 - DNA, 945 bp, Artificial
  Alicyclobacillus acidocaldarius mutated SEQ ID NO 2603
atgccgttctttcggcctttcgaacccatttcaagcaccgaggtgccggtgggagacgcgtggatcgcgcaggtcaaatgggacggggtgcgcgccgtggccgaggtgtcgggcgacggcgtgcaaatctggaaccgccacggacggcttcgaacggaccggtatccggagatcgcatcggcgctgcggccctttcgggggtgtgcgttcgacggcgaagtggtggcgctcacacagggaaggcccgacttttaccgggttcttcgcagggaccgggccgtcgcgtcgcacgagatcgagcaactcgtgcgcgagatccccgtatggtacgccgtgttcgatgtcgtgcggatgggcggggaatgggttggggattggccattggccaagcgactcgactggatgctcgagcatctctcgggcgtggaacatgtgattacgagcgaaggcgaggtggacaccgaggcgctcttcgccgccacaaagcaactgggactcgagggaattgtgtgcaaacgcgtggactccacctacgcgcctggcggcaaagacgggcgctgggtcaaagtcaaacacgagcgaaacgccatcgcggccgttggcggcgtcgtgtaccgagacggcgccccgaatgcgctgatgctcggcctgtttgacgacaaggcacggctgtttcacgtcggcaacgcgggggccggtcgcctccctcgtcgagcatggcgccagctcgtcgagcgagtcctctcccacgagacatcgttgcaaccgttcgcccgcgcgcccaaggccgtgagaacgtgccgattcgcgcaccccgtcgtcgccgtgaaggttcgcttcgccgaatggacgccaaaagggaccatgcgccaccctgtcctcctcgccgagttggatatcccggcgacgcccgcggcgtgcagttttgcccaggccgacccgtga

SEQ ID NO: 2616 - DNA, 945 bp, Artificial
  Alicyclobacillus acidocaldarius mutated SEQ ID NO 2603
atgccgttctttaaacctttcgaacccatttcaagcaccgaggtgccggtgggagacgcgtggatcgcgcaggtcaaatgggacggggtgcgcgccgtggccgaggtgtcgggcgacggcgtgcaaatctggaaccgccacggacggcttcgaacggaccggtatccggagatcgcatcggcgctgcggccctttcgggggtgtgcgttcgacggcgaagtggtggcgctcacacagggaaggcccgacttttaccgggttcttcgcagggaccgggccgtcgcgtcgcacgagatcgagcaactcgtgcgcgagatccccgtatggtacgccgtgttcgatgtcgtgcggatgggcggggaatgggttggggattggccattggccaagcgactcgactggatgctcgagcatctctcgggcgtggaacatgtgctgacgagcgaaggcgaggtggacaccgaggcgctcttcgccgccacaaagcaactgggactcgagggaattgtgtgcaaacgcgtggactccacctacgcgcctggcggcaaagacgggcgctgggtcaaagtcaaacacgagcgaaacgccatcgcggccgttggcggcgtcgtgtaccgagacggcgccccgaatgcgctgatgctcggcctgtttgacgacaaggcacggctgtttcacgtcggcaacgcgggggccggtcgcctccctcgtcgagcatggcgccagctcgtcgagcgagtcctctcccacgagacatcgttgcaaccgttcgcccgcgcgcccaaggccgtgagaacgtgccgattcgcgcaccccgtcgtcgccgtgaaggttcgcttcgccgaatggacgccaaaagggaccatgcgccaccctgtcctcctcgccgagttggatatcccggcgacgcccgcggcgtgcagttttgcccaggccgacccgtga

SEQ ID NO: 2617 - DNA, 945 bp, Artificial
  Alicyclobacillus acidocaldarius mutated SEQ ID NO 2603
atgccgttctttcggcctttcgaacccatttcaagcaccgaggtgccggtgggagacgcgtggatcgcgcaggtcaaatgggacggggtgcgcgccgtggccgaggtgtcgggcgacggcgtgcaaatctggaaccgccacggacggcttcgaacggaccggtatccggagatcgcatcggcgctgcggccctttcgggggtgtgcgttcgacggcgaagtggtggcgctcacacagggaaggcccgacttttaccgggttcttcgcagggaccgggccgtcgcgtcgcacgagttagagcaactcgtgcgcgagatccccgtatggtacgccgtgttcgatgtcgtgcggatgggcggggaatgggttggggattggccattggccaagcgactcgactggatgctcgagcatctctcgggcgtggaacatgtgctgacgagcgaaggcgaggtggacaccgaggcgctcttcgccgccacaaagcaactgggactcgagggaattgtgtgcaaacgcgtggactccacctacgcgcctggcggcaaagacgggcgctgggtcaaagtcaaacacgagcgaaacgccatcgcggccgttggcggcgtcgtgtaccgagacggcgccccgaatgcgctgatgctcggcctgtttgacgacaaggcacggctgtttcacgtcggcaacgcgggggccggtcgcctccctcgtcgagcatggcgccagctcgtcgagcgagtcctctcccacgagacatcgttgcaaccgttcgcccgcgcgcccaaggccgtgagaacgtgccgattcgcgcaccccgtcgtcgccgtgaaggttcgcttcgccgaatggacgccaaaagggaccatgcgccaccctgtcctcctcgccgagttggatatcccggcgacgcccgcggcgtgcagttttgcccaggccgacccgtga

SEQ ID NO: 2618 - DNA, 945 bp, Artificial
  Alicyclobacillus acidocaldarius mutated SEQ ID NO 2603
atgccgttctttcggcctttcgaacccatttcaagcaccgaggtgccggtgggagacgcgtggatcgcgcaggtcaaatgggacggggtgcgcgccgtggccgaggtgtcgggcgacggcgtgcaaatctggaaccgccacggacggcttcgaacggaccggtatccggagatcgcatcggcgctgcggccctttcgggggtgtgcgttcgacggcgaagtggtggcgctcacacagggaaggcccgacttttaccgggttcttcgcagggacaaagccgtcgcgtcgcacgagatcgagcaactcgtgcgcgagatccccgtatggtacgccgtgttcgatgtcgtgcggatgggcggggaatgggttggggattggccattggccaagcgactcgactggatgctcgagcatctctcgggcgtggaacatgtgctgacgagcgaaggcgaggtggacaccgaggcgctcttcgccgccacaaagcaactgggactcgagggaattgtgtgcaaacgcgtggactccacctacgcgcctggcggcaaagacgggcgctgggtcaaagtcaaacacgagcgaaacgccatcgcggccgttggcggcgtcgtgtaccgagacggcgccccgaatgcgctgatgctcggcctgtttgacgacaaggcacggctgtttcacgtcggcaacgcgggggccggtcgcctccctcgtcgagcatggcgccagctcgtcgagcgagtcctctcccacgagacatcgttgcaaccgttcgcccgcgcgcccaaggccgtgagaacgtgccgattcgcgcaccccgtcgtcgccgtgaaggttcgcttcgccgaatggacgccaaaagggaccatgcgccaccctgtcctcctcgccgagttggatatcccggcgacgcccgcggcgtgcagttttgcccaggccgacccgtga

SEQ ID NO: 2619 - protein, 478 aa, Alicyclobacillus acidocaldarius; identical to SEQ ID NO: 1769

SEQ ID NO: 2620 - DNA, 1437 bp, Alicyclobacillus acidocaldarius; identical to SEQ ID NO: 1770

SEQ ID NO: 2621 - protein, 472 aa, Paenibacillus larvae; identical to SEQ ID NO: 1771

SEQ ID NO: 2622 - protein, 476 aa, Pelotomaculum thermopropionicum; identical to SEQ ID NO: 1772

SEQ ID NO: 2623 - protein, 473 aa, Carnobacterium  AT7; identical to SEQ ID NO: 1773

SEQ ID NO: 2624 - protein, 449 aa, bacteriophage phi-FC1; identical to SEQ ID NO: 1774

SEQ ID NO: 2625 - protein, 455 aa, Streptococcus pneumoniae; identical to SEQ ID NO: 1775

SEQ ID NO: 2626 - protein, 478 aa, Artificial; identical to SEQ ID NO: 1778
  Alicyclobacillus acidocaldarius mutated SEQ ID NO 2619

SEQ ID NO: 2627 - protein, 478 aa, Artificial
  Alicyclobacillus acidocaldarius mutated SEQ ID NO 2619
MLLMTVALYCRVSTDEQAEHGFSIDQQKERLIAFCKSQGWDQYRLYIDDGYTGTNMDRPALQRLIKHIKEKKIDTVIVYKLDRLSRKQRDVLYLLEDVFDKNNVVFKSATEPFDTSTPLGKAMLGILAVFAQLERDTIIERLSTGQKLRVKSGKFSGGRIPFGYVYNSQTGKFEVSPHEAFLVREVYKKYLQGYSLSDLSDWIESQTSARYWDHARIRDMLTRETYTGVMPYGTLRSTEIAPPIIERELWEQVQQEMVRRREGFTPKGEYLLSGLLRCAECGSSFIHVIRKKGPYVYYLYGCRSQHQRPKKVPRRAPKQACTVGYRNREELESWVIEQVKRIARLDAEEFEHQIANIETNSDETEDTLRDLRKNLSDIEHKLNRWYEAFEEGTIDATQLRDRIKHLEEERRRLQTNIEELQDTLVKDTQPQRVFNAAKLIEEAWDYMTFDEKKNVLRAAISYIEIPRKGQPPVIHWNV

SEQ ID NO: 2628 - protein, 478 aa, Artificial
  Alicyclobacillus acidocaldarius mutated SEQ ID NO 2619
MLLMTVALYCRVSTDEQAEHGFSIDNQKERLIAFCKSQGWDQYRLYIDDGYTGTNMDRPALQRLIKHIKEKKIDTVIVYKLDRLSRKQRDVLYLLEDVFDKNNVVFKSATEPFDTSTPLGKAMLGILAVFAQLERDTIIERLSTGQKLRVKSGKFSGGRIPFGYVYNSQTGKFEVSPHEAFLVREVYKKYLQGYSLSDLSDWIESQTSARYWDHARIRDMLTRETYTGVMPYGTLRSTEIAPPIIERELWEQVQQEMVRRREGFTPKGEYLLSGLLRCAECGSSFIHVIRKKGPYVYYLYGCRSQHQRPKKVPRRAPKQACTVGYRNREELESWVIEQVKRIARLDAEEFEHQIANIETNSDETEDTLRDLRKNLSDIEHKLNRWYEAFEEGTIDATQLRDRIKHLEEERRRLQTNIEELQDTLVKDTQPQRVFNAAKLLEEAWDYMTFDEKKNVLRAAISYIEIPRKGQPPVIHWNV

SEQ ID NO: 2629 - protein, 478 aa, Artificial
  Alicyclobacillus acidocaldarius mutated SEQ ID NO 2619
MLLMTVALYCRVSTDEQAEHGFSIDNQKERLIAFCKSQGWDQYRLYIDDGYTGTNMDRPALQRLIKHIKEKKIDTVIVYKLDRLSRKQRDVLYLLEDVFDKNNVVFKSATEPFDTSTPLGKAMLGILAVFAQLERDTIIERLSTGQKLRVKSGKFSGGRIPFGYVYNSQTGKFEVSPHEAFLVREVYKKYLQGYSLSDLSDWIESQTSARYWDHARIRDMLTRETYTGVMPYGTLRSTEIAPPIIERELWENVQQEMVRRREGFTPKGEYLLSGLLRCAECGSSFIHVIRKKGPYVYYLYGCRSQHQRPKKVPRRAPKQACTVGYRNREELESWVIEQVKRIARLDAEEFEHQIANIETNSDETEDTLRDLRKNLSDIEHKLNRWYEAFEEGTIDATQLRDRIKHLEEERRRLQTNIEELQDTLVKDTQPQRVFNAAKLIEEAWDYMTFDEKKNVLRAAISYIEIPRKGQPPVIHWNV

SEQ ID NO: 2630 - protein, 478 aa, Artificial
  Alicyclobacillus acidocaldarius mutated SEQ ID NO 2619
MLLMTVALYCRVSTDEQAEHGFSIDNQKERLIAFCKSQGWDQYRLYIDDGYTGTNMDRPALQRLIKHIKEKKIDTVIVYKLDRLSRKQRDVLYLLEDVFDKNNVVFKSATEPFDTSTPLGKAMLGILAVFAQLERDTIIERLSTGQKLRVKSGKFSGGRIPFGYVYNSQTGKFEVSPHEAFLVREVYKKYLQGYSLSDLSDWIESQTSARYWDHARIRDMLTRETYTGVMPYGTLRSTEIAPPIIERELWEQVQQEMVRRREGFTPKGEYLLSGLLRCAECGSSFIHVIRKKGPYVYYLYGCRSQHQRPKKVPRRAPKQACTVGYRNREELESWVIEQVKRIARLDAEEFEHQIANIETNSDETEDTLRDLRKNLSDIEHKLNRWYEAFEEGTIDATQLRDRIKHLEEERRRLQTNIEELQDTLVKDTQPQRVFNAAKLIEEAWDYMTFDEKKNVLRAAISYIEIPRRGQPPVIHWNV

SEQ ID NO: 2631 - DNA, 1437 bp, Artificial; identical to SEQ ID NO: 1783
  Alicyclobacillus acidocaldarius mutated SEQ ID NO 2620

SEQ ID NO: 2632 - DNA, 1437 bp, Artificial
  Alicyclobacillus acidocaldarius mutated SEQ ID NO 2620
gtgcttttgatgacggtggctttgtactgtagggtatcgacagacgaacaagccgagcatggtttctctatcgaccaacagaaagaacgattgattgccttttgtaaatcacaaggatgggatcaatatcggctgtacatagacgacggatacactggtacgaacatggatcgaccggcgctgcagaggctcatcaaacacatcaaagaaaaaaagatcgatacagtaatcgtgtacaagcttgataggttaagcagaaaacaacgcgacgtgctgtatctactcgaagacgtttttgataagaacaatgtggtgttcaagagcgctacagaaccctttgacactagtacgccgctcggcaaagcaatgttaggtattctcgcggtattcgctcaacttgaacgggacaccatcattgagcgcctatctactggacaaaaacttcgtgttaaatcggggaaattttccggcgggagaattccttttggctacgtctataattcccagactggaaagtttgaagtgtcacctcatgaagcctttcttgtgagggaggtgtataaaaaatatcttcaaggatacagtcttagtgatttgtctgattggatcgaatcacagacatccgctcgttattgggatcacgcaaggattcgagacatgttgaccagagaaacgtatacgggtgttatgccatatggaactctaagaagtacagaaatcgccccacccatcatcgaacgcgaattgtgggaacaagtacaacaggaaatggttcgaagacgcgaaggctttactcctaaaggcgaatacttgttgtccggtcttttgcggtgcgcggaatgcggaagttctttcatacacgtcattcgcaaaaagggaccgtatgtctattacttgtatggatgcagatctcaacaccaacgccctaaaaaggtaccaagaagggctccgaaacaagcttgcaccgtcggttatcgcaatcgtgaagagttggagtcatgggtaatcgaacaggtgaaacgaatagcaaggttggatgcagaagaatttgaacaccaaatcgcaaatatagaaaccaattctgatgaaaccgaagatacacttagggatttaaggaaaaacctatcagatatagagcataagttgaatagatggtacgaggcctttgaagaggggacgatagatgctacgcagttgcgagatcggattaagcatctcgaagaggaaagaaggagattacagaccaatattgaagaattgcaagacacacttgtgaaagatacacaaccgcaacgtgtgttcaacgctgcaaagcttattgaagaggcttgggattacatgacctttgatgaaaagaaaaatgtcttacgtgccgcgatttcgtatattgagatccctcgaaagggacaaccgccggtcatccattggaatgtctag

SEQ ID NO: 2633 - DNA, 1437 bp, Artificial
  Alicyclobacillus acidocaldarius mutated SEQ ID NO 2620
gtgcttttgatgacggtggctttgtactgtagggtatcgacagacgaacaagccgagcatggtttctctatcgacaatcagaaagaacgattgattgccttttgtaaatcacaaggatgggatcaatatcggctgtacatagacgacggatacactggtacgaacatggatcgaccggcgctgcagaggctcatcaaacacatcaaagaaaaaaagatcgatacagtaatcgtgtacaagcttgataggttaagcagaaaacaacgcgacgtgctgtatctactcgaagacgtttttgataagaacaatgtggtgttcaagagcgctacagaaccctttgacactagtacgccgctcggcaaagcaatgttaggtattctcgcggtattcgctcaacttgaacgggacaccatcattgagcgcctatctactggacaaaaacttcgtgttaaatcggggaaattttccggcgggagaattccttttggctacgtctataattcccagactggaaagtttgaagtgtcacctcatgaagcctttcttgtgagggaggtgtataaaaaatatcttcaaggatacagtcttagtgatttgtctgattggatcgaatcacagacatccgctcgttattgggatcacgcaaggattcgagacatgttgaccagagaaacgtatacgggtgttatgccatatggaactctaagaagtacagaaatcgccccacccatcatcgaacgcgaattgtgggaacaagtacaacaggaaatggttcgaagacgcgaaggctttactcctaaaggcgaatacttgttgtccggtcttttgcggtgcgcggaatgcggaagttctttcatacacgtcattcgcaaaaagggaccgtatgtctattacttgtatggatgcagatctcaacaccaacgccctaaaaaggtaccaagaagggctccgaaacaagcttgcaccgtcggttatcgcaatcgtgaagagttggagtcatgggtaatcgaacaggtgaaacgaatagcaaggttggatgcagaagaatttgaacaccaaatcgcaaatatagaaaccaattctgatgaaaccgaagatacacttagggatttaaggaaaaacctatcagatatagagcataagttgaatagatggtacgaggcctttgaagaggggacgatagatgctacgcagttgcgagatcggattaagcatctcgaagaggaaagaaggagattacagaccaatattgaagaattgcaagacacacttgtgaaagatacacaaccgcaacgtgtgttcaacgctgcaaagcttttagaagaggcttgggattacatgacctttgatgaaaagaaaaatgtcttacgtgccgcgatttcgtatattgagatccctcgaaagggacaaccgccggtcatccattggaatgtctag

SEQ ID NO: 2634 - DNA, 1437 bp, Artificial
  Alicyclobacillus acidocaldarius mutated SEQ ID NO 2620
gtgcttttgatgacggtggctttgtactgtagggtatcgacagacgaacaagccgagcatggtttctctatcgacaatcagaaagaacgattgattgccttttgtaaatcacaaggatgggatcaatatcggctgtacatagacgacggatacactggtacgaacatggatcgaccggcgctgcagaggctcatcaaacacatcaaagaaaaaaagatcgatacagtaatcgtgtacaagcttgataggttaagcagaaaacaacgcgacgtgctgtatctactcgaagacgtttttgataagaacaatgtggtgttcaagagcgctacagaaccctttgacactagtacgccgctcggcaaagcaatgttaggtattctcgcggtattcgctcaacttgaacgggacaccatcattgagcgcctatctactggacaaaaacttcgtgttaaatcggggaaattttccggcgggagaattccttttggctacgtctataattcccagactggaaagtttgaagtgtcacctcatgaagcctttcttgtgagggaggtgtataaaaaatatcttcaaggatacagtcttagtgatttgtctgattggatcgaatcacagacatccgctcgttattgggatcacgcaaggattcgagacatgttgaccagagaaacgtatacgggtgttatgccatatggaactctaagaagtacagaaatcgccccacccatcatcgaacgcgaattgtgggaaaatgtacaacaggaaatggttcgaagacgcgaaggctttactcctaaaggcgaatacttgttgtccggtcttttgcggtgcgcggaatgcggaagttctttcatacacgtcattcgcaaaaagggaccgtatgtctattacttgtatggatgcagatctcaacaccaacgccctaaaaaggtaccaagaagggctccgaaacaagcttgcaccgtcggttatcgcaatcgtgaagagttggagtcatgggtaatcgaacaggtgaaacgaatagcaaggttggatgcagaagaatttgaacaccaaatcgcaaatatagaaaccaattctgatgaaaccgaagatacacttagggatttaaggaaaaacctatcagatatagagcataagttgaatagatggtacgaggcctttgaagaggggacgatagatgctacgcagttgcgagatcggattaagcatctcgaagaggaaagaaggagattacagaccaatattgaagaattgcaagacacacttgtgaaagatacacaaccgcaacgtgtgttcaacgctgcaaagcttattgaagaggcttgggattacatgacctttgatgaaaagaaaaatgtcttacgtgccgcgatttcgtatattgagatccctcgaaagggacaaccgccggtcatccattggaatgtctag

SEQ ID NO: 2635 - DNA, 1437 bp, Artificial
  Alicyclobacillus acidocaldarius mutated SEQ ID NO 2620
gtgcttttgatgacggtggctttgtactgtagggtatcgacagacgaacaagccgagcatggtttctctatcgacaatcagaaagaacgattgattgccttttgtaaatcacaaggatgggatcaatatcggctgtacatagacgacggatacactggtacgaacatggatcgaccggcgctgcagaggctcatcaaacacatcaaagaaaaaaagatcgatacagtaatcgtgtacaagcttgataggttaagcagaaaacaacgcgacgtgctgtatctactcgaagacgtttttgataagaacaatgtggtgttcaagagcgctacagaaccctttgacactagtacgccgctcggcaaagcaatgttaggtattctcgcggtattcgctcaacttgaacgggacaccatcattgagcgcctatctactggacaaaaacttcgtgttaaatcggggaaattttccggcgggagaattccttttggctacgtctataattcccagactggaaagtttgaagtgtcacctcatgaagcctttcttgtgagggaggtgtataaaaaatatcttcaaggatacagtcttagtgatttgtctgattggatcgaatcacagacatccgctcgttattgggatcacgcaaggattcgagacatgttgaccagagaaacgtatacgggtgttatgccatatggaactctaagaagtacagaaatcgccccacccatcatcgaacgcgaattgtgggaacaagtacaacaggaaatggttcgaagacgcgaaggctttactcctaaaggcgaatacttgttgtccggtcttttgcggtgcgcggaatgcggaagttctttcatacacgtcattcgcaaaaagggaccgtatgtctattacttgtatggatgcagatctcaacaccaacgccctaaaaaggtaccaagaagggctccgaaacaagcttgcaccgtcggttatcgcaatcgtgaagagttggagtcatgggtaatcgaacaggtgaaacgaatagcaaggttggatgcagaagaatttgaacaccaaatcgcaaatatagaaaccaattctgatgaaaccgaagatacacttagggatttaaggaaaaacctatcagatatagagcataagttgaatagatggtacgaggcctttgaagaggggacgatagatgctacgcagttgcgagatcggattaagcatctcgaagaggaaagaaggagattacagaccaatattgaagaattgcaagacacacttgtgaaagatacacaaccgcaacgtgtgttcaacgctgcaaagcttattgaagaggcttgggattacatgacctttgatgaaaagaaaaatgtcttacgtgccgcgatttcgtatattgagatccctcgacgtggacaaccgccggtcatccattggaatgtctag

SEQ ID NO: 2636 - protein, 163 aa, Alicyclobacillus acidocaldarius
MMMTFGERLAQLRRSKGLSQYALAEQLKMTRGQIANYEQGTREPDIETLKKLADFFDVSIDFLVLGKPNVSDFNGLTNEVKRTLEALSQMSVEKQQEVADFAEYLRSKEEQPVVEYDVREIAANMEKALYAHGDEDLIQHFEEIMRRVIRRYDERASQDQQNR

SEQ ID NO: 2637 - DNA, 492 bp, Alicyclobacillus acidocaldarius
atgatgatgacgtttggcgaacgtttggcacagttacgccggtcaaaaggtttgagtcaatacgctttagcggaacaactcaaaatgacacgcgggcaaatcgctaattatgagcagggcacaagagaacctgacattgagactttgaagaaactagcggatttcttcgatgtaagtatcgactttctcgtattgggaaagcccaatgtgtcagattttaacggcttgactaatgaggttaaaagaacgttggaagcgctatctcaaatgtcagtcgagaagcagcaagaggtcgccgattttgccgaatacctgagatccaaggaagaacagcctgtggtagaatatgacgtgcgagaaattgcagcgaatatggaaaaagcattgtacgcgcacggagacgaagaccttattcaacactttgaggagatcatgagacgtgtcattcgtcgatatgatgaacgtgccagccaagaccagcagaatcggtga

SEQ ID NO: 2638 - protein, 135 aa, Listeria innocua
FSKRLSELRKKKGFSQYKLADELGFSRGQVANYEQGTREPDYQTLLKIAEFFNVSTDYLLGRDDNNLADTIAAHIDSNASEEDMKEILAYIEEKRKEHANEEEIDITDIAAKKDADVAKFVEENPDFKAVAARVM

SEQ ID NO: 2639 - protein, 135 aa, Listeria monocytogenes
FSKRLSELRKKKGFSQYKLADELGFSRGQVANYEQGTREPDYQTLLKIAEFFNVSTDYLLGRDDNNLADTIAAHIDSNATEEDIKEILAYIEEKRKEHANEKEINITEIASKEDEEINKFVDENEDFKVVAARVM

SEQ ID NO: 2640 - protein, 135 aa, Listeria monocytogenes
FSKRLSELRKKKGFSQYKLADELGFSRGQVANYEQGTREPDYQTLLKIAEFFNVSTDYLLGRDDNNLAETIAAHIDSNASEEDIKEILAYIEEKRKEHVNEEEINITEIASKEDDAVDKFVEENEDFKAVAARVM

SEQ ID NO: 2641 - protein, 135 aa, Listeria monocytogenes
FSKRLSELRKKKGFSQYKLADELGFSRGQVANYEQGTREPDYQTLLKIAEFFNVSTDYLLGRDDNNLADTIAAHIDSNATEEDIKEILAYIEEKRKEHANEREINITEIASKEDEAVDKFVEENEDFKAVAARVM

SEQ ID NO: 2642 - protein, 95 aa, Desulfotomaculum reducens
MTQEQLAQQLGFTRGQVSNYEQGSREPDFETLKKIADFFKVTTDYMLGRTDDPTPVDKLIELSALAGQQKFDPMKELPPEAQRSLEDFIDYLMRK

SEQ ID NO: 2643 - protein, 163 aa, Artificial
  Alicyclobacillus acidocaldarius mutated SEQ ID NO 2636
MMMTFGERLAQLRRSKGLSQYALAEQLRMTRGQIANYEQGTREPDIETLKKLADFFDVSIDFLVLGKPNVSDFNGLTNEVKRTLEALSQMSVEKQQEVADFAEYLRSKEEQPVVEYDVREIAANMEKALYAHGDEDLIQHFEEIMRRVIRRYDERASQDQQNR

SEQ ID NO: 2644 - protein, 163 aa, Artificial
  Alicyclobacillus acidocaldarius mutated SEQ ID NO 2636
MMMTFGERLAQLRRSKGLSQYALAEQLKMTRGQIANYEQGTREPDIETLKKLADFFDVSIDFLVLGKPNVSDFNGLTNEVKRTLEALSQMSVEKQQEVADFAEYLRSKEEQPVVEYDVREIAANMEKALYAHGDEDLIQHFEEIMRRVIRRYEERASQDQQNR

SEQ ID NO: 2645 - protein, 163 aa, Artificial
  Alicyclobacillus acidocaldarius mutated SEQ ID NO 2636
MMMTFGERLAQLRRSKGLSQYALAEQLKMTRGQIANYEQGTREPDIETLKKLADFFDVSIDFLVLGKPNVSDFNGLTNEVKRTLEALSQMSVEKQQEVADFAEYLRSKEEQPVVEYDVKEIAANMEKALYAHGDEDLIQHFEEIMRRVIRRYDERASQDQQNR

SEQ ID NO: 2646 - protein, 163 aa, Artificial
  Alicyclobacillus acidocaldarius mutated SEQ ID NO 2636
MMMTFGERLAQLRRSKGLSQYALAEQLKMTRGQIANYEQGTREPDIETLKKLADFFDVSIDFLVLGKPNVSDFNGLTNEVKRTLEALSQMSVEKQQEVADFAEYLRSKEEQPVVEYDVREIAANMERALYAHGDEDLIQHFEEIMRRVIRRYDERASQDQQNR

SEQ ID NO: 2647 - protein, 163 aa, Artificial
  Alicyclobacillus acidocaldarius mutated SEQ ID NO 2636
MMMTFGERLAQLRRSKGLSQYALAEQLKMTRGQIANYEQGTREPDIETLKKLADFFDVSIDFLVLGKPNVSDFNGLTNEVKRTLEALSQMSVEKQQEVADFAEYLRSKEEQPVVEYDVREIAANMEKALYAHGDEDLIQHFEDIMRRVIRRYDERASQDQQNR

SEQ ID NO: 2648 - DNA, 492 bp, Artificial
  Alicyclobacillus acidocaldarius mutated SEQ ID NO 2637
atgatgatgacgtttggcgaacgtttggcacagttacgccggtcaaaaggtttgagtcaatacgctttagcggaacaactccgtatgacacgcgggcaaatcgctaattatgagcagggcacaagagaacctgacattgagactttgaagaaactagcggatttcttcgatgtaagtatcgactttctcgtattgggaaagcccaatgtgtcagattttaacggcttgactaatgaggttaaaagaacgttggaagcgctatctcaaatgtcagtcgagaagcagcaagaggtcgccgattttgccgaatacctgagatccaaggaagaacagcctgtggtagaatatgacgtgcgagaaattgcagcgaatatggaaaaagcattgtacgcgcacggagacgaagaccttattcaacactttgaggagatcatgagacgtgtcattcgtcgatatgatgaacgtgccagccaagaccagcagaatcggtga

SEQ ID NO: 2649 - DNA, 492 bp, Artificial
  Alicyclobacillus acidocaldarius mutated SEQ ID NO 2637
atgatgatgacgtttggcgaacgtttggcacagttacgccggtcaaaaggtttgagtcaatacgctttagcggaacaactcaaaatgacacgcgggcaaatcgctaattatgagcagggcacaagagaacctgacattgagactttgaagaaactagcggatttcttcgatgtaagtatcgactttctcgtattgggaaagcccaatgtgtcagattttaacggcttgactaatgaggttaaaagaacgttggaagcgctatctcaaatgtcagtcgagaagcagcaagaggtcgccgattttgccgaatacctgagatccaaggaagaacagcctgtggtagaatatgacgtgcgagaaattgcagcgaatatggaaaaagcattgtacgcgcacggagacgaagaccttattcaacactttgaggagatcatgagacgtgtcattcgtcgatatgaagaacgtgccagccaagaccagcagaatcggtga

SEQ ID NO: 2650 - DNA, 492 bp, Artificial
  Alicyclobacillus acidocaldarius mutated SEQ ID NO 2637
atgatgatgacgtttggcgaacgtttggcacagttacgccggtcaaaaggtttgagtcaatacgctttagcggaacaactcaaaatgacacgcgggcaaatcgctaattatgagcagggcacaagagaacctgacattgagactttgaagaaactagcggatttcttcgatgtaagtatcgactttctcgtattgggaaagcccaatgtgtcagattttaacggcttgactaatgaggttaaaagaacgttggaagcgctatctcaaatgtcagtcgagaagcagcaagaggtcgccgattttgccgaatacctgagatccaaggaagaacagcctgtggtagaatatgacgtgaaagaaattgcagcgaatatggaaaaagcattgtacgcgcacggagacgaagaccttattcaacactttgaggagatcatgagacgtgtcattcgtcgatatgatgaacgtgccagccaagaccagcagaatcggtga

SEQ ID NO: 2651 - DNA, 492 bp, Artificial
  Alicyclobacillus acidocaldarius mutated SEQ ID NO 2637
atgatgatgacgtttggcgaacgtttggcacagttacgccggtcaaaaggtttgagtcaatacgctttagcggaacaactcaaaatgacacgcgggcaaatcgctaattatgagcagggcacaagagaacctgacattgagactttgaagaaactagcggatttcttcgatgtaagtatcgactttctcgtattgggaaagcccaatgtgtcagattttaacggcttgactaatgaggttaaaagaacgttggaagcgctatctcaaatgtcagtcgagaagcagcaagaggtcgccgattttgccgaatacctgagatccaaggaagaacagcctgtggtagaatatgacgtgcgagaaattgcagcgaatatggaacgtgcattgtacgcgcacggagacgaagaccttattcaacactttgaggagatcatgagacgtgtcattcgtcgatatgatgaacgtgccagccaagaccagcagaatcggtga

SEQ ID NO: 2652 - DNA, 492 bp, Artificial
  Alicyclobacillus acidocaldarius mutated SEQ ID NO 2637
atgatgatgacgtttggcgaacgtttggcacagttacgccggtcaaaaggtttgagtcaatacgctttagcggaacaactcaaaatgacacgcgggcaaatcgctaattatgagcagggcacaagagaacctgacattgagactttgaagaaactagcggatttcttcgatgtaagtatcgactttctcgtattgggaaagcccaatgtgtcagattttaacggcttgactaatgaggttaaaagaacgttggaagcgctatctcaaatgtcagtcgagaagcagcaagaggtcgccgattttgccgaatacctgagatccaaggaagaacagcctgtggtagaatatgacgtgcgagaaattgcagcgaatatggaaaaagcattgtacgcgcacggagacgaagaccttattcaacactttgaggatatcatgagacgtgtcattcgtcgatatgatgaacgtgccagccaagaccagcagaatcggtga

SEQ ID NO: 2653 - protein, 82 aa, Alicyclobacillus acidocaldarius
MSSFPERLSELLSATNSTKRALARAIGISERMIQYYITGAKSPTLDVLVAMADYFNVGLDYLAGRSDDPTPPPRSPSSGWDP

SEQ ID NO: 2654 - DNA, 249 bp, Alicyclobacillus acidocaldarius
atgtcctcatttccggaacgcttgtcagaacttttgtctgcgaccaattcaacaaaacgtgccctagcgcgcgcgattgggatatcagagcgcatgattcagtactacatcactggcgctaagagccccactctcgatgttcttgtggcgatggccgactactttaatgtggggctcgactacttagccgggcgttccgatgaccccacgcccccaccccgctccccctcatctgggtgggatccgtag

SEQ ID NO: 2655 - protein, 61 aa, Anaerotruncus colihominis
FQKRLKELRNAKGTSQIAIAAALGITDRGYRKYEAGDSEPTLSVIIALADYFDVSLDYLCG

SEQ ID NO: 2656 - protein, 59 aa, Thermoanaerobacter pseudethanolicus
KRIKELRKKKGITQKELASYLGISDRAVGYYESGQRTPPPDILQKIADFFNVSTDYLLG

SEQ ID NO: 2657 - protein, 61 aa, Pelotomaculum thermopropionicum
FAKRLSFLITKNKLSKQAVANAINVSRPAVSQFANGENLPSVEKLIALADFFDVSLDYLVG

SEQ ID NO: 2658 - protein, 58 aa, Bacillus cereus
RIKSLRKKENLTQKQLAEKIGVSQRMIGYYESEERFPPHDVLTKLADCFSVSADYLLG

SEQ ID NO: 2659 - protein, 61 aa, Bacillus halodurans
FPERLRYLRKKHGLTMKELGKKINVAESTISGYENGNRKPDMDTLVKMAEYFNSSTDYLLG

SEQ ID NO: 2660 - protein, 82 aa, Artificial
  Alicyclobacillus acidocaldarius mutated SEQ ID NO 2653
MSSFPDRLSELLSATNSTKRALARAIGISERMIQYYITGAKSPTLDVLVAMADYFNVGLDYLAGRSDDPTPPPRSPSSGWDP

SEQ ID NO: 2661 - protein, 82 aa, Artificial
  Alicyclobacillus acidocaldarius mutated SEQ ID NO 2653
MSSFPERLSELLSATNSTKRALARAIGISERMIQYYITGAKSPTLDVLVAMADYFNVGLDYLAGRSDEPTPPPRSPSSGWDP

SEQ ID NO: 2662 - protein, 82 aa, Artificial
  Alicyclobacillus acidocaldarius mutated SEQ ID NO 2653
MSSFPERLSELLSATNSTKRALARAIGISERMIQYYITGAKSPTLDVLVAMADYFNIGLDYLAGRSDDPTPPPRSPSSGWDP

SEQ ID NO: 2663 - protein, 82 aa, Artificial
  Alicyclobacillus acidocaldarius mutated SEQ ID NO 2653
MSSFPERLSELLSATQSTKRALARAIGISERMIQYYITGAKSPTLDVLVAMADYFNVGLDYLAGRSDDPTPPPRSPSSGWDP

SEQ ID NO: 2664 - protein, 82 aa, Artificial
  Alicyclobacillus acidocaldarius mutated SEQ ID NO 2653
MSSFPERLSELLSATNSTKRALARAIGISERMINYYITGAKSPTLDVLVAMADYFNVGLDYLAGRSDDPTPPPRSPSSGWDP

SEQ ID NO: 2665 - DNA, 249 bp, Artificial
  Alicyclobacillus acidocaldarius mutated SEQ ID NO 2654
atgtcctcatttccggatcgcttgtcagaacttttgtctgcgaccaattcaacaaaacgtgccctagcgcgcgcgattgggatatcagagcgcatgattcagtactacatcactggcgctaagagccccactctcgatgttcttgtggcgatggccgactactttaatgtggggctcgactacttagccgggcgttccgatgaccccacgcccccaccccgctccccctcatctgggtgggatccgtag

SEQ ID NO: 2666 - DNA, 249 bp, Artificial
  Alicyclobacillus acidocaldarius mutated SEQ ID NO 2654
atgtcctcatttccggaacgcttgtcagaacttttgtctgcgaccaattcaacaaaacgtgccctagcgcgcgcgattgggatatcagagcgcatgattcagtactacatcactggcgctaagagccccactctcgatgttcttgtggcgatggccgactactttaatgtggggctcgactacttagccgggcgttccgatgaacccacgcccccaccccgctccccctcatctgggtgggatccgtag

SEQ ID NO: 2667 - DNA, 249 bp, Artificial
  Alicyclobacillus acidocaldarius mutated SEQ ID NO 2654
atgtcctcatttccggaacgcttgtcagaacttttgtctgcgaccaattcaacaaaacgtgccctagcgcgcgcgattgggatatcagagcgcatgattcagtactacatcactggcgctaagagccccactctcgatgttcttgtggcgatggccgactactttaatattgggctcgactacttagccgggcgttccgatgaccccacgcccccaccccgctccccctcatctgggtgggatccgtag

SEQ ID NO: 2668 - DNA, 249 bp, Artificial
  Alicyclobacillus acidocaldarius mutated SEQ ID NO 2654
atgtcctcatttccggaacgcttgtcagaacttttgtctgcgacccaatcaacaaaacgtgccctagcgcgcgcgattgggatatcagagcgcatgattcagtactacatcactggcgctaagagccccactctcgatgttcttgtggcgatggccgactactttaatgtggggctcgactacttagccgggcgttccgatgaccccacgcccccaccccgctccccctcatctgggtgggatccgtag

SEQ ID NO: 2669 - DNA, 249 bp, Artificial
  Alicyclobacillus acidocaldarius mutated SEQ ID NO 2654
atgtcctcatttccggaacgcttgtcagaacttttgtctgcgaccaattcaacaaaacgtgccctagcgcgcgcgattgggatatcagagcgcatgattaattactacatcactggcgctaagagccccactctcgatgttcttgtggcgatggccgactactttaatgtggggctcgactacttagccgggcgttccgatgaccccacgcccccaccccgctccccctcatctgggtgggatccgtag

SEQ ID NO: 2670 - protein, 72 aa, Alicyclobacillus acidocaldarius
MTLFSQRLTELLDRTGTTRRSFAQALGVSERMVQYYITGKKDPTVETLIAIADFFDVSLDYLVGRSENPERK

SEQ ID NO: 2671 - DNA, 219 bp, Alicyclobacillus acidocaldarius
atgactcttttttctcagcgactgaccgaattactcgaccgaacgggaaccacgcgtcggtcgtttgcacaggcactcggagtctctgaacgcatggtgcagtactacataaccggaaagaaagatccaacagttgaaactctaattgccattgctgatttctttgatgtgagtttggactatcttgttggtcgctcagagaatccagaacgaaaatga

SEQ ID NO: 2672 - protein, 69 aa, Anaerotruncus colihominis
IFQKRLKELRNAKGTSQIAIAAALGITDRGYRKYEAGDSEPTLSVIIALADYFDVSLDYLCGRSDDPAR

SEQ ID NO: 2673 - protein, 69 aa, Pelotomaculum thermopropionicum
IFAKRLSFLITKNKLSKQAVANAINVSRPAVSQFANGENLPSVEKLIALADFFDVSLDYLVGRSDDPRR

SEQ ID NO: 2674 - protein, 67 aa, Caldicellulosiruptor saccharolyticus
MNLFRFRLKELREEKNISRSDLAEILGVSTQTIANYENGHREPNFDTLLKIADYFGVTVDYLIGRSE

SEQ ID NO: 2675 - protein, 64 aa, Thermoanaerobacter  X514
FSQRLRQLREEKGLLQKDVAKILGITPSAYGYYEQGKREPSMEVLKKLSDFFNVSIDYLLGRTD

SEQ ID NO: 2676 - protein, 68 aa, Bacillus cereus
MIGEKIKELRKNNKITQEQLGNAIGVSKMAISYFEKGKKSPGRESLEKIADYFNVTTDYLLGRSEDPE

SEQ ID NO: 2677 - protein, 72 aa, Artificial
  Alicyclobacillus acidocaldarius mutated SEQ ID NO 2670
MTLFSQRLTELLDRTGTTRKSFAQALGVSERMVQYYITGKKDPTVETLIAIADFFDVSLDYLVGRSENPERK

SEQ ID NO: 2678 - protein, 72 aa, Artificial
  Alicyclobacillus acidocaldarius mutated SEQ ID NO 2670
MTLFSQRLTELLERTGTTRRSFAQALGVSERMVQYYITGKKDPTVETLIAIADFFDVSLDYLVGRSENPERK

SEQ ID NO: 2679 - protein, 72 aa, Artificial
  Alicyclobacillus acidocaldarius mutated SEQ ID NO 2670
MTLFSQRLTELLDRTGTTRRSFAQALGVSDRMVQYYITGKKDPTVETLIAIADFFDVSLDYLVGRSENPERK

SEQ ID NO: 2680 - protein, 72 aa, Artificial
  Alicyclobacillus acidocaldarius mutated SEQ ID NO 2670
MTLFSQRLTELLDRTGTTRRSFAQALGVSERMVQYYITGKKDPTVETLLAIADFFDVSLDYLVGRSENPERK

SEQ ID NO: 2681 - protein, 72 aa, Artificial
  Alicyclobacillus acidocaldarius mutated SEQ ID NO 2670
MTLFSQRLTELIDRTGTTRRSFAQALGVSERMVQYYITGKKDPTVETLIAIADFFDVSLDYLVGRSENPERK

SEQ ID NO: 2682 - DNA, 219 bp, Artificial
  Alicyclobacillus acidocaldarius mutated SEQ ID NO 2671
atgactcttttttctcagcgactgaccgaattactcgaccgaacgggaaccacgcgtaaatcgtttgcacaggcactcggagtctctgaacgcatggtgcagtactacataaccggaaagaaagatccaacagttgaaactctaattgccattgctgatttctttgatgtgagtttggactatcttgttggtcgctcagagaatccagaacgaaaatga

SEQ ID NO: 2683 - DNA, 219 bp, Artificial
  Alicyclobacillus acidocaldarius mutated SEQ ID NO 2671
atgactcttttttctcagcgactgaccgaattactcgaacgaacgggaaccacgcgtcggtcgtttgcacaggcactcggagtctctgaacgcatggtgcagtactacataaccggaaagaaagatccaacagttgaaactctaattgccattgctgatttctttgatgtgagtttggactatcttgttggtcgctcagagaatccagaacgaaaatga

SEQ ID NO: 2684 - DNA, 219 bp, Artificial
  Alicyclobacillus acidocaldarius mutated SEQ ID NO 2671
atgactcttttttctcagcgactgaccgaattactcgaccgaacgggaaccacgcgtcggtcgtttgcacaggcactcggagtctctgatcgcatggtgcagtactacataaccggaaagaaagatccaacagttgaaactctaattgccattgctgatttctttgatgtgagtttggactatcttgttggtcgctcagagaatccagaacgaaaatga

SEQ ID NO: 2685 - DNA, 219 bp, Artificial
  Alicyclobacillus acidocaldarius mutated SEQ ID NO 2671
atgactcttttttctcagcgactgaccgaattactcgaccgaacgggaaccacgcgtcggtcgtttgcacaggcactcggagtctctgaacgcatggtgcagtactacataaccggaaagaaagatccaacagttgaaactctattagccattgctgatttctttgatgtgagtttggactatcttgttggtcgctcagagaatccagaacgaaaatga

SEQ ID NO: 2686 - DNA, 219 bp, Artificial
  Alicyclobacillus acidocaldarius mutated SEQ ID NO 2671
atgactcttttttctcagcgactgaccgaattaattgaccgaacgggaaccacgcgtcggtcgtttgcacaggcactcggagtctctgaacgcatggtgcagtactacataaccggaaagaaagatccaacagttgaaactctaattgccattgctgatttctttgatgtgagtttggactatcttgttggtcgctcagagaatccagaacgaaaatga

SEQ ID NO: 2687 - protein, 227 aa, Alicyclobacillus acidocaldarius
MCFDPDRRGDLQLQDLHRRDTMQPVDMDGNQTMMEWMFEGHRIRVVMINDEPWWVAKDVCEALQIANSRDAVSRLDEDEKNTVAITDGNRGNPNTTIINEAGLYQLTFTSRVDTAKRFRRWLAHEVLPSIRKTGEYKTPGRRQECDIAAKQVAVMEMKARTEQAKLLVDAVHRLEHRLSDLLIERILIASTNLMAGYDAIGIPTDGPSFTEPGRTRFPDLKPYWKPF

SEQ ID NO: 2688 - DNA, 684 bp, Alicyclobacillus acidocaldarius
atgtgtttcgacccagatcggaggggcgacctccaactgcaagatcttcacaggagggataccatgcaacccgtcgacatggacggaaaccaaacgatgatggaatggatgttcgaaggccatcgaatccgagtcgtcatgattaacgatgaaccgtggtgggtagcgaaagacgtttgcgaagcacttcaaattgccaacagcagagatgcggtttcgcggcttgacgaagacgagaaaaataccgtcgccattaccgacggaaatcgcgggaaccccaacacaactatcatcaacgaagcaggcctgtatcaattgacatttacaagccgcgttgacacagcgaaacgcttcaggcgctggcttgcccacgaagtcctgcccagcatccgcaagaccggcgagtacaagacgcccggacgtcgtcaggagtgcgacattgcggcgaagcaggtcgccgtgatggagatgaaggcgcgcaccgagcaggcgaagttgctggtggacgctgttcaccgactggaacatcggttgtcggatctcctgatcgaacgcatcctcattgccagcacgaatctgatggctgggtatgacgcgatcgggattccgacagacgggccgagcttcacggagcccggaaggacgcggttcccggatctcaagccgtactggaagccgttttga

SEQ ID NO: 2689 - protein, 103 aa, Klebsiella phage phiKO2
ENHPVRVVLVNGEPWFVAKDICDALKLVNSRKALSSLDDDEKNTVTLSDGNRGNPNMSIISESGLYTLILRCRDAVKQGTTAWRFRKWVTNEVLPAIRKSGEY

SEQ ID NO: 2690 - protein, 99 aa, Clostridium thermocellum
YKGKQVRTFIIDGEPWWVAKDVCDILELGDTHKAMERLDEDERNTIPVTDSLGRLQETYVVNEAGLYNLILGSRKQEAKEFKRWITHEVIPQIRKTGIY

SEQ ID NO: 2691 - protein, 107 aa, Geobacillus kaustophilus
NQLQKVFIYSGSQVRTIIKDDEVWFVAKDVCEILDIADARKAVQRLDEDERSLIPVTDSLGRKQETFIVNEPGLYTLILGSRKSEAKQFKRWVTHEVIPTIRKTGGY

SEQ ID NO: 2692 - protein, 141 aa, Thermoanaerobacter  X514
YEGNTVRTVMKDGNPWWVLKDVCSVLDIGNSRDVMARLDSDEKGVDIIDTPGGKQEVSIINESGLYSVILVSRKPEAKKFKRWVTHEVLPSIRRHGLYATDELLANPDFLIQALQELKAERAKNAELTTTISIQEQQIAEM

SEQ ID NO: 2693 - protein, 149 aa, Escherichia coli
FDSVNVRVVYLNGDPWFVAKDVCVALEISNSRDALKALDADEKKTVALSYGIRGNPNHSLISESGFYKLIARSRKAVTPGTFAHRFSNWVFRNVIPGIRKTGAYGIPWGALQDFSRRKEQYQLSASQKGRELQACKRKKRELEEEEKRL

SEQ ID NO: 2694 - protein, 227 aa, Artificial
  Alicyclobacillus acidocaldarius mutated SEQ ID NO 2687
MCFDPDRRGDLNLQDLHRRDTMQPVDMDGNQTMMEWMFEGHRIRVVMINDEPWWVAKDVCEALQIANSRDAVSRLDEDEKNTVAITDGNRGNPNTTIINEAGLYQLTFTSRVDTAKRFRRWLAHEVLPSIRKTGEYKTPGRRQECDIAAKQVAVMEMKARTEQAKLLVDAVHRLEHRLSDLLIERILIASTNLMAGYDAIGIPTDGPSFTEPGRTRFPDLKPYWKPF

SEQ ID NO: 2695 - protein, 227 aa, Artificial
  Alicyclobacillus acidocaldarius mutated SEQ ID NO 2687
MCFDPDRRGDLQLQDLHRRDTMQPVDMDGNQTMMEWMFEGHRIRVVMINDEPWWVAKDVCEALQIANSRDAVSRLDEDEKQTVAITDGNRGNPNTTIINEAGLYQLTFTSRVDTAKRFRRWLAHEVLPSIRKTGEYKTPGRRQECDIAAKQVAVMEMKARTEQAKLLVDAVHRLEHRLSDLLIERILIASTNLMAGYDAIGIPTDGPSFTEPGRTRFPDLKPYWKPF

SEQ ID NO: 2696 - protein, 227 aa, Artificial
  Alicyclobacillus acidocaldarius mutated SEQ ID NO 2687
MCFDPDRRGDLQLQDLHRRDTMQPVDMDGNQTMMEWMFEGHRIRVVMINDEPWWVAKDVCEALQIANSRDAVSRLDEDEKNTVAITDGNRGNPNTTIINEAGLYQLTFTSRVDTAKRFRRWLAHEVLPSIRKTGEYKTPGRRQECDIAAKQVAVMEMKARTEQAKLLVDAVHRLEHRLSDLLIERILIASTNLMAGYDAIGIPTDGPSFTEPGRTRFPDLRPYWKPF

SEQ ID NO: 2697 - protein, 227 aa, Artificial
  Alicyclobacillus acidocaldarius mutated SEQ ID NO 2687
MCFDPDRRGDLQLQDLHRRDTMQPVDMDGNQTMMEWMFEGHRIRVVMINDEPWWVAKDVCEALQIANSRDAVSRLDEDEKNTVAITDGNRGNPNTTIINEAGLYQLTFTSRVDTAKRFRRWLAHEVLPSIRKTGEYKTPGRRQECDIAAKQVAVMEMKARTEQAKLLVDAVHRLEHRLSDLLIERILIASTNLMAGYDALGIPTDGPSFTEPGRTRFPDLKPYWKPF

SEQ ID NO: 2698 - protein, 227 aa, Artificial
  Alicyclobacillus acidocaldarius mutated SEQ ID NO 2687
MCFDPDRRGDLQLQDLHRRDTMQPIDMDGNQTMMEWMFEGHRIRVVMINDEPWWVAKDVCEALQIANSRDAVSRLDEDEKNTVAITDGNRGNPNTTIINEAGLYQLTFTSRVDTAKRFRRWLAHEVLPSIRKTGEYKTPGRRQECDIAAKQVAVMEMKARTEQAKLLVDAVHRLEHRLSDLLIERILIASTNLMAGYDAIGIPTDGPSFTEPGRTRFPDLKPYWKPF

SEQ ID NO: 2699 - DNA, 684 bp, Artificial
  Alicyclobacillus acidocaldarius mutated SEQ ID NO 2688
atgtgtttcgacccagatcggaggggcgacctcaatctgcaagatcttcacaggagggataccatgcaacccgtcgacatggacggaaaccaaacgatgatggaatggatgttcgaaggccatcgaatccgagtcgtcatgattaacgatgaaccgtggtgggtagcgaaagacgtttgcgaagcacttcaaattgccaacagcagagatgcggtttcgcggcttgacgaagacgagaaaaataccgtcgccattaccgacggaaatcgcgggaaccccaacacaactatcatcaacgaagcaggcctgtatcaattgacatttacaagccgcgttgacacagcgaaacgcttcaggcgctggcttgcccacgaagtcctgcccagcatccgcaagaccggcgagtacaagacgcccggacgtcgtcaggagtgcgacattgcggcgaagcaggtcgccgtgatggagatgaaggcgcgcaccgagcaggcgaagttgctggtggacgctgttcaccgactggaacatcggttgtcggatctcctgatcgaacgcatcctcattgccagcacgaatctgatggctgggtatgacgcgatcgggattccgacagacgggccgagcttcacggagcccggaaggacgcggttcccggatctcaagccgtactggaagccgttttga

SEQ ID NO: 2700 - DNA, 684 bp, Artificial
  Alicyclobacillus acidocaldarius mutated SEQ ID NO 2688
atgtgtttcgacccagatcggaggggcgacctccaactgcaagatcttcacaggagggataccatgcaacccgtcgacatggacggaaaccaaacgatgatggaatggatgttcgaaggccatcgaatccgagtcgtcatgattaacgatgaaccgtggtgggtagcgaaagacgtttgcgaagcacttcaaattgccaacagcagagatgcggtttcgcggcttgacgaagacgagaaacaaaccgtcgccattaccgacggaaatcgcgggaaccccaacacaactatcatcaacgaagcaggcctgtatcaattgacatttacaagccgcgttgacacagcgaaacgcttcaggcgctggcttgcccacgaagtcctgcccagcatccgcaagaccggcgagtacaagacgcccggacgtcgtcaggagtgcgacattgcggcgaagcaggtcgccgtgatggagatgaaggcgcgcaccgagcaggcgaagttgctggtggacgctgttcaccgactggaacatcggttgtcggatctcctgatcgaacgcatcctcattgccagcacgaatctgatggctgggtatgacgcgatcgggattccgacagacgggccgagcttcacggagcccggaaggacgcggttcccggatctcaagccgtactggaagccgttttga

SEQ ID NO: 2701 - DNA, 684 bp, Artificial
  Alicyclobacillus acidocaldarius mutated SEQ ID NO 2688
atgtgtttcgacccagatcggaggggcgacctccaactgcaagatcttcacaggagggataccatgcaacccgtcgacatggacggaaaccaaacgatgatggaatggatgttcgaaggccatcgaatccgagtcgtcatgattaacgatgaaccgtggtgggtagcgaaagacgtttgcgaagcacttcaaattgccaacagcagagatgcggtttcgcggcttgacgaagacgagaaaaataccgtcgccattaccgacggaaatcgcgggaaccccaacacaactatcatcaacgaagcaggcctgtatcaattgacatttacaagccgcgttgacacagcgaaacgcttcaggcgctggcttgcccacgaagtcctgcccagcatccgcaagaccggcgagtacaagacgcccggacgtcgtcaggagtgcgacattgcggcgaagcaggtcgccgtgatggagatgaaggcgcgcaccgagcaggcgaagttgctggtggacgctgttcaccgactggaacatcggttgtcggatctcctgatcgaacgcatcctcattgccagcacgaatctgatggctgggtatgacgcgatcgggattccgacagacgggccgagcttcacggagcccggaaggacgcggttcccggatctccgtccgtactggaagccgttttga

SEQ ID NO: 2702 - DNA, 684 bp, Artificial
  Alicyclobacillus acidocaldarius mutated SEQ ID NO 2688
atgtgtttcgacccagatcggaggggcgacctccaactgcaagatcttcacaggagggataccatgcaacccgtcgacatggacggaaaccaaacgatgatggaatggatgttcgaaggccatcgaatccgagtcgtcatgattaacgatgaaccgtggtgggtagcgaaagacgtttgcgaagcacttcaaattgccaacagcagagatgcggtttcgcggcttgacgaagacgagaaaaataccgtcgccattaccgacggaaatcgcgggaaccccaacacaactatcatcaacgaagcaggcctgtatcaattgacatttacaagccgcgttgacacagcgaaacgcttcaggcgctggcttgcccacgaagtcctgcccagcatccgcaagaccggcgagtacaagacgcccggacgtcgtcaggagtgcgacattgcggcgaagcaggtcgccgtgatggagatgaaggcgcgcaccgagcaggcgaagttgctggtggacgctgttcaccgactggaacatcggttgtcggatctcctgatcgaacgcatcctcattgccagcacgaatctgatggctgggtatgacgcgttagggattccgacagacgggccgagcttcacggagcccggaaggacgcggttcccggatctcaagccgtactggaagccgttttga

SEQ ID NO: 2703 - DNA, 684 bp, Artificial
  Alicyclobacillus acidocaldarius mutated SEQ ID NO 2688
atgtgtttcgacccagatcggaggggcgacctccaactgcaagatcttcacaggagggataccatgcaacccattgacatggacggaaaccaaacgatgatggaatggatgttcgaaggccatcgaatccgagtcgtcatgattaacgatgaaccgtggtgggtagcgaaagacgtttgcgaagcacttcaaattgccaacagcagagatgcggtttcgcggcttgacgaagacgagaaaaataccgtcgccattaccgacggaaatcgcgggaaccccaacacaactatcatcaacgaagcaggcctgtatcaattgacatttacaagccgcgttgacacagcgaaacgcttcaggcgctggcttgcccacgaagtcctgcccagcatccgcaagaccggcgagtacaagacgcccggacgtcgtcaggagtgcgacattgcggcgaagcaggtcgccgtgatggagatgaaggcgcgcaccgagcaggcgaagttgctggtggacgctgttcaccgactggaacatcggttgtcggatctcctgatcgaacgcatcctcattgccagcacgaatctgatggctgggtatgacgcgatcgggattccgacagacgggccgagcttcacggagcccggaaggacgcggttcccggatctcaagccgtactggaagccgttttga

SEQ ID NO: 2704 - protein, 159 aa, Alicyclobacillus acidocaldarius
MCVVVMGGWEMEVKVQIVSPLLTADDLPQYATQGSAGMDLRACLEAPRVVRPGEIVPVPTGLAIQLPRRDAVALVYARSGLAAKHGIALANGVGVIDSDYTGEIVVPLHHFGSKEFVLQPKERIAQLVIAPIYVARLVAVDHLGPTARGAGGFGSTGRV

SEQ ID NO: 2705 - DNA, 480 bp, Alicyclobacillus acidocaldarius
gtgtgtgtcgtcgtgatgggcggttgggagatggaggtcaaagtccaaatcgtgtcgcccctcctcaccgccgacgatctgcctcagtacgccacgcagggctctgccggcatggatctccgcgcttgcctggaagcgccccgggttgtgcgcccgggcgagatcgtgcccgtgccgacgggccttgccattcagctgccccgacgcgacgcggtcgcgctcgtgtacgcgcgaagtgggctcgcggcaaaacacggcatcgcgctcgcgaacggcgtcggggtcatcgacagtgactacacgggcgagatcgtcgtgccgcttcaccacttcggctctaaggagttcgtcctgcagccgaaggagcgcatcgcccagcttgtgattgcccccatctatgtggcgcgcctcgtggcggtggaccatctcggccccaccgcgcgcggcgccggcgggttcggatcgacggggcgggtgtaa

SEQ ID NO: 2706 - protein, 136 aa, Pelotomaculum thermopropionicum
AISLPRYATDGSAGLDLPACLDEPLAVPPGARVKVPTGIAIEIPHRNIAGLVFPRSGLASKHGISLANAVGVIDSDYKGEIVIAVFNQSDQEYLIKPGERVAQLVFVPVFTATLDVVENLNCSSRGEGGFGSTGRI

SEQ ID NO: 2707 - protein, 132 aa, Faecalibacterium prausnitzii
VPAYATPGAAAADLCAVLDAPLTVAPMQRVLVPTGLAIELPGAHSVALVYARSGLSIKHGLCMANGVGVVDSDYRGELKVPMVNLGAEAYTIQPGERVAQLCIAPVYTAAFVPAEELGDTQRGVGGFGSTGK

SEQ ID NO: 2708 - protein, 134 aa, Desulfitobacterium hafniense
APKLPQYATPGAAGVDLQASLDQELTIEPGQIVKIPTGLAIELPHAGVGAFVFARSGLASKYGLALANGVGVIDSDYRGEILVAVINQGSEPFVVKDGDRIAQMVFLPVFIGEFYLADQLDETGRGCGGFGSTG

SEQ ID NO: 2709 - protein, 134 aa, Burkholderia ubonensis
DYLPAYATTGSAGLDLRACLDAPLTLKPGETALVPTGLAIHLADPGYAALILPRSGLGHKHGIVLGNLVGLIDSDYQGELMISTWNRGQTEFVLNPFERLAQLVIVPVVQAQFNIVDDFAASDRGAGGFGSTGR

SEQ ID NO: 2710 - protein, 134 aa, Burkholderia pseudomallei
DYLPKYATTGSAGLDLRACLDAPVTLKPGDTALVPTGLAIHLADPGYTALILPRSGLGHKHGIVLGNLVGLIDSDYQGELMISTWNRGQTEFALNPFERLAQLVIVPVVQARFNLVDDFAQSERGAGGFGSTGR

SEQ ID NO: 2711 - protein, 159 aa, Artificial
  Alicyclobacillus acidocaldarius mutated SEQ ID NO 2704
MCVVVMGGWEMEVKVQIVSPLLTADDLPQYATQGSAGMDLRACLEAPRVVRPGEIVPVPTGLAIQLPRRDAVALVYARSGLAAKHGIALANGVGVIDSDYTGEIVVPIHHFGSKEFVLQPKERIAQLVIAPIYVARLVAVDHLGPTARGAGGFGSTGRV

SEQ ID NO: 2712 - protein, 159 aa, Artificial
  Alicyclobacillus acidocaldarius mutated SEQ ID NO 2704
MCVVVMGGWEMEVKVQIVSPLLTADDLPQYATQGSAGMDLRACLEAPRVVRPGEIVPVPTGLAIQLPRRDAVALVYARSGLAAKHGIALANGVGVIDSDYTGEIVVPLHHFGSKEFVLQPKERIAQLVIAPIYVARLVAVDHLGPTARGAGGFGSTGKV

SEQ ID NO: 2713 - protein, 159 aa, Artificial
  Alicyclobacillus acidocaldarius mutated SEQ ID NO 2704
MCIVVMGGWEMEVKVQIVSPLLTADDLPQYATQGSAGMDLRACLEAPRVVRPGEIVPVPTGLAIQLPRRDAVALVYARSGLAAKHGIALANGVGVIDSDYTGEIVVPLHHFGSKEFVLQPKERIAQLVIAPIYVARLVAVDHLGPTARGAGGFGSTGRV

SEQ ID NO: 2714 - protein, 159 aa, Artificial
  Alicyclobacillus acidocaldarius mutated SEQ ID NO 2704
MCVVIMGGWEMEVKVQIVSPLLTADDLPQYATQGSAGMDLRACLEAPRVVRPGEIVPVPTGLAIQLPRRDAVALVYARSGLAAKHGIALANGVGVIDSDYTGEIVVPLHHFGSKEFVLQPKERIAQLVIAPIYVARLVAVDHLGPTARGAGGFGSTGRV

SEQ ID NO: 2715 - protein, 159 aa, Artificial
  Alicyclobacillus acidocaldarius mutated SEQ ID NO 2704
MCVVVMGGWEMEVKVNIVSPLLTADDLPQYATQGSAGMDLRACLEAPRVVRPGEIVPVPTGLAIQLPRRDAVALVYARSGLAAKHGIALANGVGVIDSDYTGEIVVPLHHFGSKEFVLQPKERIAQLVIAPIYVARLVAVDHLGPTARGAGGFGSTGRV

SEQ ID NO: 2716 - DNA, 480 bp, Artificial
  Alicyclobacillus acidocaldarius mutated SEQ ID NO 2705
gtgtgtgtcgtcgtgatgggcggttgggagatggaggtcaaagtccaaatcgtgtcgcccctcctcaccgccgacgatctgcctcagtacgccacgcagggctctgccggcatggatctccgcgcttgcctggaagcgccccgggttgtgcgcccgggcgagatcgtgcccgtgccgacgggccttgccattcagctgccccgacgcgacgcggtcgcgctcgtgtacgcgcgaagtgggctcgcggcaaaacacggcatcgcgctcgcgaacggcgtcggggtcatcgacagtgactacacgggcgagatcgtcgtgccgattcaccacttcggctctaaggagttcgtcctgcagccgaaggagcgcatcgcccagcttgtgattgcccccatctatgtggcgcgcctcgtggcggtggaccatctcggccccaccgcgcgcggcgccggcgggttcggatcgacggggcgggtgtaa

SEQ ID NO: 2717 - DNA, 480 bp, Artificial
  Alicyclobacillus acidocaldarius mutated SEQ ID NO 2705
gtgtgtgtcgtcgtgatgggcggttgggagatggaggtcaaagtccaaatcgtgtcgcccctcctcaccgccgacgatctgcctcagtacgccacgcagggctctgccggcatggatctccgcgcttgcctggaagcgccccgggttgtgcgcccgggcgagatcgtgcccgtgccgacgggccttgccattcagctgccccgacgcgacgcggtcgcgctcgtgtacgcgcgaagtgggctcgcggcaaaacacggcatcgcgctcgcgaacggcgtcggggtcatcgacagtgactacacgggcgagatcgtcgtgccgcttcaccacttcggctctaaggagttcgtcctgcagccgaaggagcgcatcgcccagcttgtgattgcccccatctatgtggcgcgcctcgtggcggtggaccatctcggccccaccgcgcgcggcgccggcgggttcggatcgacggggaaagtgtaa

SEQ ID NO: 2718 - DNA, 480 bp, Artificial
  Alicyclobacillus acidocaldarius mutated SEQ ID NO 2705
gtgtgtattgtcgtgatgggcggttgggagatggaggtcaaagtccaaatcgtgtcgcccctcctcaccgccgacgatctgcctcagtacgccacgcagggctctgccggcatggatctccgcgcttgcctggaagcgccccgggttgtgcgcccgggcgagatcgtgcccgtgccgacgggccttgccattcagctgccccgacgcgacgcggtcgcgctcgtgtacgcgcgaagtgggctcgcggcaaaacacggcatcgcgctcgcgaacggcgtcggggtcatcgacagtgactacacgggcgagatcgtcgtgccgcttcaccacttcggctctaaggagttcgtcctgcagccgaaggagcgcatcgcccagcttgtgattgcccccatctatgtggcgcgcctcgtggcggtggaccatctcggccccaccgcgcgcggcgccggcgggttcggatcgacggggcgggtgtaa

SEQ ID NO: 2719 - DNA, 480 bp, Artificial
  Alicyclobacillus acidocaldarius mutated SEQ ID NO 2705
gtgtgtgtcgtcattatgggcggttgggagatggaggtcaaagtccaaatcgtgtcgcccctcctcaccgccgacgatctgcctcagtacgccacgcagggctctgccggcatggatctccgcgcttgcctggaagcgccccgggttgtgcgcccgggcgagatcgtgcccgtgccgacgggccttgccattcagctgccccgacgcgacgcggtcgcgctcgtgtacgcgcgaagtgggctcgcggcaaaacacggcatcgcgctcgcgaacggcgtcggggtcatcgacagtgactacacgggcgagatcgtcgtgccgcttcaccacttcggctctaaggagttcgtcctgcagccgaaggagcgcatcgcccagcttgtgattgcccccatctatgtggcgcgcctcgtggcggtggaccatctcggccccaccgcgcgcggcgccggcgggttcggatcgacggggcgggtgtaa

SEQ ID NO: 2720 - DNA, 480 bp, Artificial
  Alicyclobacillus acidocaldarius mutated SEQ ID NO 2705
gtgtgtgtcgtcgtgatgggcggttgggagatggaggtcaaagtcaatatcgtgtcgcccctcctcaccgccgacgatctgcctcagtacgccacgcagggctctgccggcatggatctccgcgcttgcctggaagcgccccgggttgtgcgcccgggcgagatcgtgcccgtgccgacgggccttgccattcagctgccccgacgcgacgcggtcgcgctcgtgtacgcgcgaagtgggctcgcggcaaaacacggcatcgcgctcgcgaacggcgtcggggtcatcgacagtgactacacgggcgagatcgtcgtgccgcttcaccacttcggctctaaggagttcgtcctgcagccgaaggagcgcatcgcccagcttgtgattgcccccatctatgtggcgcgcctcgtggcggtggaccatctcggccccaccgcgcgcggcgccggcgggttcggatcgacggggcgggtgtaa

SEQ ID NO: 2721 - protein, 378 aa, Alicyclobacillus acidocaldarius; identical to SEQ ID NO: 1837

SEQ ID NO: 2722 - DNA, 1137 bp, Alicyclobacillus acidocaldarius; identical to SEQ ID NO: 1838

SEQ ID NO: 2723 - protein, 323 aa, Paenibacillus  JDR-2; identical to SEQ ID NO: 1839

SEQ ID NO: 2724 - protein, 328 aa, Bacillus halodurans; identical to SEQ ID NO: 1840

SEQ ID NO: 2725 - protein, 324 aa, Bacillus megaterium; identical to SEQ ID NO: 1841

SEQ ID NO: 2726 - protein, 325 aa, Bacillus licheniformis; identical to SEQ ID NO: 1842

SEQ ID NO: 2727 - protein, 325 aa, Bacillus amyloliquefaciens; identical to SEQ ID NO: 1843

SEQ ID NO: 2728 - protein, 378 aa, Artificial; identical to SEQ ID NO: 1846
  Alicyclobacillus acidocaldarius mutated SEQ ID NO 2721

SEQ ID NO: 2729 - protein, 378 aa, Artificial
  Alicyclobacillus acidocaldarius mutated SEQ ID NO 2721
MFGSRRRRGSRAYALEEIEGWCVMGDKKAALEQALRKIEKEFGKGSIMRLGEAAAMTVETVPTGSIALDIALGVGGLPRGRIVEIYGPESSGKTTVALHVVAEVQKLGGQAAFIDAEHALDPVYAQKLGVNIDELLISQPDTGEQALEIAEALVRSGAVDVIVVDSVAALVPKNELEGDMGDSHVGLQARLMSQALRKLAGAISKSKTIAIFINQIREKVGVMFGNPETTTGGRALKFYASVRLEVRRVEAIKQGNDVVGSRTRIKVVKNKVAPPFRQCDVDIMFGEGISREGSLIDIATEIDVVQKSGAWYSFGEERLGQGRENAKQYLKEHPEIAEQIEAAVREYFHVNPAKPLVAAAAEDAEDDADDAFDEFDAF

SEQ ID NO: 2730 - protein, 378 aa, Artificial
  Alicyclobacillus acidocaldarius mutated SEQ ID NO 2721
MFGSRRRRGSRAYALEEIEGWCVMGDKKAALEQALRKIEKEFGKGSIMRLGEAAAMTVETVPTGSIALDIALGVGGLPRGRIVELYGPESSGKTTVALHVVAEVQKLGGQAAFIDAEHALDPVYAQKLGVNIDELLISQPDTGEQALEIAEALVRSGAVDVIVVDSVAALVPKNELEGDMGDSHVGLQARLMSQALRKLAGAISKSKTIAIFINQIREKVGVMFGNPETTTGGRALKFYASVRLEVRRVEAIKQGNDVVGSRTRIKVVKNKVAPPFRQCDVDIMFGEGISREGSLIDIATEIDVVQKSGAWYSFGEERLGQGRENAKQYLKEHPEIAEQIEAAVREYFHVNPAKPLVAAAAEDADDDADDAFDEFDAF

SEQ ID NO: 2731 - protein, 378 aa, Artificial; identical to SEQ ID NO: 1848
  Alicyclobacillus acidocaldarius mutated SEQ ID NO 2721

SEQ ID NO: 2732 - protein, 378 aa, Artificial
  Alicyclobacillus acidocaldarius mutated SEQ ID NO 2721
MFGSRKRRGSRAYALEEIEGWCVMGDKKAALEQALRKIEKEFGKGSIMRLGEAAAMTVETVPTGSIALDIALGVGGLPRGRIVEIYGPESSGKTTVALHVVAEVQKLGGQAAFIDAEHALDPVYAQKLGVNIDELLISQPDTGEQALEIAEALVRSGAVDVIVVDSVAALVPKNELEGDMGDSHVGLQARLMSQALRKLAGAISKSKTIAIFINQIREKVGVMFGNPETTTGGRALKFYASVRLEVRRVEAIKQGNDVVGSRTRIKVVKNKVAPPFRQCDVDIMFGEGISREGSLIDIATEIDVVQKSGAWYSFGEERLGQGRENAKQYLKEHPEIAEQIEAAVREYFHVNPAKPLVAAAAEDADDDADDAFDEFDAF

SEQ ID NO: 2733 - DNA, 1137 bp, Artificial; identical to SEQ ID NO: 1851
  Alicyclobacillus acidocaldarius mutated SEQ ID NO 2722

SEQ ID NO: 2734 - DNA, 1137 bp, Artificial
  Alicyclobacillus acidocaldarius mutated SEQ ID NO 2722
gtgttcgggagcaggcggagaagaggctcacgggcatacgcgcttgaagaaattgagggatggtgtgtcatgggagacaaaaaggcggctttggaacaagccctgcgaaaaattgagaaggaatttggcaagggttccatcatgagactcggcgaagcggccgcgatgacggtcgagaccgtgccgacggggtcgattgcgcttgacattgcgctcggcgtcggaggactgcctcgtgggagaatcgtggaaatctacggaccggagtcgtcgggcaagacgaccgtggcgcttcacgttgtcgcggaggtgcagaagctgggcggtcaggcggcgttcatcgacgccgaacacgcgttggatccggtctatgcccaaaagctcggcgtcaacatcgacgaactcctgatttctcagccggacacgggggaacaggcgctcgagatcgccgaggcgctggttcggagtggcgcggtggacgtgatcgtcgtggactccgtggcagccttggttccgaagaacgaactcgagggcgacatgggcgattcgcacgtcggattgcaggcgcgcctgatgtcgcaggcgctgcgcaagttggcgggcgccatcagcaagtcgaagaccatcgccatcttcatcaaccaaatccgcgaaaaggtcggcgtcatgttcggaaatcccgagaccacgacaggcgggcgcgcgctgaaattctacgcctccgtgcggctggaggtccggcgcgtcgaggccatcaaacaggggaatgacgtggtgggatcgcggacgcggatcaaggtcgtgaagaacaaggtggcgccgccgttccgccagtgcgacgtggatatcatgtttggggaagggatctcgcgagagggcagcttgatcgatatcgccaccgagatcgacgtcgtccagaaaagcggagcctggtattcctttggtgaggagcggctcggacaagggcgtgaaaacgccaagcagtacctgaaggagcatccggagatcgcggagcaaatcgaggcggcggttcgcgagtacttccacgtgaatccggccaagccgctggttgcagccgctgcggaggatgcggaagatgacgcggatgacgcattcgacgaattcgacgccttctga

SEQ ID NO: 2735 - DNA, 1137 bp, Artificial
  Alicyclobacillus acidocaldarius mutated SEQ ID NO 2722
gtgttcgggagcaggcggagaagaggctcacgggcatacgcgcttgaagaaattgagggatggtgtgtcatgggagacaaaaaggcggctttggaacaagccctgcgaaaaattgagaaggaatttggcaagggttccatcatgagactcggcgaagcggccgcgatgacggtcgagaccgtgccgacggggtcgattgcgcttgacattgcgctcggcgtcggaggactgcctcgtgggagaatcgtggaattatacggaccggagtcgtcgggcaagacgaccgtggcgcttcacgttgtcgcggaggtgcagaagctgggcggtcaggcggcgttcatcgacgccgaacacgcgttggatccggtctatgcccaaaagctcggcgtcaacatcgacgaactcctgatttctcagccggacacgggggaacaggcgctcgagatcgccgaggcgctggttcggagtggcgcggtggacgtgatcgtcgtggactccgtggcagccttggttccgaagaacgaactcgagggcgacatgggcgattcgcacgtcggattgcaggcgcgcctgatgtcgcaggcgctgcgcaagttggcgggcgccatcagcaagtcgaagaccatcgccatcttcatcaaccaaatccgcgaaaaggtcggcgtcatgttcggaaatcccgagaccacgacaggcgggcgcgcgctgaaattctacgcctccgtgcggctggaggtccggcgcgtcgaggccatcaaacaggggaatgacgtggtgggatcgcggacgcggatcaaggtcgtgaagaacaaggtggcgccgccgttccgccagtgcgacgtggatatcatgtttggggaagggatctcgcgagagggcagcttgatcgatatcgccaccgagatcgacgtcgtccagaaaagcggagcctggtattcctttggtgaggagcggctcggacaagggcgtgaaaacgccaagcagtacctgaaggagcatccggagatcgcggagcaaatcgaggcggcggttcgcgagtacttccacgtgaatccggccaagccgctggttgcagccgctgcggaggatgcggatgatgacgcggatgacgcattcgacgaattcgacgccttctga

SEQ ID NO: 2736 - DNA, 1137 bp, Artificial; identical to SEQ ID NO: 1853
  Alicyclobacillus acidocaldarius mutated SEQ ID NO 2722

SEQ ID NO: 2737 - DNA, 1137 bp, Artificial
  Alicyclobacillus acidocaldarius mutated SEQ ID NO 2722
gtgttcgggagcaggaaaagaagaggctcacgggcatacgcgcttgaagaaattgagggatggtgtgtcatgggagacaaaaaggcggctttggaacaagccctgcgaaaaattgagaaggaatttggcaagggttccatcatgagactcggcgaagcggccgcgatgacggtcgagaccgtgccgacggggtcgattgcgcttgacattgcgctcggcgtcggaggactgcctcgtgggagaatcgtggaaatctacggaccggagtcgtcgggcaagacgaccgtggcgcttcacgttgtcgcggaggtgcagaagctgggcggtcaggcggcgttcatcgacgccgaacacgcgttggatccggtctatgcccaaaagctcggcgtcaacatcgacgaactcctgatttctcagccggacacgggggaacaggcgctcgagatcgccgaggcgctggttcggagtggcgcggtggacgtgatcgtcgtggactccgtggcagccttggttccgaagaacgaactcgagggcgacatgggcgattcgcacgtcggattgcaggcgcgcctgatgtcgcaggcgctgcgcaagttggcgggcgccatcagcaagtcgaagaccatcgccatcttcatcaaccaaatccgcgaaaaggtcggcgtcatgttcggaaatcccgagaccacgacaggcgggcgcgcgctgaaattctacgcctccgtgcggctggaggtccggcgcgtcgaggccatcaaacaggggaatgacgtggtgggatcgcggacgcggatcaaggtcgtgaagaacaaggtggcgccgccgttccgccagtgcgacgtggatatcatgtttggggaagggatctcgcgagagggcagcttgatcgatatcgccaccgagatcgacgtcgtccagaaaagcggagcctggtattcctttggtgaggagcggctcggacaagggcgtgaaaacgccaagcagtacctgaaggagcatccggagatcgcggagcaaatcgaggcggcggttcgcgagtacttccacgtgaatccggccaagccgctggttgcagccgctgcggaggatgcggatgatgacgcggatgacgcattcgacgaattcgacgccttctga

SEQ ID NO: 2738 - protein, 260 aa, Alicyclobacillus acidocaldarius
MIARMETRTMDVTTMGRGVSMRLAFFSDVHGNELALDAVIADLRQVGCDGVYVLGDLAFRGYAPKACVEKVAEVADKVIRGNADEWVVRGVRPGEVPDERRAGMDEEAAFARGLLAREELEYLANLPLLLQEESPFGRWLAFHATPLDPFPVVAADAPDDDIESRIVAGQDARLYLYGHIHVPYVRDIRGRTVVNLGSVGMPFDGVPQASYVILHVDEDVFRVEHRRVPYDVEAACRRYDEIGYPAAEMMKRVLRTARPV

SEQ ID NO: 2739 - DNA, 783 bp, Alicyclobacillus acidocaldarius
gtgatcgcccggatggaaacgcgtacaatggacgtgaccacgatgggaaggggagtgtcgatgcggctcgcgtttttctcggacgtgcacggaaacgagctggcgctcgatgcggtcatcgccgatctgcggcaagtgggatgcgatggcgtctatgtgctcggcgatcttgcgtttcggggatatgcgccgaaggcgtgcgtggagaaggtcgccgaggtggcggacaaggtcatccgcggcaacgccgacgaatgggtggtgcgcggggtgcggcccggcgaggtgccggacgagcggcgcgccggcatggacgaggaggcagcgttcgcaagggggttgctcgcgcgagaggaactcgaatacctcgccaacttgccgctgctgctccaggaggagtcgccgtttgggcgctggctcgcctttcacgccacgccgctcgatccgtttccggtggtcgcggcggacgcgccagatgacgacatcgagtcgcgtatcgtcgcggggcaggacgcgcggctgtacctgtacggtcacattcacgtgccgtatgtccgcgatatccgtgggagaacggtcgtcaacctcggcagcgtcggcatgccgttcgacggcgtgccccaggcgtcgtacgtcatcctgcacgtggatgaggacgtgttccgcgtggaacatcgccgggttccctacgacgtggaggccgcgtgcaggcggtacgacgagatcggctatccggcggccgagatgatgaagcgcgtgttacgcaccgcgcgacccgtctga

SEQ ID NO: 2740 - protein, 240 aa, Bacillus halodurans
MKAAFISDIHGNAQALEAVLTDIESKQVDQIIVLGDICFRGIEPKRSLELVRSLQVPVVKGNADEWVVRGIRKGEVPDSVLEVMRIEREWTYGKLDESDIDFLKQLPTVHTFSLSDTWNVLCFHATPTSLFDIVTPTAADHVVKEKLMAQNQANLYLYGHIHLPYVRFIDGKIVANLGSVGLPFDGVCQASYLLVDGAEEQFSVTIQRVSYDIHSVCEQIEASDYPNPTFLQNVLKHGKP

SEQ ID NO: 2741 - protein, 234 aa, Bacillus clausii
MRFAFLSDIHGNATALEAVLNDLQTKQIDQTYILGDLCFRGPEPKRVLELVQASGARVIKGNADEWLVRGFKDGEVPVERLEMFNKERDWTLGRLSQEDLDYLKNLPTELVIDDGQDLVIHAFHASPSGLFTAIDGDETEKIENELMVRDEADIYIYGHTHHPYVRSLHGKNVINTGSVGMPFDGHPLASYIILDIEDGSHSVQLNRVPYNREHVVEIYKQSGYPNIEAMSAVI

SEQ ID NO: 2742 - protein, 241 aa, Bacillus selenitireducens
MRLALLSDIHGNEAALRAVLEDLSRKNASHVAVLGDISYRGPKPKECLDLIRELHGKVIKGNADEWLIRGIREGELPQQAFAIMQREQAWSYGKMTDEGLHYLNQLPTELEIPLTNRIQLYATHAFPDDLFKVIPEHAENSAFDAFFEHNPRAMYYAYGHIHIPHMRNITGNTLLNTGSIGLPFDGNPDASYVMLERTNDSISTSFHRVAYDIEKAVFDLKDTDYPEDAAPLLESIYRTGK

SEQ ID NO: 2743 - protein, 237 aa, Bacillus coagulans
MKLAFISDIHGNAHALEAVLEDIEQKRADKIFVLGDLCFRGPEPQRAYEMVMALNTEVIKGNADEWVYRGVGMNEVPEKAYEMMNRERDWTVSRMEQNAVESLHQLPEEVKYEYGGIKIHGFHATPYSLFENVPPDSENSKLKEKLMQEDADIYLYAHIHLPFIRTFDGKTFVNLGSVGLPFDGIAKASYAMVEIGDHDYQVSNVRVSYDVQKTIGLFEASDYPNKDKLIDILTRAK

SEQ ID NO: 2744 - protein, 231 aa, Candidatus Kuenenia
MKILIISDIHGNEAALKAVLEETADMIFCLGDIVNYGPYPKECIEKIRKLTDKIVRGNHDNAIGKNMECGCSEKYKALSDQGKIFTKTILDAGEKEFLANLPLTLNTEAGGVTFLLSHGSPGGDIYKYLRPEVSDSEMEDELKGVRANIVLLGHTHLPVVRKVGEITVVNPGSVGQPRDGIPLASYAIWKDGALEIKRVPYDIDATARGLQHTTIPADHVARLEEILRKGR

SEQ ID NO: 2745 - protein, 260 aa, Artificial
  Alicyclobacillus acidocaldarius mutated SEQ ID NO 2738
MIARMETRTMDVTTMGRGVSMRLAFFSDVHGNELALDAVIADLRQVGCDGVYVLGDLAFRGYAPKACIEKVAEVADKVIRGNADEWVVRGVRPGEVPDERRAGMDEEAAFARGLLAREELEYLANLPLLLQEESPFGRWLAFHATPLDPFPVVAADAPDDDIESRIVAGQDARLYLYGHIHVPYVRDIRGRTVVNLGSVGMPFDGVPQASYVILHVDEDVFRVEHRRVPYDVEAACRRYDEIGYPAAEMMKRVLRTARPV

SEQ ID NO: 2746 - protein, 260 aa, Artificial
  Alicyclobacillus acidocaldarius mutated SEQ ID NO 2738
MIARMETRTMDVTTMGRGVSMRLAFFSDVHGNELALDAVIADLRQVGCDGVYVLGDLAFRGYAPKACVEKVAEVADKVIRGNADEWVVRGVRPGEVPDERRAGMDEEAAFARGLLAREELEYLANLPLLLQEESPFGRWLAFHATPLDPFPVVAADAPDDDIESRIVAGQDARLYLYGHIHVPYVRDIRGRTVVNLGSVGMPFDGVPQASYVILHVDEDVFRVEHRRVPYDVEAACKRYDEIGYPAAEMMKRVLRTARPV

SEQ ID NO: 2747 - protein, 260 aa, Artificial
  Alicyclobacillus acidocaldarius mutated SEQ ID NO 2738
MIARMETRTMDVTTMGRGVSMRLAFFSDVHGNELALDAVIADLRQVGCDGVYVLGDLAFRGYAPKACVEKVAEVADKVIRGNADEWVVRGVRPGEVPDERRAGMDEEAAFARGLLAREELEYLANLPLLLQEESPFGRWLAFHATPLDPFPVVAADAPDDDIESRIVAGQDARLYLYGHIHVPYVRDIRGRTVVNLGSVGMPFDGVPQASYVILHVDEDVFRVEHKRVPYDVEAACRRYDEIGYPAAEMMKRVLRTARPV

SEQ ID NO: 2748 - protein, 260 aa, Artificial
  Alicyclobacillus acidocaldarius mutated SEQ ID NO 2738
MIARMETRTMDVTTMGRGVSMRLAFFSDVHGNELALDAVIADLRQVGCDGVYVLGDLAFRGYAPKACVEKVAEVADKVIRGNADEWVVRGVRPGEVPDERRAGMDEEAAFARGLLAREEIEYLANLPLLLQEESPFGRWLAFHATPLDPFPVVAADAPDDDIESRIVAGQDARLYLYGHIHVPYVRDIRGRTVVNLGSVGMPFDGVPQASYVILHVDEDVFRVEHRRVPYDVEAACRRYDEIGYPAAEMMKRVLRTARPV

SEQ ID NO: 2749 - protein, 260 aa, Artificial
  Alicyclobacillus acidocaldarius mutated SEQ ID NO 2738
MIARMETRTMDVTTMGRGVSMRLAFFSDVHGNELALDAVIADLRQVGCDGVYVLGDLAFRGYAPKACVEKVAEVADKVIRGNADEWVVRGVRPGEVPDERRAGMDEEAAFARGLLAREELEYLANLPLLLQEESPFGKWLAFHATPLDPFPVVAADAPDDDIESRIVAGQDARLYLYGHIHVPYVRDIRGRTVVNLGSVGMPFDGVPQASYVILHVDEDVFRVEHRRVPYDVEAACRRYDEIGYPAAEMMKRVLRTARPV

SEQ ID NO: 2750 - DNA, 783 bp, Artificial
  Alicyclobacillus acidocaldarius mutated SEQ ID NO 2739
gtgatcgcccggatggaaacgcgtacaatggacgtgaccacgatgggaaggggagtgtcgatgcggctcgcgtttttctcggacgtgcacggaaacgagctggcgctcgatgcggtcatcgccgatctgcggcaagtgggatgcgatggcgtctatgtgctcggcgatcttgcgtttcggggatatgcgccgaaggcgtgcattgagaaggtcgccgaggtggcggacaaggtcatccgcggcaacgccgacgaatgggtggtgcgcggggtgcggcccggcgaggtgccggacgagcggcgcgccggcatggacgaggaggcagcgttcgcaagggggttgctcgcgcgagaggaactcgaatacctcgccaacttgccgctgctgctccaggaggagtcgccgtttgggcgctggctcgcctttcacgccacgccgctcgatccgtttccggtggtcgcggcggacgcgccagatgacgacatcgagtcgcgtatcgtcgcggggcaggacgcgcggctgtacctgtacggtcacattcacgtgccgtatgtccgcgatatccgtgggagaacggtcgtcaacctcggcagcgtcggcatgccgttcgacggcgtgccccaggcgtcgtacgtcatcctgcacgtggatgaggacgtgttccgcgtggaacatcgccgggttccctacgacgtggaggccgcgtgcaggcggtacgacgagatcggctatccggcggccgagatgatgaagcgcgtgttacgcaccgcgcgacccgtctga

SEQ ID NO: 2751 - DNA, 783 bp, Artificial
  Alicyclobacillus acidocaldarius mutated SEQ ID NO 2739
gtgatcgcccggatggaaacgcgtacaatggacgtgaccacgatgggaaggggagtgtcgatgcggctcgcgtttttctcggacgtgcacggaaacgagctggcgctcgatgcggtcatcgccgatctgcggcaagtgggatgcgatggcgtctatgtgctcggcgatcttgcgtttcggggatatgcgccgaaggcgtgcgtggagaaggtcgccgaggtggcggacaaggtcatccgcggcaacgccgacgaatgggtggtgcgcggggtgcggcccggcgaggtgccggacgagcggcgcgccggcatggacgaggaggcagcgttcgcaagggggttgctcgcgcgagaggaactcgaatacctcgccaacttgccgctgctgctccaggaggagtcgccgtttgggcgctggctcgcctttcacgccacgccgctcgatccgtttccggtggtcgcggcggacgcgccagatgacgacatcgagtcgcgtatcgtcgcggggcaggacgcgcggctgtacctgtacggtcacattcacgtgccgtatgtccgcgatatccgtgggagaacggtcgtcaacctcggcagcgtcggcatgccgttcgacggcgtgccccaggcgtcgtacgtcatcctgcacgtggatgaggacgtgttccgcgtggaacatcgccgggttccctacgacgtggaggccgcgtgcaaacggtacgacgagatcggctatccggcggccgagatgatgaagcgcgtgttacgcaccgcgcgacccgtctga

SEQ ID NO: 2752 - DNA, 783 bp, Artificial
  Alicyclobacillus acidocaldarius mutated SEQ ID NO 2739
gtgatcgcccggatggaaacgcgtacaatggacgtgaccacgatgggaaggggagtgtcgatgcggctcgcgtttttctcggacgtgcacggaaacgagctggcgctcgatgcggtcatcgccgatctgcggcaagtgggatgcgatggcgtctatgtgctcggcgatcttgcgtttcggggatatgcgccgaaggcgtgcgtggagaaggtcgccgaggtggcggacaaggtcatccgcggcaacgccgacgaatgggtggtgcgcggggtgcggcccggcgaggtgccggacgagcggcgcgccggcatggacgaggaggcagcgttcgcaagggggttgctcgcgcgagaggaactcgaatacctcgccaacttgccgctgctgctccaggaggagtcgccgtttgggcgctggctcgcctttcacgccacgccgctcgatccgtttccggtggtcgcggcggacgcgccagatgacgacatcgagtcgcgtatcgtcgcggggcaggacgcgcggctgtacctgtacggtcacattcacgtgccgtatgtccgcgatatccgtgggagaacggtcgtcaacctcggcagcgtcggcatgccgttcgacggcgtgccccaggcgtcgtacgtcatcctgcacgtggatgaggacgtgttccgcgtggaacataaacgggttccctacgacgtggaggccgcgtgcaggcggtacgacgagatcggctatccggcggccgagatgatgaagcgcgtgttacgcaccgcgcgacccgtctga

SEQ ID NO: 2753 - DNA, 783 bp, Artificial
  Alicyclobacillus acidocaldarius mutated SEQ ID NO 2739
gtgatcgcccggatggaaacgcgtacaatggacgtgaccacgatgggaaggggagtgtcgatgcggctcgcgtttttctcggacgtgcacggaaacgagctggcgctcgatgcggtcatcgccgatctgcggcaagtgggatgcgatggcgtctatgtgctcggcgatcttgcgtttcggggatatgcgccgaaggcgtgcgtggagaaggtcgccgaggtggcggacaaggtcatccgcggcaacgccgacgaatgggtggtgcgcggggtgcggcccggcgaggtgccggacgagcggcgcgccggcatggacgaggaggcagcgttcgcaagggggttgctcgcgcgagaggaaattgaatacctcgccaacttgccgctgctgctccaggaggagtcgccgtttgggcgctggctcgcctttcacgccacgccgctcgatccgtttccggtggtcgcggcggacgcgccagatgacgacatcgagtcgcgtatcgtcgcggggcaggacgcgcggctgtacctgtacggtcacattcacgtgccgtatgtccgcgatatccgtgggagaacggtcgtcaacctcggcagcgtcggcatgccgttcgacggcgtgccccaggcgtcgtacgtcatcctgcacgtggatgaggacgtgttccgcgtggaacatcgccgggttccctacgacgtggaggccgcgtgcaggcggtacgacgagatcggctatccggcggccgagatgatgaagcgcgtgttacgcaccgcgcgacccgtctga

SEQ ID NO: 2754 - DNA, 783 bp, Artificial
  Alicyclobacillus acidocaldarius mutated SEQ ID NO 2739
gtgatcgcccggatggaaacgcgtacaatggacgtgaccacgatgggaaggggagtgtcgatgcggctcgcgtttttctcggacgtgcacggaaacgagctggcgctcgatgcggtcatcgccgatctgcggcaagtgggatgcgatggcgtctatgtgctcggcgatcttgcgtttcggggatatgcgccgaaggcgtgcgtggagaaggtcgccgaggtggcggacaaggtcatccgcggcaacgccgacgaatgggtggtgcgcggggtgcggcccggcgaggtgccggacgagcggcgcgccggcatggacgaggaggcagcgttcgcaagggggttgctcgcgcgagaggaactcgaatacctcgccaacttgccgctgctgctccaggaggagtcgccgtttgggaaatggctcgcctttcacgccacgccgctcgatccgtttccggtggtcgcggcggacgcgccagatgacgacatcgagtcgcgtatcgtcgcggggcaggacgcgcggctgtacctgtacggtcacattcacgtgccgtatgtccgcgatatccgtgggagaacggtcgtcaacctcggcagcgtcggcatgccgttcgacggcgtgccccaggcgtcgtacgtcatcctgcacgtggatgaggacgtgttccgcgtggaacatcgccgggttccctacgacgtggaggccgcgtgcaggcggtacgacgagatcggctatccggcggccgagatgatgaagcgcgtgttacgcaccgcgcgacccgtctga

SEQ ID NO: 2755 - protein, 422 aa, Alicyclobacillus acidocaldarius
MPMTLQAVFRSAMLDITPLRTSPAFLRLWIGSGISTLGGTMTPFAVMLQVYRATHSTLDVGLTGLASVLPGALFVLLGGSVGDRVDRRKLALLATSGQMLVSALLAVQALIAWSALWLIYALLCAQSVLGAINAPARRTFVPRLLPKEQVRAGQTLNTLAIRFGEVAGPSLAGVIASFAGLGWCYACDAATFLAALYAIYRLPPMLPEANAKQRSMLDGVMEGLRFLGRSRALLGAMLADLSVTVLGVPTALLPALVSERFGGRPETLGLMMGATGIGGLVILALSGPVRHIRSEGKAILVACAAWAIAAGGLGLAPFVWLCVALLGLMGAADSILVVMRSTLIQQGTPDGLRGRISSVDYLVGTGGPQLGNLRAGLVGSLLPPGASIAVGGLSTLAAILCVGWFVPELRRAQAEEGVGASD

SEQ ID NO: 2756 - DNA, 1269 bp, Alicyclobacillus acidocaldarius
atgcccatgacgcttcaagccgtgttccgctcggcgatgttggacatcacgccgcttcgcacgtctcccgcgtttttgcggctctggattggcagcgggatctcgacgctcgggggcaccatgacgcccttcgcggtcatgctgcaggtgtatcgagccacgcacagcaccctcgatgtcgggctgaccggcctcgccagcgtgctgccgggtgcgctgttcgtgctcctcggcggaagcgtgggcgatcgcgtcgatcgccgcaagctcgcccttctcgccacaagcgggcagatgctcgtgtcggcgctcctcgctgtgcaggcgctcatcgcgtggtccgcgctctggctcatctacgcgctgttgtgcgcgcagtcggtgctcggagccatcaacgccccagcgcgccggacgtttgtgccgcgccttctgcccaaggagcaggtcagagcggggcagacgctgaacaccttggccattcgcttcggggaggtcgctgggccatcgcttgcgggcgtgatcgccagtttcgccgggctcgggtggtgttacgcctgcgacgcggcgacctttctcgcggcactctatgccatctatcgtttgccacccatgttgccagaggccaatgccaagcagcggagcatgttggacggcgtgatggagggactgcgcttcttggggcgatcgcgcgcccttctcggcgccatgttagctgacctcagcgtcaccgtgcttggcgtgcccaccgcgctcctgccggcgctcgtgagcgagcgctttggtggccggccggagacgctcggcctgatgatgggcgccaccggcatcggcggcttggtcatccttgccctgtcgggccctgtgcgccacattcggtccgaaggcaaagcgattctggtcgcctgtgctgcctgggccatagccgcagggggtctcgggctcgcccccttcgtctggctctgcgtggcccttctcgggctgatgggcgcggcagactccatcctcgtggtgatgcgctcgacgctcatccagcaagggacgccggacggcctgcgcggacgcatttccagcgtggattacctggtggggacgggcggtccgcagctcggcaatctccgcgcagggctcgtggggagcctgctcccgcccggagcgtccatcgccgtcggcggactttccacgctcgccgccatcctttgcgtcggctggttcgtccctgagttgcgaagggcgcaggcggaagagggtgtgggggcttcagactag

SEQ ID NO: 2757 - protein, 393 aa, Streptomyces ambofaciens
RVRFLDTRPLRSSQSFRDLWIGTSVSQVGGQIANMAVLAQVWDLTGSPVGTGAIGLATGLPMVLFGLLGGTLADTFDRRAVVRATTAGQLLAAAGLCAQALADNRNVLLLLALVAMGTSSGALGAPARRTFPVRLLPGDQVAAGLALTNVSFQAAMLAGPAMAGLIIAHWDLSAAYATQAVAMVLSMLTVLRLPAMRPEGADAAGGRRRPERGGWRIVLRRPTLWGSMATDLSATLLAMPVALFPLVNEIRFGGNPQTLGLFLSAVAVGGITAGLLSGTVTRWHRGGLVQMSAAGVWGLALACFGLAGPLWLALGCLAVAGAADTVSVVTRSALVQLETPDAYRGRVSSVEHVIGVAGPELGNFRGGLLASATSASFSLVFGGLSAILAIAAV

SEQ ID NO: 2758 - protein, 402 aa, Arthrobacter  FB24
LADITPLRESPDFRRLWLGSAVSNLGSQLTLVAVSLEVYRLTQDSLYVGLLSIFALVPLVLGGLLGGSIADAHDRRKVALLATTMLWLTTAGLAAQAWLGLGNVWLLYVLVAVQSGAQAINQPARSAIIPALVRKELLPAANALSMITFGLGMTAGPLLAGVLVAWVGFGWTYTLDVASFAFAFWALLRLPPMPPGKTTHRAGLRSVVEGFRFLGTRPNLRMTFVIDLVAMIFAQPRALMPAIGAVMIGGGEATVGVLLASTAVGAFLAGLFSGPLGGIRRQGSAVVWSVMGWGASIAGFGLVVVLAGRSGADGVTWWLLPAALCCALAGIADSVSAVFRTTILQAATPDHLRGRLQGVFVVVVAGGPRIGDMLAGGGTKLLSEGWVLLLGGLLCIAVAWTV

SEQ ID NO: 2759 - protein, 393 aa, Streptomyces ambofaciens
RVRFLDTRPLRSSQSFRDLWIGTSVSQVGGQIANVAVLAQVWDLTGSPVGTGAIGLATGLPMVLFGLLGGTLADTFDRRAVVRATTAGQLLAAAGLCAQALADNRNVLLLLALVAMGTSSGALGAPARRTFPVRLLPGDQVAAGLALTNVSFQAAMLAGPAMAGLIIARWDLSAAYATQAVAMVVSMLTVIRLPAMRPEGADAAGGRRRPERGGWRIVLRRPTLWGSMATDLSATLLAMPVALFPLVNEIRFGGNPQTLGLFLSAVAVGGITAGLLSGTVTRWHRGGLVQMSAAGVWGLALACFGLAGPLWLALGCLAVAGAADTVSVVTRSALVQLETPDAYRGRVSSVEHVIGVAGPELGNFRGGLSASATSASFSLVFGGLSAILAIAAV

SEQ ID NO: 2760 - protein, 407 aa, Kineococcus radiotolerans
VDTRPLRSSPAFRRLWIGTTAAAFGGQVAVVAVLYQVWNLTGSTVWTGAIGIATAVPTIVGGIVGGTLADTLDRRRLVLVTTTVSVLAALSLALQAVAGAATVLLVLVLVAAQTSAAAVGAAARRTFISRLLPSDLVRAGVALNHIGFQIAMLTGPAVAGVVLAAGGLRAAYLTDAVGLTVSLYGVLRLPAIRPQSLADTGTARAARGGLPAVRATWEGWRYLLRRPVLRGCLATDLAATVLAMPIALFPAINAQRFDGEEATLGLFLSAIAVGGLLAGFTSGTLTRARRTGRVMLIAAATWGTSLTTFALVDSLPATLACLAVAGAADTVAVISRGTIVQLSTPDAFLGRVSAAEGTVGVAGPGLGNARAGAVAGVTSTAVSSLTGGLACVLAVAVIAATTPALRR

SEQ ID NO: 2761 - protein, 407 aa, Frankia alni
LADLSPLREHPAYRRLWVGETISALGSQITATAVLLQVFAVTRSSFQVGLVSLVALVPLVAGGLFGGAIVDAVDRRRLAMITSGGLAVVSAAFLLLTLAGAVDDVAWPLMCLVAVQSALLAADQPARRAMTPNLIPLEHLPAASALAQIGGTAAGVFGPLIAGVSVAAGGFSIAYAIDLVTFAAPLYGLARLPAMPPRGGGRGAGVASVAEGLRFLRGQPVLLMTFVVDIIAMVFGMPRALFPALAEGRFGGGSATAGAMYSAVAVGSLLAAGLSGPLGGVRRQGLAVVVSIVLWGGAIAGFGLAHDIALGLALLALAGAADMVSAILRNAILNVATPDEMRGRLQGVFLVVVTGGPRLGDLEAGSVAAVTSPAFSVVSGGLAGIGCLLLATAAVPALIRYDARAAV

SEQ ID NO: 2762 - protein, 422 aa, Artificial
  Alicyclobacillus acidocaldarius mutated SEQ ID NO 2755
MPMTLQAVFRSAMLDITPLRTSPAFLRLWIGSGISTLGGTMTPFAVMLQVYRATHSTLDVGLTGLASVLPGALFVLLGGSVGDRVDRRKLALLATSGQMLVSALLAVQALIAWSALWLIYALLCAQSVLGAINAPARRTFVPRLLPKEQVRAGQTLNTLAIRFGEVAGPSLAGVIASFAGLGWCYACDAATFLAALYAIYRLPPMLPEANAKQRSMLDGVMEGLRFLGRSRALLGAMLADLSVTVLGVPTALLPALVSERFGGRPETLGLMMGATGIGGLVILALSGPVRHIRSEGKAILVACAAWAIAAGGLGLAPFVWLCVALLGLMGAADSILVVMRSTLIQQGTPDGLRGRISSVDYLVGTGGPQLGNLRAGLVGSLLPPGASIAVGGLSTLAAILCVGWFVPDLRRAQAEEGVGASD

SEQ ID NO: 2763 - protein, 422 aa, Artificial
  Alicyclobacillus acidocaldarius mutated SEQ ID NO 2755
MPMTLQAVFRSAMLDITPLRTSPAFLRLWIGSGISTLGGTMTPFAVMLQVYRATHSTLDVGLTGLASVLPGALFVLLGGSVGDRVDRRKLALLATSGQMLVSALLAVQALIAWSALWLIYALLCAQSVLGAINAPARRTFVPRLLPKEQVRAGQTLNTLAIRFGEVAGPSLAGVIASFAGLGWCYACDAATFLAALYAIYRLPPMLPEANAKQRSMLDGVMEGLRFLGRSRALLGAMLADLSVTVLGVPTALLPALVSERFGGRPETLGLMMGATGIGGLVILALSGPVRHIRSEGKAILVACAAWAIAAGGLGLAPFVWLCVALIGLMGAADSILVVMRSTLIQQGTPDGLRGRISSVDYLVGTGGPQLGNLRAGLVGSLLPPGASIAVGGLSTLAAILCVGWFVPELRRAQAEEGVGASD

SEQ ID NO: 2764 - protein, 422 aa, Artificial
  Alicyclobacillus acidocaldarius mutated SEQ ID NO 2755
MPMTLQAVFRSAMLDITPLRTSPAFLRLWIGSGISTLGGTMTPFAVMLQVYRATHSTLDVGLTGLASVLPGALFVLLGGSVGDRVDRRKLALLATSGQMLVSALLAVQALIAWSALWLIYALLCAQSVLGAINAPARRTFVPRLLPKEQVRAGQTLNTLAIRFGEVAGPSLAGVIASFAGLGWCYACDAATFLAALYAIYRLPPMLPEANAKQRSMLDGVMEGLRFLGRSRALLGAMLADLSVTVLGVPTALLPALVSERFGGRPETLGLMMGATGIGGLVILALSGPVRHIRSEGKAILVACAAWAIAAGGLGLAPFVWLCVALLGLMGAADSILVVMRSTLIQQGTPDGLRGRISSVDYLVGTGGPQLGNLRAGLVGSLLPPGASIAVGGLSTLAAILCVGWFVPEIRRAQAEEGVGASD

SEQ ID NO: 2765 - protein, 422 aa, Artificial
  Alicyclobacillus acidocaldarius mutated SEQ ID NO 2755
MPMTLQAVFRSAMLDITPLRTSPAFLRLWIGSGISTLGGTMTPFAVMLQVYRATHSTLDVGLTGLASVLPGALFVLLGGSVGDRVDRRKLALLATSGQMLVSALLAVQALIAWSALWLIYALLCAQSVLGAINAPARRTFVPRLLPKEQVRAGQTLNTLAIRFGEVAGPSLAGVIASFAGLGWCYACDAATFLAALYAIYRLPPMLPEANAKQRSMLDGVMEGLRFLGRSRALLGAMLADLSVTVLGVPTALLPALVSERFGGRPETLGLMMGATGIGGLVILALSGPVRHIRSEGKAILVACAAWAIAAGGLGLAPFVWLCVALLGLMGAADSILVVMRSTLIQQGTPDGLRGRISSVDYLVGTGGPQLGNLRAGLIGSLLPPGASIAVGGLSTLAAILCVGWFVPELRRAQAEEGVGASD

SEQ ID NO: 2766 - protein, 422 aa, Artificial
  Alicyclobacillus acidocaldarius mutated SEQ ID NO 2755
MPMTLQAVFRSAMLDITPLRTSPAFLRLWIGSGISTLGGTMTPFAVMLQVYRATHSTLDVGLTGLASVLPGALFVLLGGSVGDRVDRRKLALLATSGQMLVSALLAVQALIAWSALWLIYALLCAQSVLGALNAPARRTFVPRLLPKEQVRAGQTLNTLAIRFGEVAGPSLAGVIASFAGLGWCYACDAATFLAALYAIYRLPPMLPEANAKQRSMLDGVMEGLRFLGRSRALLGAMLADLSVTVLGVPTALLPALVSERFGGRPETLGLMMGATGIGGLVILALSGPVRHIRSEGKAILVACAAWAIAAGGLGLAPFVWLCVALLGLMGAADSILVVMRSTLIQQGTPDGLRGRISSVDYLVGTGGPQLGNLRAGLVGSLLPPGASIAVGGLSTLAAILCVGWFVPELRRAQAEEGVGASD

SEQ ID NO: 2767 - DNA, 1269 bp, Artificial
  Alicyclobacillus acidocaldarius mutated SEQ ID NO 2756
atgcccatgacgcttcaagccgtgttccgctcggcgatgttggacatcacgccgcttcgcacgtctcccgcgtttttgcggctctggattggcagcgggatctcgacgctcgggggcaccatgacgcccttcgcggtcatgctgcaggtgtatcgagccacgcacagcaccctcgatgtcgggctgaccggcctcgccagcgtgctgccgggtgcgctgttcgtgctcctcggcggaagcgtgggcgatcgcgtcgatcgccgcaagctcgcccttctcgccacaagcgggcagatgctcgtgtcggcgctcctcgctgtgcaggcgctcatcgcgtggtccgcgctctggctcatctacgcgctgttgtgcgcgcagtcggtgctcggagccatcaacgccccagcgcgccggacgtttgtgccgcgccttctgcccaaggagcaggtcagagcggggcagacgctgaacaccttggccattcgcttcggggaggtcgctgggccatcgcttgcgggcgtgatcgccagtttcgccgggctcgggtggtgttacgcctgcgacgcggcgacctttctcgcggcactctatgccatctatcgtttgccacccatgttgccagaggccaatgccaagcagcggagcatgttggacggcgtgatggagggactgcgcttcttggggcgatcgcgcgcccttctcggcgccatgttagctgacctcagcgtcaccgtgcttggcgtgcccaccgcgctcctgccggcgctcgtgagcgagcgctttggtggccggccggagacgctcggcctgatgatgggcgccaccggcatcggcggcttggtcatccttgccctgtcgggccctgtgcgccacattcggtccgaaggcaaagcgattctggtcgcctgtgctgcctgggccatagccgcagggggtctcgggctcgcccccttcgtctggctctgcgtggcccttctcgggctgatgggcgcggcagactccatcctcgtggtgatgcgctcgacgctcatccagcaagggacgccggacggcctgcgcggacgcatttccagcgtggattacctggtggggacgggcggtccgcagctcggcaatctccgcgcagggctcgtggggagcctgctcccgcccggagcgtccatcgccgtcggcggactttccacgctcgccgccatcctttgcgtcggctggttcgtccctgatttgcgaagggcgcaggcggaagagggtgtgggggcttcagactag

SEQ ID NO: 2768 - DNA, 1269 bp, Artificial
  Alicyclobacillus acidocaldarius mutated SEQ ID NO 2756
atgcccatgacgcttcaagccgtgttccgctcggcgatgttggacatcacgccgcttcgcacgtctcccgcgtttttgcggctctggattggcagcgggatctcgacgctcgggggcaccatgacgcccttcgcggtcatgctgcaggtgtatcgagccacgcacagcaccctcgatgtcgggctgaccggcctcgccagcgtgctgccgggtgcgctgttcgtgctcctcggcggaagcgtgggcgatcgcgtcgatcgccgcaagctcgcccttctcgccacaagcgggcagatgctcgtgtcggcgctcctcgctgtgcaggcgctcatcgcgtggtccgcgctctggctcatctacgcgctgttgtgcgcgcagtcggtgctcggagccatcaacgccccagcgcgccggacgtttgtgccgcgccttctgcccaaggagcaggtcagagcggggcagacgctgaacaccttggccattcgcttcggggaggtcgctgggccatcgcttgcgggcgtgatcgccagtttcgccgggctcgggtggtgttacgcctgcgacgcggcgacctttctcgcggcactctatgccatctatcgtttgccacccatgttgccagaggccaatgccaagcagcggagcatgttggacggcgtgatggagggactgcgcttcttggggcgatcgcgcgcccttctcggcgccatgttagctgacctcagcgtcaccgtgcttggcgtgcccaccgcgctcctgccggcgctcgtgagcgagcgctttggtggccggccggagacgctcggcctgatgatgggcgccaccggcatcggcggcttggtcatccttgccctgtcgggccctgtgcgccacattcggtccgaaggcaaagcgattctggtcgcctgtgctgcctgggccatagccgcagggggtctcgggctcgcccccttcgtctggctctgcgtggcccttattgggctgatgggcgcggcagactccatcctcgtggtgatgcgctcgacgctcatccagcaagggacgccggacggcctgcgcggacgcatttccagcgtggattacctggtggggacgggcggtccgcagctcggcaatctccgcgcagggctcgtggggagcctgctcccgcccggagcgtccatcgccgtcggcggactttccacgctcgccgccatcctttgcgtcggctggttcgtccctgagttgcgaagggcgcaggcggaagagggtgtgggggcttcagactag

SEQ ID NO: 2769 - DNA, 1269 bp, Artificial
  Alicyclobacillus acidocaldarius mutated SEQ ID NO 2756
atgcccatgacgcttcaagccgtgttccgctcggcgatgttggacatcacgccgcttcgcacgtctcccgcgtttttgcggctctggattggcagcgggatctcgacgctcgggggcaccatgacgcccttcgcggtcatgctgcaggtgtatcgagccacgcacagcaccctcgatgtcgggctgaccggcctcgccagcgtgctgccgggtgcgctgttcgtgctcctcggcggaagcgtgggcgatcgcgtcgatcgccgcaagctcgcccttctcgccacaagcgggcagatgctcgtgtcggcgctcctcgctgtgcaggcgctcatcgcgtggtccgcgctctggctcatctacgcgctgttgtgcgcgcagtcggtgctcggagccatcaacgccccagcgcgccggacgtttgtgccgcgccttctgcccaaggagcaggtcagagcggggcagacgctgaacaccttggccattcgcttcggggaggtcgctgggccatcgcttgcgggcgtgatcgccagtttcgccgggctcgggtggtgttacgcctgcgacgcggcgacctttctcgcggcactctatgccatctatcgtttgccacccatgttgccagaggccaatgccaagcagcggagcatgttggacggcgtgatggagggactgcgcttcttggggcgatcgcgcgcccttctcggcgccatgttagctgacctcagcgtcaccgtgcttggcgtgcccaccgcgctcctgccggcgctcgtgagcgagcgctttggtggccggccggagacgctcggcctgatgatgggcgccaccggcatcggcggcttggtcatccttgccctgtcgggccctgtgcgccacattcggtccgaaggcaaagcgattctggtcgcctgtgctgcctgggccatagccgcagggggtctcgggctcgcccccttcgtctggctctgcgtggcccttctcgggctgatgggcgcggcagactccatcctcgtggtgatgcgctcgacgctcatccagcaagggacgccggacggcctgcgcggacgcatttccagcgtggattacctggtggggacgggcggtccgcagctcggcaatctccgcgcagggctcgtggggagcctgctcccgcccggagcgtccatcgccgtcggcggactttccacgctcgccgccatcctttgcgtcggctggttcgtccctgagattcgaagggcgcaggcggaagagggtgtgggggcttcagactag

SEQ ID NO: 2770 - DNA, 1269 bp, Artificial
  Alicyclobacillus acidocaldarius mutated SEQ ID NO 2756
atgcccatgacgcttcaagccgtgttccgctcggcgatgttggacatcacgccgcttcgcacgtctcccgcgtttttgcggctctggattggcagcgggatctcgacgctcgggggcaccatgacgcccttcgcggtcatgctgcaggtgtatcgagccacgcacagcaccctcgatgtcgggctgaccggcctcgccagcgtgctgccgggtgcgctgttcgtgctcctcggcggaagcgtgggcgatcgcgtcgatcgccgcaagctcgcccttctcgccacaagcgggcagatgctcgtgtcggcgctcctcgctgtgcaggcgctcatcgcgtggtccgcgctctggctcatctacgcgctgttgtgcgcgcagtcggtgctcggagccatcaacgccccagcgcgccggacgtttgtgccgcgccttctgcccaaggagcaggtcagagcggggcagacgctgaacaccttggccattcgcttcggggaggtcgctgggccatcgcttgcgggcgtgatcgccagtttcgccgggctcgggtggtgttacgcctgcgacgcggcgacctttctcgcggcactctatgccatctatcgtttgccacccatgttgccagaggccaatgccaagcagcggagcatgttggacggcgtgatggagggactgcgcttcttggggcgatcgcgcgcccttctcggcgccatgttagctgacctcagcgtcaccgtgcttggcgtgcccaccgcgctcctgccggcgctcgtgagcgagcgctttggtggccggccggagacgctcggcctgatgatgggcgccaccggcatcggcggcttggtcatccttgccctgtcgggccctgtgcgccacattcggtccgaaggcaaagcgattctggtcgcctgtgctgcctgggccatagccgcagggggtctcgggctcgcccccttcgtctggctctgcgtggcccttctcgggctgatgggcgcggcagactccatcctcgtggtgatgcgctcgacgctcatccagcaagggacgccggacggcctgcgcggacgcatttccagcgtggattacctggtggggacgggcggtccgcagctcggcaatctccgcgcagggctcattgggagcctgctcccgcccggagcgtccatcgccgtcggcggactttccacgctcgccgccatcctttgcgtcggctggttcgtccctgagttgcgaagggcgcaggcggaagagggtgtgggggcttcagactag

SEQ ID NO: 2771 - DNA, 1269 bp, Artificial
  Alicyclobacillus acidocaldarius mutated SEQ ID NO 2756
atgcccatgacgcttcaagccgtgttccgctcggcgatgttggacatcacgccgcttcgcacgtctcccgcgtttttgcggctctggattggcagcgggatctcgacgctcgggggcaccatgacgcccttcgcggtcatgctgcaggtgtatcgagccacgcacagcaccctcgatgtcgggctgaccggcctcgccagcgtgctgccgggtgcgctgttcgtgctcctcggcggaagcgtgggcgatcgcgtcgatcgccgcaagctcgcccttctcgccacaagcgggcagatgctcgtgtcggcgctcctcgctgtgcaggcgctcatcgcgtggtccgcgctctggctcatctacgcgctgttgtgcgcgcagtcggtgctcggagccttaaacgccccagcgcgccggacgtttgtgccgcgccttctgcccaaggagcaggtcagagcggggcagacgctgaacaccttggccattcgcttcggggaggtcgctgggccatcgcttgcgggcgtgatcgccagtttcgccgggctcgggtggtgttacgcctgcgacgcggcgacctttctcgcggcactctatgccatctatcgtttgccacccatgttgccagaggccaatgccaagcagcggagcatgttggacggcgtgatggagggactgcgcttcttggggcgatcgcgcgcccttctcggcgccatgttagctgacctcagcgtcaccgtgcttggcgtgcccaccgcgctcctgccggcgctcgtgagcgagcgctttggtggccggccggagacgctcggcctgatgatgggcgccaccggcatcggcggcttggtcatccttgccctgtcgggccctgtgcgccacattcggtccgaaggcaaagcgattctggtcgcctgtgctgcctgggccatagccgcagggggtctcgggctcgcccccttcgtctggctctgcgtggcccttctcgggctgatgggcgcggcagactccatcctcgtggtgatgcgctcgacgctcatccagcaagggacgccggacggcctgcgcggacgcatttccagcgtggattacctggtggggacgggcggtccgcagctcggcaatctccgcgcagggctcgtggggagcctgctcccgcccggagcgtccatcgccgtcggcggactttccacgctcgccgccatcctttgcgtcggctggttcgtccctgagttgcgaagggcgcaggcggaagagggtgtgggggcttcagactag

SEQ ID NO: 2772 - protein, 246 aa, Alicyclobacillus acidocaldarius
MISWNGQGGTTVAIYAIADLHLDTSQSKPMDVFGHEWRDHAEKIAHHWQDQIHDDDIVLIPGDISWAMKLEEAAPDLVWIGRLPGRKVLIRGNHDFWWGGIQRVRKALPPRMYALQNDCLVLDNVCFAGTRGWTLPHHPSYNAEQDEPILKREILRLELSLKAAVKEGKPILCLMHYPPVDSNHPHSPFHELLAAYGVRACVYGHLHGPAHRFAFNGEIDSVRYQLVSCDYLQFIPWKIPEEWLQP

SEQ ID NO: 2773 - DNA, 741 bp, Alicyclobacillus acidocaldarius
gtgatatcatggaacggtcaagggggaaccaccgtggccatctacgcgatcgcagatttgcacttggatacatcacaaagcaaacccatggacgtattcggacacgagtggcgcgatcatgcggagaagatcgcgcatcactggcaagaccagatccacgacgatgacatcgtcctaattccgggtgacatttcgtgggcgatgaaactggaagaggccgcgcccgacctggtgtggatcggacgccttcctggacgaaaagtgctcattcgaggaaaccacgatttttggtggggggggattcagcgggttcgaaaagcgctgcctccacgcatgtacgccttgcagaacgattgccttgttcttgacaacgtgtgtttcgcaggcactcgaggatggacgctgccccatcacccctcatacaacgcggaacaagatgaaccgattctcaagcgggagattctgcgcctcgagttgtcgctcaaggcagcggtcaaagagggaaagccgattctgtgtctgatgcactacccgcccgtcgattcgaatcatccgcactctccgtttcatgaactgctcgcagcctacggcgtccgggcgtgtgtatacggtcacttacatggtcccgcgcatcggttcgcattcaatggcgagatcgacagcgttcgttaccagttggtaagctgcgactaccttcaatttatcccatggaagataccggaggaatggcttcagccgtga

SEQ ID NO: 2774 - protein, 238 aa, Halothermothrix orenii
IYAIGDLHLSFENKVIPGDWEKVSQYKPMSLFGDKWVEHYRKIYKNWKAEVTCKDLVLVPGDISWAMKLEEAVYDLEFIGSMPGKKIFIRGNHDYWWSGISKVRSILPDGCFALQNDCLEFEGVSITGTRGWICPNEDNFTEHDEKVYKREVNRLKLSLESIKNTDKKKIVMMHYMPVNENHEHNDFIKVMIDYNVDICIYGHLHGEDSHKIRLPEEKWGIRFYLVSSDFLNFKPLRI

SEQ ID NO: 2775 - protein, 226 aa, Clostridium botulinum
MALYAISDLHLSLNCDKPMDVFGDHWMNHDNRIKENWINKITNEDTVLIAGDISWSMKMEDGMADLEWIHKLPGRKIISKGNHDYWWGSISKLNSLYDDMLFIQNNFFIYEDYAICGTRGWTPPADKYSEHDDKIYKREQIRLKISLDAAKKAGYEKIIVMIHYPPVNDKFQKNELTEIFNEYNVEKVIYGHLHGPSLKTIFEGKHEGVEYIMTSCDYIDFDPIKI

SEQ ID NO: 2776 - protein, 223 aa, Alkaliphilus oremlandii
MAIFAIGDLHLSGYSNKPMDIFGEHWTEHDKKIMESWQKNVKDEDAVLIPGDISWAMTLEDAKIDLNWIADLPGQKYLIRGNHDYWWGSLTKLNSLFDSMHFIQNNFFTYNQYAICGTRGWNCPNHYKFTEHDGKIFTREVNRLELSLKAAKEKGYEDIIVMLHYPPTNDKLEPSLFTEMLEKYKVKQVVYGHLHGETSYDAGLKGEYNGVYYNLVSCDYAGF

SEQ ID NO: 2777 - protein, 226 aa, Clostridium novyi
MALYAISDLHLSLNCDKPMDVFGDHWMNHDNRIKENWINKITNEDTVLIAGDISWSMKMEDGMADLEWIHKLPGRKIISKGNHDYWWGSISKLNSLYDDIRFIQNNFFVYEDYAICGTRGWNPPTDKYSEHDDKIYKREQIRLRISLDAAKKAGFEKIIVMVHYPPVNDKFEKTELTEIFNEYNVEKVIYGHLHGPSLKNIFEGEHEGVEYIMTSCDYIDFDPIKI

SEQ ID NO: 2778 - protein, 228 aa, Roseiflexus  RS-1
VWSISDLHLSFARPKPMDIFGSRWKDHPERIAAAWRARVKPDDVVLLAGDTSWAMKLQDALVDLQWIAALPGRKIISRGNHDYWWSSERTNRVRRSLPPGIDILEASAIDIGEAVVCATRGWNTPETPGFQESTDRPYYERELMRLDTALAAAQHLASGKRPIIVMIHFPPFAGRRPTEFARRIAAAKAAACVYGHLHRPEDWAVATQGLVDGVYYQLTSCDYLGFGP

SEQ ID NO: 2779 - protein, 246 aa, Artificial
  Alicyclobacillus acidocaldarius mutated SEQ ID NO 2772
MISWNGQGGTTVAIYAIADLHLDTSQSKPMDVFGHEWRDHAEKIAHHWQDQIHDDDLVLIPGDISWAMKLEEAAPDLVWIGRLPGRKVLIRGNHDFWWGGIQRVRKALPPRMYALQNDCLVLDNVCFAGTRGWTLPHHPSYNAEQDEPILKREILRLELSLKAAVKEGKPILCLMHYPPVDSNHPHSPFHELLAAYGVRACVYGHLHGPAHRFAFNGEIDSVRYQLVSCDYLQFIPWKIPEEWLQP

SEQ ID NO: 2780 - protein, 246 aa, Artificial
  Alicyclobacillus acidocaldarius mutated SEQ ID NO 2772
MISWNGQGGTTVAIYAIADLHLDTSQSKPMDVFGHEWRDHAEKIAHHWQDQIHDDDIVLIPGDISWAMKLEEAAPDLVWIGRLPGRKVLIRGNHDFWWGGIQRVRKALPPRMYALQNDCLVLDNVCFAGTRGWTLPHHPSYNAEQDEPILKREILRLELSLKAAVKEGKPILCLMHYPPVDSNHPHSPFHELLAAYGVRACVYGHLHGPAHRFAFNGEIDSVRYQLVSCDYLQFIPWKIPDEWLQP

SEQ ID NO: 2781 - protein, 246 aa, Artificial
  Alicyclobacillus acidocaldarius mutated SEQ ID NO 2772
MISWNGQGGTTVAIYAIADLHLDTSQSKPMDVFGHEWRDHAEKIAHHWQDQIHDDDIVLIPGDISWAMKLEEAAPDLVWIGRLPGRKVLIRGNHDFWWGGIQRVRKALPPRMYALQNDCLVLDNVCFAGTRGWTLPHHPSYNAEQDEPILKREILRLELSLKAAVKEGKPILCLMHYPPVDSNHPHSPFHELLAAYGVRACVYGHLHGPAHKFAFNGEIDSVRYQLVSCDYLQFIPWKIPEEWLQP

SEQ ID NO: 2782 - protein, 246 aa, Artificial
  Alicyclobacillus acidocaldarius mutated SEQ ID NO 2772
MISWNGQGGTTVAIYAIADLHLDTSQSKPMDVFGHEWRDHAEKIAHHWQDQIHDDDIVLIPGDISWAMKLEEAAPDLVWIGRLPGRKILIRGNHDFWWGGIQRVRKALPPRMYALQNDCLVLDNVCFAGTRGWTLPHHPSYNAEQDEPILKREILRLELSLKAAVKEGKPILCLMHYPPVDSNHPHSPFHELLAAYGVRACVYGHLHGPAHRFAFNGEIDSVRYQLVSCDYLQFIPWKIPEEWLQP

SEQ ID NO: 2783 - protein, 246 aa, Artificial
  Alicyclobacillus acidocaldarius mutated SEQ ID NO 2772
MISWNGQGGTTVAIYAIADLHLDTSQSKPMDVFGHEWRDHAEKIAHHWQDQIHDDDIVLIPGDISWAMKLEEAAPDLVWIGRLPGRKVLIRGNHDFWWGGIQRVRKALPPRMYALQNDCLVLDNVCFAGTRGWTLPHHPSYNAEQDEPILKRELLRLELSLKAAVKEGKPILCLMHYPPVDSNHPHSPFHELLAAYGVRACVYGHLHGPAHRFAFNGEIDSVRYQLVSCDYLQFIPWKIPEEWLQP

SEQ ID NO: 2784 - DNA, 741 bp, Artificial
  Alicyclobacillus acidocaldarius mutated SEQ ID NO 2773
gtgatatcatggaacggtcaagggggaaccaccgtggccatctacgcgatcgcagatttgcacttggatacatcacaaagcaaacccatggacgtattcggacacgagtggcgcgatcatgcggagaagatcgcgcatcactggcaagaccagatccacgacgatgacttagtcctaattccgggtgacatttcgtgggcgatgaaactggaagaggccgcgcccgacctggtgtggatcggacgccttcctggacgaaaagtgctcattcgaggaaaccacgatttttggtggggggggattcagcgggttcgaaaagcgctgcctccacgcatgtacgccttgcagaacgattgccttgttcttgacaacgtgtgtttcgcaggcactcgaggatggacgctgccccatcacccctcatacaacgcggaacaagatgaaccgattctcaagcgggagattctgcgcctcgagttgtcgctcaaggcagcggtcaaagagggaaagccgattctgtgtctgatgcactacccgcccgtcgattcgaatcatccgcactctccgtttcatgaactgctcgcagcctacggcgtccgggcgtgtgtatacggtcacttacatggtcccgcgcatcggttcgcattcaatggcgagatcgacagcgttcgttaccagttggtaagctgcgactaccttcaatttatcccatggaagataccggaggaatggcttcagccgtga

SEQ ID NO: 2785 - DNA, 741 bp, Artificial
  Alicyclobacillus acidocaldarius mutated SEQ ID NO 2773
gtgatatcatggaacggtcaagggggaaccaccgtggccatctacgcgatcgcagatttgcacttggatacatcacaaagcaaacccatggacgtattcggacacgagtggcgcgatcatgcggagaagatcgcgcatcactggcaagaccagatccacgacgatgacatcgtcctaattccgggtgacatttcgtgggcgatgaaactggaagaggccgcgcccgacctggtgtggatcggacgccttcctggacgaaaagtgctcattcgaggaaaccacgatttttggtggggggggattcagcgggttcgaaaagcgctgcctccacgcatgtacgccttgcagaacgattgccttgttcttgacaacgtgtgtttcgcaggcactcgaggatggacgctgccccatcacccctcatacaacgcggaacaagatgaaccgattctcaagcgggagattctgcgcctcgagttgtcgctcaaggcagcggtcaaagagggaaagccgattctgtgtctgatgcactacccgcccgtcgattcgaatcatccgcactctccgtttcatgaactgctcgcagcctacggcgtccgggcgtgtgtatacggtcacttacatggtcccgcgcatcggttcgcattcaatggcgagatcgacagcgttcgttaccagttggtaagctgcgactaccttcaatttatcccatggaagataccggatgaatggcttcagccgtga

SEQ ID NO: 2786 - DNA, 741 bp, Artificial
  Alicyclobacillus acidocaldarius mutated SEQ ID NO 2773
gtgatatcatggaacggtcaagggggaaccaccgtggccatctacgcgatcgcagatttgcacttggatacatcacaaagcaaacccatggacgtattcggacacgagtggcgcgatcatgcggagaagatcgcgcatcactggcaagaccagatccacgacgatgacatcgtcctaattccgggtgacatttcgtgggcgatgaaactggaagaggccgcgcccgacctggtgtggatcggacgccttcctggacgaaaagtgctcattcgaggaaaccacgatttttggtggggggggattcagcgggttcgaaaagcgctgcctccacgcatgtacgccttgcagaacgattgccttgttcttgacaacgtgtgtttcgcaggcactcgaggatggacgctgccccatcacccctcatacaacgcggaacaagatgaaccgattctcaagcgggagattctgcgcctcgagttgtcgctcaaggcagcggtcaaagagggaaagccgattctgtgtctgatgcactacccgcccgtcgattcgaatcatccgcactctccgtttcatgaactgctcgcagcctacggcgtccgggcgtgtgtatacggtcacttacatggtcccgcgcataaattcgcattcaatggcgagatcgacagcgttcgttaccagttggtaagctgcgactaccttcaatttatcccatggaagataccggaggaatggcttcagccgtga

SEQ ID NO: 2787 - DNA, 741 bp, Artificial
  Alicyclobacillus acidocaldarius mutated SEQ ID NO 2773
gtgatatcatggaacggtcaagggggaaccaccgtggccatctacgcgatcgcagatttgcacttggatacatcacaaagcaaacccatggacgtattcggacacgagtggcgcgatcatgcggagaagatcgcgcatcactggcaagaccagatccacgacgatgacatcgtcctaattccgggtgacatttcgtgggcgatgaaactggaagaggccgcgcccgacctggtgtggatcggacgccttcctggacgaaaaattctcattcgaggaaaccacgatttttggtggggggggattcagcgggttcgaaaagcgctgcctccacgcatgtacgccttgcagaacgattgccttgttcttgacaacgtgtgtttcgcaggcactcgaggatggacgctgccccatcacccctcatacaacgcggaacaagatgaaccgattctcaagcgggagattctgcgcctcgagttgtcgctcaaggcagcggtcaaagagggaaagccgattctgtgtctgatgcactacccgcccgtcgattcgaatcatccgcactctccgtttcatgaactgctcgcagcctacggcgtccgggcgtgtgtatacggtcacttacatggtcccgcgcatcggttcgcattcaatggcgagatcgacagcgttcgttaccagttggtaagctgcgactaccttcaatttatcccatggaagataccggaggaatggcttcagccgtga

SEQ ID NO: 2788 - DNA, 741 bp, Artificial
  Alicyclobacillus acidocaldarius mutated SEQ ID NO 2773
gtgatatcatggaacggtcaagggggaaccaccgtggccatctacgcgatcgcagatttgcacttggatacatcacaaagcaaacccatggacgtattcggacacgagtggcgcgatcatgcggagaagatcgcgcatcactggcaagaccagatccacgacgatgacatcgtcctaattccgggtgacatttcgtgggcgatgaaactggaagaggccgcgcccgacctggtgtggatcggacgccttcctggacgaaaagtgctcattcgaggaaaccacgatttttggtggggggggattcagcgggttcgaaaagcgctgcctccacgcatgtacgccttgcagaacgattgccttgttcttgacaacgtgtgtttcgcaggcactcgaggatggacgctgccccatcacccctcatacaacgcggaacaagatgaaccgattctcaagcgggagttactgcgcctcgagttgtcgctcaaggcagcggtcaaagagggaaagccgattctgtgtctgatgcactacccgcccgtcgattcgaatcatccgcactctccgtttcatgaactgctcgcagcctacggcgtccgggcgtgtgtatacggtcacttacatggtcccgcgcatcggttcgcattcaatggcgagatcgacagcgttcgttaccagttggtaagctgcgactaccttcaatttatcccatggaagataccggaggaatggcttcagccgtga

SEQ ID NO: 2789 - protein, 116 aa, Alicyclobacillus acidocaldarius
MQVSTLGGIPMATMTLTDANFQQAIQGDKPVLVDFWAAWCGPCRMMAPVLEEFAEAHADKVTVAKLNVDENPETTSQFGIMSIPTLILFKGGRPVKQLIGYQPKEQLEAQLADVLQ

SEQ ID NO: 2790 - DNA, 351 bp, Alicyclobacillus acidocaldarius
atgcaagtaagtaccttggggggtattccaatggccacgatgacgttgacagacgccaatttccaacaggcgattcaaggcgataaacccgtgctggtggatttctgggcggcgtggtgcggtccctgccgcatgatggcgccggtgctcgaggagttcgccgaggcgcacgccgacaaggtgaccgttgcgaagctgaacgtcgatgagaatccggagaccaccagccaattcggcatcatgagcattccgacgctcattctgttcaagggcggccgccctgtgaaacagctcatcgggtatcagccgaaggagcagcttgaggctcagctcgcggacgtcctgcagtga

SEQ ID NO: 2791 - protein, 105 aa, Bacillus acidocaldarius
ATMTLTDANFQQAIQGDKPVLVDFWAAWCGPCRMMAPVLEEFAEAHADKVTVAKLNVDENPETTSQFGIMSIPTLILFKGGRPVKQLIGYQPKEQLEAQLADVLQ

SEQ ID NO: 2792 - protein, 105 aa, Alicyclobacillus acidocaldarius
ATMTLTDANFQQAIQGDKPVLVDFWAAWCGPCRMMAPVLEEFAEAHADKVTVAKLNVDENPETTSQFGIMSIPTLILFKGGEPVKQLIGYQPKEQLEAQLADVLQ

SEQ ID NO: 2793 - protein, 105 aa, Alicyclobacillus acidocaldarius
ATMTLTDANFQQAIQGDGPVLVDFWAAWCGPCRMMAPVLEEFAEAHADKVTVAKLNVDENPETTSQFGIMSIPTLILFKGGRPVKQLIGYQPKEQLEAQLADVLQ

SEQ ID NO: 2794 - protein, 105 aa, ALICYCLOBACILLUS Acidocaldarius
ATMTLTDANFQQAIQGDGPVLVDFWAAWCGPCRMMAPVLEEFAEAHADKVTVAKLNVDENPETTSQFGIMSIPTLILFKGGEPVKQLIGYQPKEQLEAQLADVLQ

SEQ ID NO: 2795 - protein, 104 aa, Rhodococcus  RHA1
TVTITDDSFQQDVISSDKPVLVDFWATWCGPCKMIAPVLEEIAGEHSEKLTIAKLDIDANPGAARDFQVMSIPTLILFKDGKPINTIVGTKGKAALLKELADVL

SEQ ID NO: 2796 - protein, 116 aa, Artificial
  Alicyclobacillus acidocaldarius mutated SEQ ID NO 2789
MQVSTLGGIPMATMTLTDANFQQAIQGDKPVLVDFWAAWCGPCRMMAPVLEEFADAHADKVTVAKLNVDENPETTSQFGIMSIPTLILFKGGRPVKQLIGYQPKEQLEAQLADVLQ

SEQ ID NO: 2797 - protein, 116 aa, Artificial
  Alicyclobacillus acidocaldarius mutated SEQ ID NO 2789
MQVSTLGGIPMATMTLTDANFQQAIQGDKPVLVDFWAAWCGPCRMMAPVLEEFAEAHADKVTVAKLNVDENPETTSQFGIMSIPTLILFKGGRPVKQLIGYQPKEQLEAQLADVLN

SEQ ID NO: 2798 - protein, 116 aa, Artificial
  Alicyclobacillus acidocaldarius mutated SEQ ID NO 2789
MQVSTLGGIPMATMTLTDANFQQAIQGDKPVLVDFWAAWCGPCRMMAPVLEEFAEAHADKVTVAKLNVDENPETTSQFGIMSIPTLILFKGGRPVKQLIGYQPKENLEAQLADVLQ

SEQ ID NO: 2799 - protein, 116 aa, Artificial
  Alicyclobacillus acidocaldarius mutated SEQ ID NO 2789
MQVSTLGGIPMATMTLTDANFQQAIQGDKPVLVDFWAAWCGPCRMMAPVLEEFAEAHADKVTVAKLNVDENPETTSQFGIMSIPTLILFKGGRPVKQLIGYQPKDQLEAQLADVLQ

SEQ ID NO: 2800 - protein, 116 aa, Artificial
  Alicyclobacillus acidocaldarius mutated SEQ ID NO 2789
MQISTLGGIPMATMTLTDANFQQAIQGDKPVLVDFWAAWCGPCRMMAPVLEEFAEAHADKVTVAKLNVDENPETTSQFGIMSIPTLILFKGGRPVKQLIGYQPKEQLEAQLADVLQ

SEQ ID NO: 2801 - DNA, 351 bp, Artificial
  Alicyclobacillus acidocaldarius mutated SEQ ID NO 2790
atgcaagtaagtaccttggggggtattccaatggccacgatgacgttgacagacgccaatttccaacaggcgattcaaggcgataaacccgtgctggtggatttctgggcggcgtggtgcggtccctgccgcatgatggcgccggtgctcgaggagttcgccgatgcgcacgccgacaaggtgaccgttgcgaagctgaacgtcgatgagaatccggagaccaccagccaattcggcatcatgagcattccgacgctcattctgttcaagggcggccgccctgtgaaacagctcatcgggtatcagccgaaggagcagcttgaggctcagctcgcggacgtcctgcagtga

SEQ ID NO: 2802 - DNA, 351 bp, Artificial
  Alicyclobacillus acidocaldarius mutated SEQ ID NO 2790
atgcaagtaagtaccttggggggtattccaatggccacgatgacgttgacagacgccaatttccaacaggcgattcaaggcgataaacccgtgctggtggatttctgggcggcgtggtgcggtccctgccgcatgatggcgccggtgctcgaggagttcgccgaggcgcacgccgacaaggtgaccgttgcgaagctgaacgtcgatgagaatccggagaccaccagccaattcggcatcatgagcattccgacgctcattctgttcaagggcggccgccctgtgaaacagctcatcgggtatcagccgaaggagcagcttgaggctcagctcgcggacgtcctgaattga

SEQ ID NO: 2803 - DNA, 351 bp, Artificial
  Alicyclobacillus acidocaldarius mutated SEQ ID NO 2790
atgcaagtaagtaccttggggggtattccaatggccacgatgacgttgacagacgccaatttccaacaggcgattcaaggcgataaacccgtgctggtggatttctgggcggcgtggtgcggtccctgccgcatgatggcgccggtgctcgaggagttcgccgaggcgcacgccgacaaggtgaccgttgcgaagctgaacgtcgatgagaatccggagaccaccagccaattcggcatcatgagcattccgacgctcattctgttcaagggcggccgccctgtgaaacagctcatcgggtatcagccgaaggagaatcttgaggctcagctcgcggacgtcctgcagtga

SEQ ID NO: 2804 - DNA, 351 bp, Artificial
  Alicyclobacillus acidocaldarius mutated SEQ ID NO 2790
atgcaagtaagtaccttggggggtattccaatggccacgatgacgttgacagacgccaatttccaacaggcgattcaaggcgataaacccgtgctggtggatttctgggcggcgtggtgcggtccctgccgcatgatggcgccggtgctcgaggagttcgccgaggcgcacgccgacaaggtgaccgttgcgaagctgaacgtcgatgagaatccggagaccaccagccaattcggcatcatgagcattccgacgctcattctgttcaagggcggccgccctgtgaaacagctcatcgggtatcagccgaaggatcagcttgaggctcagctcgcggacgtcctgcagtga

SEQ ID NO: 2805 - DNA, 351 bp, Artificial
  Alicyclobacillus acidocaldarius mutated SEQ ID NO 2790
atgcaaattagtaccttggggggtattccaatggccacgatgacgttgacagacgccaatttccaacaggcgattcaaggcgataaacccgtgctggtggatttctgggcggcgtggtgcggtccctgccgcatgatggcgccggtgctcgaggagttcgccgaggcgcacgccgacaaggtgaccgttgcgaagctgaacgtcgatgagaatccggagaccaccagccaattcggcatcatgagcattccgacgctcattctgttcaagggcggccgccctgtgaaacagctcatcgggtatcagccgaaggagcagcttgaggctcagctcgcggacgtcctgcagtga

SEQ ID NO: 2806 - protein, 106 aa, Alicyclobacillus acidocaldarius
MEEIRTSERYREAVQSGRVVVEFYATWCPDCRRIEPYLGEWEEKYREQFTMVRVNRDEVPDLAEELQILGIPTFLVYDQGREVKRLFSRDAKSKEQVEQFLDQAYA

SEQ ID NO: 2807 - DNA, 321 bp, Alicyclobacillus acidocaldarius
gtggaagagatccgcacgagcgaacggtatcgggaagcggtgcaatcgggccgcgtggtggtggaattctatgcgacgtggtgcccagactgccgtcgcattgagccatatttgggggaatgggaagaaaagtaccgtgagcaattcacgatggtccgcgtgaaccgggacgaggtgccggacctggcggaagagctccagattcttggaattccgaccttcctcgtctacgaccaaggccgcgaggtcaagcggctcttcagtcgcgacgcgaagtccaaggagcaggtggagcagttcttggaccaggcgtatgcctga

SEQ ID NO: 2808 - protein, 103 aa, Bacillus halodurans
MEQIKTLEQFQQVKNQENVVFLFSADWCPDCRVIEPFLPELEQTYDEYQFYYVNRDDFIELCQELDIFGIPSFLFYSNGEERSRFVSKDRKTKEEIERFLTEA

SEQ ID NO: 2809 - protein, 105 aa, Paenibacillus  JDR-2
MNKLTTDAAFREAVQGDGITVVVFKTTWCADCHYIDPFMPDVEQQYNGKFSFHEIDRDELPDLCSELNILGIPSFIAFRNGKELIRYVNKLRKTREEIEQFLDRA

SEQ ID NO: 2810 - protein, 103 aa, Lactobacillus gasseri
MEEIKELTPEKLKEITANGKVVLLFLATWCPDCRFLDPFLPQIEKDNSDAKFYKIDRDGSIDVAKELNIFGIPSFVVYQDGKEIGRLVNKDRKTKEEVENFLN

SEQ ID NO: 2811 - protein, 103 aa, Lactobacillus johnsonii
MEEIKELTPEKLKEITKNGKVVLLFSATWCPDCRFLDPFLPQIEKDNPDAKFYKIDRDGSIDVAKELNIFGIPSFVVYQDGKEIGRLVNKDRKTKEEVENFLN

SEQ ID NO: 2812 - protein, 105 aa, Bacillus amyloliquefaciens
MKKIESTEELQKAVQDDWAVFMFSADWCPDCRFVEPFLPELEADFPEFTYYYVDRDQFIDTCAEWEIYGIPSFVVFNGGKEVNRFVSKDRKTKEEIEQFLTDSLA

SEQ ID NO: 2813 - protein, 106 aa, Artificial
  Alicyclobacillus acidocaldarius mutated SEQ ID NO 2806
MEEIRTSERYREAVQSGRVVVDFYATWCPDCRRIEPYLGEWEEKYREQFTMVRVNRDEVPDLAEELQILGIPTFLVYDQGREVKRLFSRDAKSKEQVEQFLDQAYA

SEQ ID NO: 2814 - protein, 106 aa, Artificial
  Alicyclobacillus acidocaldarius mutated SEQ ID NO 2806
MEEIRTSERYREAVQSGRVVVEFYATWCPDCRRIEPYLGEWEDKYREQFTMVRVNRDEVPDLAEELQILGIPTFLVYDQGREVKRLFSRDAKSKEQVEQFLDQAYA

SEQ ID NO: 2815 - protein, 106 aa, Artificial
  Alicyclobacillus acidocaldarius mutated SEQ ID NO 2806
MEEIRTSERYREAVQSGRVVVEFYATWCPDCRRIEPYLGEWEEKYREQFTMVRVNRDEVPDLAEELQILGIPTFLVYDQGREVKRLFSRDAKSKEQVEQFLDNAYA

SEQ ID NO: 2816 - protein, 106 aa, Artificial
  Alicyclobacillus acidocaldarius mutated SEQ ID NO 2806
MEEIRTSERYREAVQSGRVVVEFYATWCPDCRRIEPYLGEWEEKYREQFTMVRVNRDEVPDLAEELQILGIPTFLVYDQGREVKRLFSREAKSKEQVEQFLDQAYA

SEQ ID NO: 2817 - protein, 106 aa, Artificial
  Alicyclobacillus acidocaldarius mutated SEQ ID NO 2806
MEEIRTSERYREAVQSGRVVVEFYATWCPDCRKIEPYLGEWEEKYREQFTMVRVNRDEVPDLAEELQILGIPTFLVYDQGREVKRLFSRDAKSKEQVEQFLDQAYA

SEQ ID NO: 2818 - DNA, 321 bp, Artificial
  Alicyclobacillus acidocaldarius mutated SEQ ID NO 2807
gtggaagagatccgcacgagcgaacggtatcgggaagcggtgcaatcgggccgcgtggtggtggatttctatgcgacgtggtgcccagactgccgtcgcattgagccatatttgggggaatgggaagaaaagtaccgtgagcaattcacgatggtccgcgtgaaccgggacgaggtgccggacctggcggaagagctccagattcttggaattccgaccttcctcgtctacgaccaaggccgcgaggtcaagcggctcttcagtcgcgacgcgaagtccaaggagcaggtggagcagttcttggaccaggcgtatgcctga

SEQ ID NO: 2819 - DNA, 321 bp, Artificial
  Alicyclobacillus acidocaldarius mutated SEQ ID NO 2807
gtggaagagatccgcacgagcgaacggtatcgggaagcggtgcaatcgggccgcgtggtggtggaattctatgcgacgtggtgcccagactgccgtcgcattgagccatatttgggggaatgggaagataagtaccgtgagcaattcacgatggtccgcgtgaaccgggacgaggtgccggacctggcggaagagctccagattcttggaattccgaccttcctcgtctacgaccaaggccgcgaggtcaagcggctcttcagtcgcgacgcgaagtccaaggagcaggtggagcagttcttggaccaggcgtatgcctga

SEQ ID NO: 2820 - DNA, 321 bp, Artificial
  Alicyclobacillus acidocaldarius mutated SEQ ID NO 2807
gtggaagagatccgcacgagcgaacggtatcgggaagcggtgcaatcgggccgcgtggtggtggaattctatgcgacgtggtgcccagactgccgtcgcattgagccatatttgggggaatgggaagaaaagtaccgtgagcaattcacgatggtccgcgtgaaccgggacgaggtgccggacctggcggaagagctccagattcttggaattccgaccttcctcgtctacgaccaaggccgcgaggtcaagcggctcttcagtcgcgacgcgaagtccaaggagcaggtggagcagttcttggacaatgcgtatgcctga

SEQ ID NO: 2821 - DNA, 321 bp, Artificial
  Alicyclobacillus acidocaldarius mutated SEQ ID NO 2807
gtggaagagatccgcacgagcgaacggtatcgggaagcggtgcaatcgggccgcgtggtggtggaattctatgcgacgtggtgcccagactgccgtcgcattgagccatatttgggggaatgggaagaaaagtaccgtgagcaattcacgatggtccgcgtgaaccgggacgaggtgccggacctggcggaagagctccagattcttggaattccgaccttcctcgtctacgaccaaggccgcgaggtcaagcggctcttcagtcgcgaagcgaagtccaaggagcaggtggagcagttcttggaccaggcgtatgcctga

SEQ ID NO: 2822 - DNA, 321 bp, Artificial
  Alicyclobacillus acidocaldarius mutated SEQ ID NO 2807
gtggaagagatccgcacgagcgaacggtatcgggaagcggtgcaatcgggccgcgtggtggtggaattctatgcgacgtggtgcccagactgccgtaaaattgagccatatttgggggaatgggaagaaaagtaccgtgagcaattcacgatggtccgcgtgaaccgggacgaggtgccggacctggcggaagagctccagattcttggaattccgaccttcctcgtctacgaccaaggccgcgaggtcaagcggctcttcagtcgcgacgcgaagtccaaggagcaggtggagcagttcttggaccaggcgtatgcctga

SEQ ID NO: 2823 - protein, 514 aa, Alicyclobacillus acidocaldarius; identical to SEQ ID NO: 1905

SEQ ID NO: 2824 - DNA, 1545 bp, Alicyclobacillus acidocaldarius; identical to SEQ ID NO: 1906

SEQ ID NO: 2825 - protein, 374 aa, Paenibacillus larvae; identical to SEQ ID NO: 1907

SEQ ID NO: 2826 - protein, 358 aa, Pelotomaculum thermopropionicum; identical to SEQ ID NO: 1908

SEQ ID NO: 2827 - protein, 357 aa, Thermosinus carboxydivorans; identical to SEQ ID NO: 1909

SEQ ID NO: 2828 - protein, 356 aa, Pelotomaculum thermopropionicum; identical to SEQ ID NO: 1910

SEQ ID NO: 2829 - protein, 386 aa, Nitrococcus mobilis; identical to SEQ ID NO: 1911

SEQ ID NO: 2830 - protein, 514 aa, Artificial; identical to SEQ ID NO: 1912
  Alicyclobacillus acidocaldarius mutated SEQ ID NO 2823

SEQ ID NO: 2831 - protein, 514 aa, Artificial
  Alicyclobacillus acidocaldarius mutated SEQ ID NO 2823
MMWTAIYTRVSTEHQAQAGHGLDVQREACVQYALSLGVAPHDIRLYEEAGGSGEDMDRPELLRLLDDVRRGLVDRVVVKHPDRLSRNVADKAIVVRELSACGVKLHFVDVPNWDESDEAVLLFHVISSIAEYELRQIRRRTLAGKLKAVRGGKVMPSGVDPYGYRYEDGRYVVVPEEAEIVRLIYQWYGIDGMSLRAIAERLDAMGVPTKTRQSARWHHSTVARILDNPLYRGTWYYNRRRTRKRQGVRGARRGRGRQVVAVRDPGEWIAVSVPPVVDPDLARSVALRKQGSPRGGSTSAHTFLSGKLVCAHCQRAWRHEACRTAGGIVRKFRRPPAERGADPCAYRCARVPADEIERAVWRELVRRMRALGIGRELAAGGRASPGDPLMEDVARLRREMRAAVERRDRARELYLRGHLDRTAALRAMSEEARRLREGRAEACKLCHARQRRLNAWEDLWTALETHDGVELRRLWLEAAVSRVEMDASGGEVVLTLFARIGEQTGARVDDTLAT

SEQ ID NO: 2832 - protein, 514 aa, Artificial
  Alicyclobacillus acidocaldarius mutated SEQ ID NO 2823
MMWTAIYTRVSTEHQAQAGHGLDVQREACVQYALSLGVAPHDIRLYEEAGGSGEDMDRPELLRLLDDVRRGLVDRVVVKHPDRLSRNVADKAIVVRELSACGVKLHFVDVPNWDESDEAVLLFHVISSIAEYELRQIRRRTLAGKLKAVRGGKVMPSGVDPYGYRYEDGRYVVVPEEAEIVRLIYQWYGIDGMSLRAIAERLDAMGVPTKTRQSARWHHSTVARILDNPLYRGTWYYNRRRTRKRQGVRGARRGRGRQVVAIRDPGEWIAVSVPPVVDPDLARSVALRKQGSPRGGSTSAHTFLSGKLVCAHCQRAWRHEACRTAGGIVRKFRRPPAERGADPCAYRCARVPADEIERAVWRELVRRMRALGIGRELAAGGRASPGDPLMEDVARLRREMRAAVERRDRARELYLRGHLDRTAALRAMSEEARRLREGRAEACRLCHARQRRLNAWEDLWTALETHDGVELRRLWLEAAVSRVEMDASGGEVVLTLFARIGEQTGARVDDTLAT

SEQ ID NO: 2833 - protein, 514 aa, Artificial
  Alicyclobacillus acidocaldarius mutated SEQ ID NO 2823
MMWTAIYTRVSTEHQAQAGHGLDVQREACVQYALSLGVAPHDIRLYEEAGGSGEDMDRPELLRLLDDVRRGLVDRVVVKHPDRLSRNVADKAIVVRELSACGVKLHFVDVPNWDESDEAVLLFHVISSIAEYELRQIRRRTLAGKLKAVRGGKVMPSGVDPYGYRYEDGRYVVVPEEAEIVRLIYQWYGIDGMSLRAIAERLDAMGVPTKTRQSARWHHSTVARILDNPLYRGTWYYNRRRTRKRQGVRGARRGRGRQVVAVRDPGEWIAVSVPPVVDPDLARSVALRKQGSPRGGSTSAHTFLSGKLVCAHCQRAWRHEACRTAGGIVRRFRRPPAERGADPCAYRCARVPADEIERAVWRELVRRMRALGIGRELAAGGRASPGDPLMEDVARLRREMRAAVERRDRARELYLRGHLDRTAALRAMSEEARRLREGRAEACRLCHARQRRLNAWEDLWTALETHDGVELRRLWLEAAVSRVEMDASGGEVVLTLFARIGEQTGARVDDTLAT

SEQ ID NO: 2834 - protein, 514 aa, Artificial
  Alicyclobacillus acidocaldarius mutated SEQ ID NO 2823
MMWTAIYTRVSTEHQAQAGHGLDVQREACVQYALSLGVAPHDIRLYEEAGGSGEDMDRPELLRLLDDVRRGLVDRVVVKHPDRLSRNVADKAIVVRELSACGVKLHFVDVPNWDESDEAVLLFHVISSIAEYELRQIRRRTLAGKLKAVRGGRVMPSGVDPYGYRYEDGRYVVVPEEAEIVRLIYQWYGIDGMSLRAIAERLDAMGVPTKTRQSARWHHSTVARILDNPLYRGTWYYNRRRTRKRQGVRGARRGRGRQVVAVRDPGEWIAVSVPPVVDPDLARSVALRKQGSPRGGSTSAHTFLSGKLVCAHCQRAWRHEACRTAGGIVRKFRRPPAERGADPCAYRCARVPADEIERAVWRELVRRMRALGIGRELAAGGRASPGDPLMEDVARLRREMRAAVERRDRARELYLRGHLDRTAALRAMSEEARRLREGRAEACRLCHARQRRLNAWEDLWTALETHDGVELRRLWLEAAVSRVEMDASGGEVVLTLFARIGEQTGARVDDTLAT

SEQ ID NO: 2835 - DNA, 1545 bp, Artificial; identical to SEQ ID NO: 1917
  Alicyclobacillus acidocaldarius mutated SEQ ID NO 2824

SEQ ID NO: 2836 - DNA, 1545 bp, Artificial
  Alicyclobacillus acidocaldarius mutated SEQ ID NO 2824
gtgatgtggaccgccatctacacccgcgtgtcgaccgaacaccaggcgcaggcggggcatgggcttgacgtccagcgagaggcgtgcgtgcagtacgccctttcccttggggtggccccgcacgacatccgcctctacgaggaagcgggcgggtcgggcgaggacatggaccggccggagctgttgcgcctcctcgatgacgtccggcgtgggcttgtcgatcgcgtcgtcgtgaaacaccccgaccgcctgtcgcgcaacgtggccgacaaggccattgtggtacgggagttatccgcgtgcggcgtgaagctccactttgtcgacgtgcccaactgggatgagtccgacgaagcggtgcttctctttcacgtcatctcgagcattgccgagtacgaactgcgccagatcagacggcggacccttgcgggcaaactgaaggcagttcggggcggcaaggtgatgccatccggggtggatccgtacggctatcgctacgaggacgggcgatacgtcgtggttcccgaggaggccgagatcgtccggctcatctaccaatggtatgggatcgacggcatgagccttcgcgccatcgccgagcggctcgacgcgatgggggtgccgaccaagacgcgccagtcggcgcgctggcaccacagcacggtggcgaggatcctcgacaacccactctatcgaggcacctggtattacaaccgccggcgcacgcgcaaacggcagggcgtgagaggcgcgcgccgcggccgagggcggcaggtggtggccgtgcgcgatcccggcgaatggatcgccgtatcggtgccgcccgttgtcgatccggacctcgcgcgctcggtcgcgctgcgcaagcagggcagtccgcgaggcggctcgacttcggcgcacacgtttttatcgggcaaactcgtgtgcgcgcactgtcaacgcgcttggcgtcacgaggcatgtcgaaccgcgggcgggatcgtgcgcaagtttcggcgcccgccggcggaacgaggggccgacccatgcgcgtatcgatgtgcgcgcgtgcctgcggacgagatcgagcgggcggtgtggcgcgagctggtgcggcgcatgcgcgctttgggaattgggcgcgagctcgccgcaggcgggcgcgcgagcccgggcgacccgctgatggaggatgtggcgcgacttcgccgagagatgcgggccgcggtggaaaggcgggatcgcgcgagggagctgtatctgcgcgggcacctggaccgaaccgcggctctgcgcgcgatgtcggaggaggcccggcgcctgcgcgaggggcgcgccgaggcgtgcaaactgtgtcacgcgcggcaacgtcggttgaacgcgtgggaagacctgtggacggcgcttgaaacgcacgatggcgtggagctcaggcggttgtggctcgaggctgcggtgtcgcgcgtcgagatggacgcctcgggcggcgaggtggtgctgaccctcttcgcccggatcggcgaacaaacgggtgcccgcgtcgacgacacgttggcgacgtga

SEQ ID NO: 2837 - DNA, 1545 bp, Artificial
  Alicyclobacillus acidocaldarius mutated SEQ ID NO 2824
gtgatgtggaccgccatctacacccgcgtgtcgaccgaacaccaggcgcaggcggggcatgggcttgacgtccagcgagaggcgtgcgtgcagtacgccctttcccttggggtggccccgcacgacatccgcctctacgaggaagcgggcgggtcgggcgaggacatggaccggccggagctgttgcgcctcctcgatgacgtccggcgtgggcttgtcgatcgcgtcgtcgtgaaacaccccgaccgcctgtcgcgcaacgtggccgacaaggccattgtggtacgggagttatccgcgtgcggcgtgaagctccactttgtcgacgtgcccaactgggatgagtccgacgaagcggtgcttctctttcacgtcatctcgagcattgccgagtacgaactgcgccagatcagacggcggacccttgcgggcaaactgaaggcagttcggggcggcaaggtgatgccatccggggtggatccgtacggctatcgctacgaggacgggcgatacgtcgtggttcccgaggaggccgagatcgtccggctcatctaccaatggtatgggatcgacggcatgagccttcgcgccatcgccgagcggctcgacgcgatgggggtgccgaccaagacgcgccagtcggcgcgctggcaccacagcacggtggcgaggatcctcgacaacccactctatcgaggcacctggtattacaaccgccggcgcacgcgcaaacggcagggcgtgagaggcgcgcgccgcggccgagggcggcaggtggtggccattcgcgatcccggcgaatggatcgccgtatcggtgccgcccgttgtcgatccggacctcgcgcgctcggtcgcgctgcgcaagcagggcagtccgcgaggcggctcgacttcggcgcacacgtttttatcgggcaaactcgtgtgcgcgcactgtcaacgcgcttggcgtcacgaggcatgtcgaaccgcgggcgggatcgtgcgcaagtttcggcgcccgccggcggaacgaggggccgacccatgcgcgtatcgatgtgcgcgcgtgcctgcggacgagatcgagcgggcggtgtggcgcgagctggtgcggcgcatgcgcgctttgggaattgggcgcgagctcgccgcaggcgggcgcgcgagcccgggcgacccgctgatggaggatgtggcgcgacttcgccgagagatgcgggccgcggtggaaaggcgggatcgcgcgagggagctgtatctgcgcgggcacctggaccgaaccgcggctctgcgcgcgatgtcggaggaggcccggcgcctgcgcgaggggcgcgccgaggcgtgccgactgtgtcacgcgcggcaacgtcggttgaacgcgtgggaagacctgtggacggcgcttgaaacgcacgatggcgtggagctcaggcggttgtggctcgaggctgcggtgtcgcgcgtcgagatggacgcctcgggcggcgaggtggtgctgaccctcttcgcccggatcggcgaacaaacgggtgcccgcgtcgacgacacgttggcgacgtga

SEQ ID NO: 2838 - DNA, 1545 bp, Artificial
  Alicyclobacillus acidocaldarius mutated SEQ ID NO 2824
gtgatgtggaccgccatctacacccgcgtgtcgaccgaacaccaggcgcaggcggggcatgggcttgacgtccagcgagaggcgtgcgtgcagtacgccctttcccttggggtggccccgcacgacatccgcctctacgaggaagcgggcgggtcgggcgaggacatggaccggccggagctgttgcgcctcctcgatgacgtccggcgtgggcttgtcgatcgcgtcgtcgtgaaacaccccgaccgcctgtcgcgcaacgtggccgacaaggccattgtggtacgggagttatccgcgtgcggcgtgaagctccactttgtcgacgtgcccaactgggatgagtccgacgaagcggtgcttctctttcacgtcatctcgagcattgccgagtacgaactgcgccagatcagacggcggacccttgcgggcaaactgaaggcagttcggggcggcaaggtgatgccatccggggtggatccgtacggctatcgctacgaggacgggcgatacgtcgtggttcccgaggaggccgagatcgtccggctcatctaccaatggtatgggatcgacggcatgagccttcgcgccatcgccgagcggctcgacgcgatgggggtgccgaccaagacgcgccagtcggcgcgctggcaccacagcacggtggcgaggatcctcgacaacccactctatcgaggcacctggtattacaaccgccggcgcacgcgcaaacggcagggcgtgagaggcgcgcgccgcggccgagggcggcaggtggtggccgtgcgcgatcccggcgaatggatcgccgtatcggtgccgcccgttgtcgatccggacctcgcgcgctcggtcgcgctgcgcaagcagggcagtccgcgaggcggctcgacttcggcgcacacgtttttatcgggcaaactcgtgtgcgcgcactgtcaacgcgcttggcgtcacgaggcatgtcgaaccgcgggcgggatcgtgcgccgttttcggcgcccgccggcggaacgaggggccgacccatgcgcgtatcgatgtgcgcgcgtgcctgcggacgagatcgagcgggcggtgtggcgcgagctggtgcggcgcatgcgcgctttgggaattgggcgcgagctcgccgcaggcgggcgcgcgagcccgggcgacccgctgatggaggatgtggcgcgacttcgccgagagatgcgggccgcggtggaaaggcgggatcgcgcgagggagctgtatctgcgcgggcacctggaccgaaccgcggctctgcgcgcgatgtcggaggaggcccggcgcctgcgcgaggggcgcgccgaggcgtgccgactgtgtcacgcgcggcaacgtcggttgaacgcgtgggaagacctgtggacggcgcttgaaacgcacgatggcgtggagctcaggcggttgtggctcgaggctgcggtgtcgcgcgtcgagatggacgcctcgggcggcgaggtggtgctgaccctcttcgcccggatcggcgaacaaacgggtgcccgcgtcgacgacacgttggcgacgtga

SEQ ID NO: 2839 - DNA, 1545 bp, Artificial
  Alicyclobacillus acidocaldarius mutated SEQ ID NO 2824
gtgatgtggaccgccatctacacccgcgtgtcgaccgaacaccaggcgcaggcggggcatgggcttgacgtccagcgagaggcgtgcgtgcagtacgccctttcccttggggtggccccgcacgacatccgcctctacgaggaagcgggcgggtcgggcgaggacatggaccggccggagctgttgcgcctcctcgatgacgtccggcgtgggcttgtcgatcgcgtcgtcgtgaaacaccccgaccgcctgtcgcgcaacgtggccgacaaggccattgtggtacgggagttatccgcgtgcggcgtgaagctccactttgtcgacgtgcccaactgggatgagtccgacgaagcggtgcttctctttcacgtcatctcgagcattgccgagtacgaactgcgccagatcagacggcggacccttgcgggcaaactgaaggcagttcggggcggccgtgtgatgccatccggggtggatccgtacggctatcgctacgaggacgggcgatacgtcgtggttcccgaggaggccgagatcgtccggctcatctaccaatggtatgggatcgacggcatgagccttcgcgccatcgccgagcggctcgacgcgatgggggtgccgaccaagacgcgccagtcggcgcgctggcaccacagcacggtggcgaggatcctcgacaacccactctatcgaggcacctggtattacaaccgccggcgcacgcgcaaacggcagggcgtgagaggcgcgcgccgcggccgagggcggcaggtggtggccgtgcgcgatcccggcgaatggatcgccgtatcggtgccgcccgttgtcgatccggacctcgcgcgctcggtcgcgctgcgcaagcagggcagtccgcgaggcggctcgacttcggcgcacacgtttttatcgggcaaactcgtgtgcgcgcactgtcaacgcgcttggcgtcacgaggcatgtcgaaccgcgggcgggatcgtgcgcaagtttcggcgcccgccggcggaacgaggggccgacccatgcgcgtatcgatgtgcgcgcgtgcctgcggacgagatcgagcgggcggtgtggcgcgagctggtgcggcgcatgcgcgctttgggaattgggcgcgagctcgccgcaggcgggcgcgcgagcccgggcgacccgctgatggaggatgtggcgcgacttcgccgagagatgcgggccgcggtggaaaggcgggatcgcgcgagggagctgtatctgcgcgggcacctggaccgaaccgcggctctgcgcgcgatgtcggaggaggcccggcgcctgcgcgaggggcgcgccgaggcgtgccgactgtgtcacgcgcggcaacgtcggttgaacgcgtgggaagacctgtggacggcgcttgaaacgcacgatggcgtggagctcaggcggttgtggctcgaggctgcggtgtcgcgcgtcgagatggacgcctcgggcggcgaggtggtgctgaccctcttcgcccggatcggcgaacaaacgggtgcccgcgtcgacgacacgttggcgacgtga

SEQ ID NO: 2840 - protein, 808 aa, Alicyclobacillus acidocaldarius
MTHGGGVLRFARLSRVSSSSRGGRSHDQALSDRVGGGDQIVAGGRGDRRRSRLRGGHPPHTLRRVSSSSRSGRRGRPARAGSGGRSPGELPRLHGSLDCRSAGRHHELCPSAAAQRRLHRVRERRRGELRRRPGSLSGRVVLRAPRARRVCRGRSRRPRVARRAVRGLAGQAHARVRGVRIAARGHGHGAPRPAPRSKARDAKSYGRDRRGEEPANARRGRAAPGLRGRRAHRRLLGIRSQRLGHRRGGAFGPGSRRRHPVDARRTLFAPRAGRVRGIRWRDAPGARGASCSRMSKAISRAKDGDEGMDIKERARARVEEIGALPVYRDRHLTLLTDLYQLTMMYGHFRAGRHETRVVFDLFYRKNPCGNGYVIAAGLEQVVWYIYNLAFSEDDLAYLRSLGMFSEDFLSYLRHFRFRGDVYAVPEGTVVFPNEPILRVEGPIAEVQLIESAVLAFINHQSLIATKARRIVEAARTNVRHPGSTVIEMGLRRSQNADAAVFGARAAFIGGCVATSNVLAAQSYNIPVAGTQAHSWIQSFPSEYEAFQAYRAAFPDNTVLLVDTYDVLRSGVPNAIRVGLEMKAAGQSLKAIRIDSGDLAYLSKRARQMLNDAGLADVQIIASSDLDEYTIRDLLTQGAEIDAWGVGTRLITSEDCPSLGCVYKLVAQQFGDRMEPRIKISENPNKITNPGKKKVLRLYVNGSATADLIALDEEVYDPSEPLELFHPIHTYKRKVVQNYEMEELLRPVFVGGELVYELPTVQEIQARVETQLSAFSSEVRRHLNPHEYHVDLSKPLWDLKQRLLHEWRR

SEQ ID NO: 2841 - DNA, 2427 bp, Alicyclobacillus acidocaldarius
gtgactcatggtggaggcgtcttacgttttgctcgcctcagccgcgtttcgagcagctcgcgcggcgggcgatcacatgatcaagcgctatcggaccgagttggtggtggagaccaaatcgtcgctggcggacgtggtgaccgacgtcgatcgcgcctgcgaggaggccatccgccgcacactctccgacgcgtttcctcatcatcgcgttctgggcgaagagggcgtccggcccgggcgggaagcggcggtcgaagccctggcgaattgcctcgactgcacggatctctggattgtcgatccgctggacggcaccacgaactttgtccatcagctgccgctcagcgtcgtctccatcgcgtacgcgagcggcggcgaggtgaacttcggcgtcgtcctggatccctatcggggcgagtggttctacgcgctccgcgggcaaggcgcgtatgccgcgggcgatcacgacgtccgcgcgtggctcgccgcgccgtccgaggattggccgggcaagcgcatgcgcgtgtccggggtgtgcgaattgcggcgcgcggtcatggccacggggctccccgtccggcaccgcgatcgaaagcgcgtgatgcaaagagctacggacgtgatcgccgaggtgaagagcctgcgaacgctcggcgcggccgcgctgcacctggcttacgtggccgccgggcgcatcgacgtcttctgggaattcgatctcaacgcctgggacatcgccgcgggggcgcttttggtccaggaagcaggcggcgtcatccagtcgatgcaaggcgaaccctattcgctccgcgtgcgggacgtgtgcgcgggatccgatggcgagatgctccgggcgctcggggcgcgtcttgcagccgaatgagcaaggccatcagtcgagccaaggatggggatgaggggatggatatcaaggagcgcgcgagggcgcgcgtcgaagagataggagcgttgccggtgtaccgcgatcgccatctgacgctgctcacggacctgtatcaattgacgatgatgtacggccactttcgtgccggccgccacgagacccgcgtggtgtttgacctgttctaccggaagaatccttgcggcaacggctacgtgatcgcggccggactggaacaggtggtgtggtacatctacaacctcgcgttttcggaggacgatctcgcctatctgcggtcgctcgggatgttctccgaggactttctctcctatctgcgccatttcaggtttcgcggagatgtctacgcggtgcccgagggcacggtggtgtttccgaacgagccgatcctgcgcgtggaggggcccatcgcggaggttcaattgattgagtcggcggtgctcgcgttcatcaatcatcagagcctcatcgcgacgaaggcgcggcggatcgtcgaggcggcgaggacgaacgtcaggcatcccgggagcaccgtgattgaaatggggctcaggcgatcgcagaacgcggacgcggccgtcttcggcgcgcgcgcggcgttcatcgggggctgcgtggcgacgagtaacgtgctggcggcacagtcctacaacatccctgtggcgggcacgcaggcgcacagttggatccagagcttccccagcgagtacgaggcgtttcaggcgtaccgcgccgcgttcccggacaacaccgtcttgctcgtcgacacgtacgacgtgctgaggagtggcgttccgaacgccatccgggtcggcctggagatgaaggcggcgggtcaatccctcaaggccattcgaattgacagcggcgatctcgcttatttgtccaagcgagcccgccagatgttgaacgacgcagggctcgcggacgtgcagatcatcgcgtcgagcgatctcgacgagtacaccattcgcgatctgctgacgcaaggggccgagatcgacgcctggggcgtgggcacgcggctcatcacgagcgaagactgcccttcgctcggctgcgtgtacaagctcgtggcgcagcagtttggcgatcggatggagccgaggatcaagatctccgaaaaccccaacaagatcacgaacccgggcaagaagaaggtcctgcgcctgtacgtgaacggatcggccacggcggacctcatcgcgctcgacgaggaagtgtacgatccgtccgagccgctcgaactgtttcatccgattcatacgtacaagcgcaaagtggtgcagaactacgagatggaggagctgcttcgcccggtctttgtcggcggtgaactggtctacgagctgccgacggtgcaggagatccaggcgcgcgtggagacgcagctgtccgcgttctcgtcggaggtcaggcgacatctgaatccgcacgagtatcatgtggacctgtccaagccgctctgggatttgaagcagcggctgctgcacgaatggcggcggtag

SEQ ID NO: 2842 - protein, 474 aa, Alkaliphilus oremlandii
KNLTLLTDLYQLTMMNGYLKNGADENVVIFDLFFRTNPCNNSYTMIAGIEQVIDYIENLKFDEESLVYLKGLNLFDDEFIDYLRNFKFTGTIYGVDEGTVMFPYEPILRVKAPVIQAQLIETTLLNIVNFQSLIATKAARICSAADGDPVFEFGLRRAQGPDAGVYGARAAVIGGCVGTSNVLAGKRFDIPVVGTHAHSWIQSFDSELEAFRAYARSYPNSTTLLVDTYNVLHSGVPNAITVFNELKEQGYEPKGIRIDSGDIAYLSKEARKMLDAAGLPNVKITASSDLDEDVINNLKLQGAAIDFWGVGTNLITSKSCPALGGVYKLSAIEVDGQIIPKIKISENPEKITNPGYKKVVRIYDKENKKAQADLIMLDSEEINTNEPLTIFHPIYTWKKKTFRNYETKDLLVPIYEQGKLVYERKTIKEIRKHAQSELDSLWPEYRRLNRPQLYKVDLSKKLWDLKNQMMDQFR

SEQ ID NO: 2843 - protein, 467 aa, Desulfitobacterium hafniense
VALLTDLYQLTMMQGYYQNGYENKEAVFDLYFRKIPSGGGYVIAAGLEQVVEYIENLRFSSEDMAYLRGLNIFDEGFLNLLKDFRFHGDIDAVPEGTVVFPYEPLVRVKGRILEAQLIETALLNIINFETLIATKASRVVAAAGGGSVMEFGLRRAQGPDAGILGSRAAFIGGCQFTSNVLAGKRYGIPLSGTQAHSWIQCFPDELEAFRAYARTFPDQCLLLVDTYNVLKSGVPNAIKVGLELEAEGHRFLGIRIDSGDLTYLSREARKMLDQAGLEHARIVASNDLDEHTISAIRAQGAAIDSWGVGTHLITSKDTPALGGVYKLSAEGQKGVFEPRLKVSENISKITNPGIKKIVRFYDRRGKAMADLIALEDEHFEEPLTIFDPIETWKRKTLTDFKTRELLRPVFRGGRRVYELPYLKDIQTYAQHECETLWDEVKRLVNPHRYIVDLSPKLFELRQSLLLE

SEQ ID NO: 2844 - protein, 475 aa, Alkaliphilus metalliredigens
RNHTLLTDLYQLTMMNGYFENNSHEDTVIFDLFFRKNPCNNSFTIIAGIEQVIDYIENLGFTEEDIQYLRSLNLFGEAFLDMLKQFTFTGTIYGVQEGSIMFPHEPILRVKASVLQAQLIETALLNMINFQSLIATKASRIVEAAKGDPVFEFGLRRAQGPDAGIYGARAAVIGGCVATSNILAGKLFDLPVVGTHAHSWIQKFDSELEAFRAYAKAYPDKCLLLVDTYDTLKSGIPNALTVFNELREKGYEPKGIRIDSGDLAYISKQARRMLDDAGYEKVGIVASSDLDEDTIDSLKLQGASINSWGVGTNLITSKDCPALGGVYKLSAVEKSGTLIPKMKLSDNPGKITNPGYKKVIRIYEAENNRAQADLILLEEEEIDTTKPLTIFHPLYTWKKKTFSNYKVREMLMPIYEDGKLVYPRKTVNEIRAYVRQELSTLWPEYKRLNRPQLYKVDLSQKLWSLKHNMIQSLKK

SEQ ID NO: 2845 - protein, 469 aa, Clostridium difficile
RNLTLLTDLYQLTMLNGYFEKNIHEDIVVFDMFFRKNACDGGYTIVCGIDQVVEYIDNLHFSDEDLEYLKNLNLFSDKFLKFLKEFKFTGDIYAVEEGTIMFPNEPLITVKAPLYQAQLIETALLTIVNFQSLIATKASRVCFAAQGDPVFEFGLRRAQGPDAGIYGARAAVVGGCAGTANVLAGKMFDIPIIGTQAHSWVQKFDNELEAFQAYADVYPDKCLLLVDTYDVLNSGVPNAIKVFKNISEKGYKPMGIRLDSGDLAYLSKEAKKQLDNAGFSDISITASNDLDEYTITSLKAEGATINSWGVGTKLITSFDSPSLGGVYKLAASCEKGVLEPKIKISENPEKINNPGYKKVIRIYNEDNKAEADLIMLHDEVIDESKPLEIFHPTYTWKTKVFTNYKVKELLKPLYIKGRCKYNKKAVLEIKNHVQYELSTIWEQYKRLSKPHIYKVDLSRNLWYLKTQMI

SEQ ID NO: 2846 - protein, 476 aa, Dorea longicatena
RNLTLLTDLYELTMMQGYYEKGQNENVIFDVFFRQNPCNNGYSVCAGLDQVIDYIKNLHFTYDDVDYLRGLGIFKEDFLHYLSGFHFSGDIYAIPEGTVVFPKEPLLKVVAPIMEAQLVETAILNIINHQSLIATKTSRIVFAANGDGIMEFGLRRAQGPDAGLYGARAAMIGGCVGTSNVLAGQMFDVPVMGTHAHSWIMSFPDEYTAFKTYAEMYPDNCTLLVDTYDTLKSGVPNAIRVFQEFKDAGKPLIKYGIRLDSGDLAYLSKEARKMLDEAGFPEATICASNDLDEFLLHDLKMQGAAIDSWGVGTNLITSKDCPSFGGVYKLAAIQNEEGEFVPKIKISENTEKITNPGNKTIYRIYEKASGKIKADLICFADEVIDPKQDLLLFDPMDTWKKTKLAGGTYNVREILLPIFKNGECLYKSPTLKEIAAYCREEKDTLWDETKRLFYPHRVYVDLSQKLYAVKQSLLDQ

SEQ ID NO: 2847 - protein, 808 aa, Artificial
  Alicyclobacillus acidocaldarius mutated SEQ ID NO 2840
MTHGGGVLRFARLSRVSSSSRGGRSHDQALSDRVGGGDQIVAGGRGDRRRSRLRGGHPPHTLRRVSSSSRSGRRGRPARAGSGGRSPGELPRLHGSLDCRSAGRHHELCPSAAAQRRLHRVRERRRGELRRRPGSLSGRVVLRAPRARRVCRGRSRRPRVARRAVRGLAGQAHARVRGVRIAARGHGHGAPRPAPRSKARDAKSYGRDRRGEEPANARRGRAAPGLRGRRAHRRLLGIRSQRLGHRRGGAFGPGSRRRHPVDARRTLFAPRAGRVRGIRWRDAPGARGASCSRMSKAISRAKDGDEGMDIKERARARVEEIGALPVYRDRHLTLLTDLYQLTMMYGHFRAGRHETRVVFDLFYRKNPCGNGYVIAAGLEQVVWYIYNLAFSEDDLAYLRSLGMFSEDFLSYLRHFRFRGDVYAVPEGTVVFPNEPILRVEGPIAEVQLIESAVLAFINHQSLIATKARRIVEAARTNVRHPGSTVIEMGLRRSQNADAAVFGARAAFIGGCVATSNVLAAQSYNIPVAGTQAHSWIQSFPSEYEAFQAYRAAFPDNTVLLVDTYDVLRSGVPNAIRVGLEMKAAGQSLKAIRIDSGDLAYLSKRARQMLNDAGLADVQILASSDLDEYTIRDLLTQGAEIDAWGVGTRLITSEDCPSLGCVYKLVAQQFGDRMEPRIKISENPNKITNPGKKKVLRLYVNGSATADLIALDEEVYDPSEPLELFHPIHTYKRKVVQNYEMEELLRPVFVGGELVYELPTVQEIQARVETQLSAFSSEVRRHLNPHEYHVDLSKPLWDLKQRLLHEWRR

SEQ ID NO: 2848 - protein, 808 aa, Artificial
  Alicyclobacillus acidocaldarius mutated SEQ ID NO 2840
MTHGGGVLRFARLSRVSSSSRGGRSHDQALSDRVGGGDQIVAGGRGDRRRSRLRGGHPPHTLRRVSSSSRSGRRGRPARAGSGGRSPGELPRLHGSLDCRSAGRHHELCPSAAAQRRLHRVRERRRGELRRRPGSLSGRVVLRAPRARRVCRGRSRRPRVARRAVRGLAGQAHARVRGVRIAARGHGHGAPRPAPRSKARDAKSYGRDRRGEEPANARRGRAAPGLRGRRAHRRLLGIRSQRLGHRRGGAFGPGSRRRHPVDARRTLFAPRAGRVRGIRWRDAPGARGASCSRMSKAISRAKDGDEGMDIKDRARARVEEIGALPVYRDRHLTLLTDLYQLTMMYGHFRAGRHETRVVFDLFYRKNPCGNGYVIAAGLEQVVWYIYNLAFSEDDLAYLRSLGMFSEDFLSYLRHFRFRGDVYAVPEGTVVFPNEPILRVEGPIAEVQLIESAVLAFINHQSLIATKARRIVEAARTNVRHPGSTVIEMGLRRSQNADAAVFGARAAFIGGCVATSNVLAAQSYNIPVAGTQAHSWIQSFPSEYEAFQAYRAAFPDNTVLLVDTYDVLRSGVPNAIRVGLEMKAAGQSLKAIRIDSGDLAYLSKRARQMLNDAGLADVQIIASSDLDEYTIRDLLTQGAEIDAWGVGTRLITSEDCPSLGCVYKLVAQQFGDRMEPRIKISENPNKITNPGKKKVLRLYVNGSATADLIALDEEVYDPSEPLELFHPIHTYKRKVVQNYEMEELLRPVFVGGELVYELPTVQEIQARVETQLSAFSSEVRRHLNPHEYHVDLSKPLWDLKQRLLHEWRR

SEQ ID NO: 2849 - protein, 808 aa, Artificial
  Alicyclobacillus acidocaldarius mutated SEQ ID NO 2840
MTHGGGVLRFARLSRVSSSSRGGRSHDQALSDRVGGGDQIVAGGRGDRRRSRLRGGHPPHTLRRVSSSSRSGRRGRPARAGSGGRSPGELPRLHGSLDCRSAGRHHELCPSAAAQRRLHRVRERRRGELRRRPGSLSGRVVLRAPRARRVCRGRSRRPRVARRAVRGLAGQAHARVRGVRIAARGHGHGAPRPAPRSKARDAKSYGRDRRGEEPANARRGRAAPGLRGRRAHRRLLGIRSQRLGHRRGGAFGPGSRRRHPVDARRTLFAPRAGRVRGIRWRDAPGARGASCSRMSKAISRAKDGDEGMDIKERARARVEEIGALPVYRDRHLTLLTDLYQLTMMYGHFRAGRHETRVVFDLFYRKNPCGNGYVIAAGLEQVVWYIYNLAFSEDDLAYLRSLGMFSEDFLSYLRHFRFRGDVYAVPEGTVVFPNEPILRVEGPIAEVQLIESAVLAFINHQSLIATKARRIVEAARTNVRHPGSTVIEMGLRRSQNADAAVFGARAAFIGGCVATSNVLAAQSYNIPVAGTQAHSWIQSFPSEYEAFQAYRAAFPDNTVLLVDTYDVLRSGVPNAIRVGLEMKAAGQSLKAIRIDSGDLAYLSKRARQMLNDAGLADVQIIASSDLDEYTIRDLLTQGAEIDAWGVGTRLITSEDCPSLGCVYKLIAQQFGDRMEPRIKISENPNKITNPGKKKVLRLYVNGSATADLIALDEEVYDPSEPLELFHPIHTYKRKVVQNYEMEELLRPVFVGGELVYELPTVQEIQARVETQLSAFSSEVRRHLNPHEYHVDLSKPLWDLKQRLLHEWRR

SEQ ID NO: 2850 - protein, 808 aa, Artificial
  Alicyclobacillus acidocaldarius mutated SEQ ID NO 2840
MTHGGGVLRFARLSRVSSSSRGGRSHDQALSDRVGGGDQIVAGGRGDRRRSRLRGGHPPHTLRRVSSSSRSGRRGRPARAGSGGRSPGELPRLHGSLDCRSAGRHHDLCPSAAAQRRLHRVRERRRGELRRRPGSLSGRVVLRAPRARRVCRGRSRRPRVARRAVRGLAGQAHARVRGVRIAARGHGHGAPRPAPRSKARDAKSYGRDRRGEEPANARRGRAAPGLRGRRAHRRLLGIRSQRLGHRRGGAFGPGSRRRHPVDARRTLFAPRAGRVRGIRWRDAPGARGASCSRMSKAISRAKDGDEGMDIKERARARVEEIGALPVYRDRHLTLLTDLYQLTMMYGHFRAGRHETRVVFDLFYRKNPCGNGYVIAAGLEQVVWYIYNLAFSEDDLAYLRSLGMFSEDFLSYLRHFRFRGDVYAVPEGTVVFPNEPILRVEGPIAEVQLIESAVLAFINHQSLIATKARRIVEAARTNVRHPGSTVIEMGLRRSQNADAAVFGARAAFIGGCVATSNVLAAQSYNIPVAGTQAHSWIQSFPSEYEAFQAYRAAFPDNTVLLVDTYDVLRSGVPNAIRVGLEMKAAGQSLKAIRIDSGDLAYLSKRARQMLNDAGLADVQIIASSDLDEYTIRDLLTQGAEIDAWGVGTRLITSEDCPSLGCVYKLVAQQFGDRMEPRIKISENPNKITNPGKKKVLRLYVNGSATADLIALDEEVYDPSEPLELFHPIHTYKRKVVQNYEMEELLRPVFVGGELVYELPTVQEIQARVETQLSAFSSEVRRHLNPHEYHVDLSKPLWDLKQRLLHEWRR

SEQ ID NO: 2851 - protein, 808 aa, Artificial
  Alicyclobacillus acidocaldarius mutated SEQ ID NO 2840
MTHGGGVLRFARLSRVSSSSRGGRSHDQALSDRVGGGDQIVAGGRGDRRRSRLRGGHPPHTLRRVSSSSRSGRRGRPARAGSGGRSPGELPRLHGSLDCRSAGRHHELCPSAAAQRRLHRVRERRRGELRRRPGSLSGRVVLRAPRARRVCRGRSRRPRVARRAVRGLAGQAHARVRGVRIAARGHGHGAPRPAPRSKARDAKSYGRDRRGEEPANARRGRAAPGLRGRRAHRRLLGIRSNRLGHRRGGAFGPGSRRRHPVDARRTLFAPRAGRVRGIRWRDAPGARGASCSRMSKAISRAKDGDEGMDIKERARARVEEIGALPVYRDRHLTLLTDLYQLTMMYGHFRAGRHETRVVFDLFYRKNPCGNGYVIAAGLEQVVWYIYNLAFSEDDLAYLRSLGMFSEDFLSYLRHFRFRGDVYAVPEGTVVFPNEPILRVEGPIAEVQLIESAVLAFINHQSLIATKARRIVEAARTNVRHPGSTVIEMGLRRSQNADAAVFGARAAFIGGCVATSNVLAAQSYNIPVAGTQAHSWIQSFPSEYEAFQAYRAAFPDNTVLLVDTYDVLRSGVPNAIRVGLEMKAAGQSLKAIRIDSGDLAYLSKRARQMLNDAGLADVQIIASSDLDEYTIRDLLTQGAEIDAWGVGTRLITSEDCPSLGCVYKLVAQQFGDRMEPRIKISENPNKITNPGKKKVLRLYVNGSATADLIALDEEVYDPSEPLELFHPIHTYKRKVVQNYEMEELLRPVFVGGELVYELPTVQEIQARVETQLSAFSSEVRRHLNPHEYHVDLSKPLWDLKQRLLHEWRR

SEQ ID NO: 2852 - DNA, 2427 bp, Artificial
  Alicyclobacillus acidocaldarius mutated SEQ ID NO 2841
gtgactcatggtggaggcgtcttacgttttgctcgcctcagccgcgtttcgagcagctcgcgcggcgggcgatcacatgatcaagcgctatcggaccgagttggtggtggagaccaaatcgtcgctggcggacgtggtgaccgacgtcgatcgcgcctgcgaggaggccatccgccgcacactctccgacgcgtttcctcatcatcgcgttctgggcgaagagggcgtccggcccgggcgggaagcggcggtcgaagccctggcgaattgcctcgactgcacggatctctggattgtcgatccgctggacggcaccacgaactttgtccatcagctgccgctcagcgtcgtctccatcgcgtacgcgagcggcggcgaggtgaacttcggcgtcgtcctggatccctatcggggcgagtggttctacgcgctccgcgggcaaggcgcgtatgccgcgggcgatcacgacgtccgcgcgtggctcgccgcgccgtccgaggattggccgggcaagcgcatgcgcgtgtccggggtgtgcgaattgcggcgcgcggtcatggccacggggctccccgtccggcaccgcgatcgaaagcgcgtgatgcaaagagctacggacgtgatcgccgaggtgaagagcctgcgaacgctcggcgcggccgcgctgcacctggcttacgtggccgccgggcgcatcgacgtcttctgggaattcgatctcaacgcctgggacatcgccgcgggggcgcttttggtccaggaagcaggcggcgtcatccagtcgatgcaaggcgaaccctattcgctccgcgtgcgggacgtgtgcgcgggatccgatggcgagatgctccgggcgctcggggcgcgtcttgcagccgaatgagcaaggccatcagtcgagccaaggatggggatgaggggatggatatcaaggagcgcgcgagggcgcgcgtcgaagagataggagcgttgccggtgtaccgcgatcgccatctgacgctgctcacggacctgtatcaattgacgatgatgtacggccactttcgtgccggccgccacgagacccgcgtggtgtttgacctgttctaccggaagaatccttgcggcaacggctacgtgatcgcggccggactggaacaggtggtgtggtacatctacaacctcgcgttttcggaggacgatctcgcctatctgcggtcgctcgggatgttctccgaggactttctctcctatctgcgccatttcaggtttcgcggagatgtctacgcggtgcccgagggcacggtggtgtttccgaacgagccgatcctgcgcgtggaggggcccatcgcggaggttcaattgattgagtcggcggtgctcgcgttcatcaatcatcagagcctcatcgcgacgaaggcgcggcggatcgtcgaggcggcgaggacgaacgtcaggcatcccgggagcaccgtgattgaaatggggctcaggcgatcgcagaacgcggacgcggccgtcttcggcgcgcgcgcggcgttcatcgggggctgcgtggcgacgagtaacgtgctggcggcacagtcctacaacatccctgtggcgggcacgcaggcgcacagttggatccagagcttccccagcgagtacgaggcgtttcaggcgtaccgcgccgcgttcccggacaacaccgtcttgctcgtcgacacgtacgacgtgctgaggagtggcgttccgaacgccatccgggtcggcctggagatgaaggcggcgggtcaatccctcaaggccattcgaattgacagcggcgatctcgcttatttgtccaagcgagcccgccagatgttgaacgacgcagggctcgcggacgtgcagatcttagcgtcgagcgatctcgacgagtacaccattcgcgatctgctgacgcaaggggccgagatcgacgcctggggcgtgggcacgcggctcatcacgagcgaagactgcccttcgctcggctgcgtgtacaagctcgtggcgcagcagtttggcgatcggatggagccgaggatcaagatctccgaaaaccccaacaagatcacgaacccgggcaagaagaaggtcctgcgcctgtacgtgaacggatcggccacggcggacctcatcgcgctcgacgaggaagtgtacgatccgtccgagccgctcgaactgtttcatccgattcatacgtacaagcgcaaagtggtgcagaactacgagatggaggagctgcttcgcccggtctttgtcggcggtgaactggtctacgagctgccgacggtgcaggagatccaggcgcgcgtggagacgcagctgtccgcgttctcgtcggaggtcaggcgacatctgaatccgcacgagtatcatgtggacctgtccaagccgctctgggatttgaagcagcggctgctgcacgaatggcggcggtag

SEQ ID NO: 2853 - DNA, 2427 bp, Artificial
  Alicyclobacillus acidocaldarius mutated SEQ ID NO 2841
gtgactcatggtggaggcgtcttacgttttgctcgcctcagccgcgtttcgagcagctcgcgcggcgggcgatcacatgatcaagcgctatcggaccgagttggtggtggagaccaaatcgtcgctggcggacgtggtgaccgacgtcgatcgcgcctgcgaggaggccatccgccgcacactctccgacgcgtttcctcatcatcgcgttctgggcgaagagggcgtccggcccgggcgggaagcggcggtcgaagccctggcgaattgcctcgactgcacggatctctggattgtcgatccgctggacggcaccacgaactttgtccatcagctgccgctcagcgtcgtctccatcgcgtacgcgagcggcggcgaggtgaacttcggcgtcgtcctggatccctatcggggcgagtggttctacgcgctccgcgggcaaggcgcgtatgccgcgggcgatcacgacgtccgcgcgtggctcgccgcgccgtccgaggattggccgggcaagcgcatgcgcgtgtccggggtgtgcgaattgcggcgcgcggtcatggccacggggctccccgtccggcaccgcgatcgaaagcgcgtgatgcaaagagctacggacgtgatcgccgaggtgaagagcctgcgaacgctcggcgcggccgcgctgcacctggcttacgtggccgccgggcgcatcgacgtcttctgggaattcgatctcaacgcctgggacatcgccgcgggggcgcttttggtccaggaagcaggcggcgtcatccagtcgatgcaaggcgaaccctattcgctccgcgtgcgggacgtgtgcgcgggatccgatggcgagatgctccgggcgctcggggcgcgtcttgcagccgaatgagcaaggccatcagtcgagccaaggatggggatgaggggatggatatcaaggatcgcgcgagggcgcgcgtcgaagagataggagcgttgccggtgtaccgcgatcgccatctgacgctgctcacggacctgtatcaattgacgatgatgtacggccactttcgtgccggccgccacgagacccgcgtggtgtttgacctgttctaccggaagaatccttgcggcaacggctacgtgatcgcggccggactggaacaggtggtgtggtacatctacaacctcgcgttttcggaggacgatctcgcctatctgcggtcgctcgggatgttctccgaggactttctctcctatctgcgccatttcaggtttcgcggagatgtctacgcggtgcccgagggcacggtggtgtttccgaacgagccgatcctgcgcgtggaggggcccatcgcggaggttcaattgattgagtcggcggtgctcgcgttcatcaatcatcagagcctcatcgcgacgaaggcgcggcggatcgtcgaggcggcgaggacgaacgtcaggcatcccgggagcaccgtgattgaaatggggctcaggcgatcgcagaacgcggacgcggccgtcttcggcgcgcgcgcggcgttcatcgggggctgcgtggcgacgagtaacgtgctggcggcacagtcctacaacatccctgtggcgggcacgcaggcgcacagttggatccagagcttccccagcgagtacgaggcgtttcaggcgtaccgcgccgcgttcccggacaacaccgtcttgctcgtcgacacgtacgacgtgctgaggagtggcgttccgaacgccatccgggtcggcctggagatgaaggcggcgggtcaatccctcaaggccattcgaattgacagcggcgatctcgcttatttgtccaagcgagcccgccagatgttgaacgacgcagggctcgcggacgtgcagatcatcgcgtcgagcgatctcgacgagtacaccattcgcgatctgctgacgcaaggggccgagatcgacgcctggggcgtgggcacgcggctcatcacgagcgaagactgcccttcgctcggctgcgtgtacaagctcgtggcgcagcagtttggcgatcggatggagccgaggatcaagatctccgaaaaccccaacaagatcacgaacccgggcaagaagaaggtcctgcgcctgtacgtgaacggatcggccacggcggacctcatcgcgctcgacgaggaagtgtacgatccgtccgagccgctcgaactgtttcatccgattcatacgtacaagcgcaaagtggtgcagaactacgagatggaggagctgcttcgcccggtctttgtcggcggtgaactggtctacgagctgccgacggtgcaggagatccaggcgcgcgtggagacgcagctgtccgcgttctcgtcggaggtcaggcgacatctgaatccgcacgagtatcatgtggacctgtccaagccgctctgggatttgaagcagcggctgctgcacgaatggcggcggtag

SEQ ID NO: 2854 - DNA, 2427 bp, Artificial
  Alicyclobacillus acidocaldarius mutated SEQ ID NO 2841
gtgactcatggtggaggcgtcttacgttttgctcgcctcagccgcgtttcgagcagctcgcgcggcgggcgatcacatgatcaagcgctatcggaccgagttggtggtggagaccaaatcgtcgctggcggacgtggtgaccgacgtcgatcgcgcctgcgaggaggccatccgccgcacactctccgacgcgtttcctcatcatcgcgttctgggcgaagagggcgtccggcccgggcgggaagcggcggtcgaagccctggcgaattgcctcgactgcacggatctctggattgtcgatccgctggacggcaccacgaactttgtccatcagctgccgctcagcgtcgtctccatcgcgtacgcgagcggcggcgaggtgaacttcggcgtcgtcctggatccctatcggggcgagtggttctacgcgctccgcgggcaaggcgcgtatgccgcgggcgatcacgacgtccgcgcgtggctcgccgcgccgtccgaggattggccgggcaagcgcatgcgcgtgtccggggtgtgcgaattgcggcgcgcggtcatggccacggggctccccgtccggcaccgcgatcgaaagcgcgtgatgcaaagagctacggacgtgatcgccgaggtgaagagcctgcgaacgctcggcgcggccgcgctgcacctggcttacgtggccgccgggcgcatcgacgtcttctgggaattcgatctcaacgcctgggacatcgccgcgggggcgcttttggtccaggaagcaggcggcgtcatccagtcgatgcaaggcgaaccctattcgctccgcgtgcgggacgtgtgcgcgggatccgatggcgagatgctccgggcgctcggggcgcgtcttgcagccgaatgagcaaggccatcagtcgagccaaggatggggatgaggggatggatatcaaggagcgcgcgagggcgcgcgtcgaagagataggagcgttgccggtgtaccgcgatcgccatctgacgctgctcacggacctgtatcaattgacgatgatgtacggccactttcgtgccggccgccacgagacccgcgtggtgtttgacctgttctaccggaagaatccttgcggcaacggctacgtgatcgcggccggactggaacaggtggtgtggtacatctacaacctcgcgttttcggaggacgatctcgcctatctgcggtcgctcgggatgttctccgaggactttctctcctatctgcgccatttcaggtttcgcggagatgtctacgcggtgcccgagggcacggtggtgtttccgaacgagccgatcctgcgcgtggaggggcccatcgcggaggttcaattgattgagtcggcggtgctcgcgttcatcaatcatcagagcctcatcgcgacgaaggcgcggcggatcgtcgaggcggcgaggacgaacgtcaggcatcccgggagcaccgtgattgaaatggggctcaggcgatcgcagaacgcggacgcggccgtcttcggcgcgcgcgcggcgttcatcgggggctgcgtggcgacgagtaacgtgctggcggcacagtcctacaacatccctgtggcgggcacgcaggcgcacagttggatccagagcttccccagcgagtacgaggcgtttcaggcgtaccgcgccgcgttcccggacaacaccgtcttgctcgtcgacacgtacgacgtgctgaggagtggcgttccgaacgccatccgggtcggcctggagatgaaggcggcgggtcaatccctcaaggccattcgaattgacagcggcgatctcgcttatttgtccaagcgagcccgccagatgttgaacgacgcagggctcgcggacgtgcagatcatcgcgtcgagcgatctcgacgagtacaccattcgcgatctgctgacgcaaggggccgagatcgacgcctggggcgtgggcacgcggctcatcacgagcgaagactgcccttcgctcggctgcgtgtacaagctcattgcgcagcagtttggcgatcggatggagccgaggatcaagatctccgaaaaccccaacaagatcacgaacccgggcaagaagaaggtcctgcgcctgtacgtgaacggatcggccacggcggacctcatcgcgctcgacgaggaagtgtacgatccgtccgagccgctcgaactgtttcatccgattcatacgtacaagcgcaaagtggtgcagaactacgagatggaggagctgcttcgcccggtctttgtcggcggtgaactggtctacgagctgccgacggtgcaggagatccaggcgcgcgtggagacgcagctgtccgcgttctcgtcggaggtcaggcgacatctgaatccgcacgagtatcatgtggacctgtccaagccgctctgggatttgaagcagcggctgctgcacgaatggcggcggtag

SEQ ID NO: 2855 - DNA, 2427 bp, Artificial
  Alicyclobacillus acidocaldarius mutated SEQ ID NO 2841
gtgactcatggtggaggcgtcttacgttttgctcgcctcagccgcgtttcgagcagctcgcgcggcgggcgatcacatgatcaagcgctatcggaccgagttggtggtggagaccaaatcgtcgctggcggacgtggtgaccgacgtcgatcgcgcctgcgaggaggccatccgccgcacactctccgacgcgtttcctcatcatcgcgttctgggcgaagagggcgtccggcccgggcgggaagcggcggtcgaagccctggcgaattgcctcgactgcacggatctctggattgtcgatccgctggacggcaccacgatctttgtccatcagctgccgctcagcgtcgtctccatcgcgtacgcgagcggcggcgaggtgaacttcggcgtcgtcctggatccctatcggggcgagtggttctacgcgctccgcgggcaaggcgcgtatgccgcgggcgatcacgacgtccgcgcgtggctcgccgcgccgtccgaggattggccgggcaagcgcatgcgcgtgtccggggtgtgcgaattgcggcgcgcggtcatggccacggggctccccgtccggcaccgcgatcgaaagcgcgtgatgcaaagagctacggacgtgatcgccgaggtgaagagcctgcgaacgctcggcgcggccgcgctgcacctggcttacgtggccgccgggcgcatcgacgtcttctgggaattcgatctcaacgcctgggacatcgccgcgggggcgcttttggtccaggaagcaggcggcgtcatccagtcgatgcaaggcgaaccctattcgctccgcgtgcgggacgtgtgcgcgggatccgatggcgagatgctccgggcgctcggggcgcgtcttgcagccgaatgagcaaggccatcagtcgagccaaggatggggatgaggggatggatatcaaggagcgcgcgagggcgcgcgtcgaagagataggagcgttgccggtgtaccgcgatcgccatctgacgctgctcacggacctgtatcaattgacgatgatgtacggccactttcgtgccggccgccacgagacccgcgtggtgtttgacctgttctaccggaagaatccttgcggcaacggctacgtgatcgcggccggactggaacaggtggtgtggtacatctacaacctcgcgttttcggaggacgatctcgcctatctgcggtcgctcgggatgttctccgaggactttctctcctatctgcgccatttcaggtttcgcggagatgtctacgcggtgcccgagggcacggtggtgtttccgaacgagccgatcctgcgcgtggaggggcccatcgcggaggttcaattgattgagtcggcggtgctcgcgttcatcaatcatcagagcctcatcgcgacgaaggcgcggcggatcgtcgaggcggcgaggacgaacgtcaggcatcccgggagcaccgtgattgaaatggggctcaggcgatcgcagaacgcggacgcggccgtcttcggcgcgcgcgcggcgttcatcgggggctgcgtggcgacgagtaacgtgctggcggcacagtcctacaacatccctgtggcgggcacgcaggcgcacagttggatccagagcttccccagcgagtacgaggcgtttcaggcgtaccgcgccgcgttcccggacaacaccgtcttgctcgtcgacacgtacgacgtgctgaggagtggcgttccgaacgccatccgggtcggcctggagatgaaggcggcgggtcaatccctcaaggccattcgaattgacagcggcgatctcgcttatttgtccaagcgagcccgccagatgttgaacgacgcagggctcgcggacgtgcagatcatcgcgtcgagcgatctcgacgagtacaccattcgcgatctgctgacgcaaggggccgagatcgacgcctggggcgtgggcacgcggctcatcacgagcgaagactgcccttcgctcggctgcgtgtacaagctcgtggcgcagcagtttggcgatcggatggagccgaggatcaagatctccgaaaaccccaacaagatcacgaacccgggcaagaagaaggtcctgcgcctgtacgtgaacggatcggccacggcggacctcatcgcgctcgacgaggaagtgtacgatccgtccgagccgctcgaactgtttcatccgattcatacgtacaagcgcaaagtggtgcagaactacgagatggaggagctgcttcgcccggtctttgtcggcggtgaactggtctacgagctgccgacggtgcaggagatccaggcgcgcgtggagacgcagctgtccgcgttctcgtcggaggtcaggcgacatctgaatccgcacgagtatcatgtggacctgtccaagccgctctgggatttgaagcagcggctgctgcacgaatggcggcggtag

SEQ ID NO: 2856 - DNA, 2427 bp, Artificial
  Alicyclobacillus acidocaldarius mutated SEQ ID NO 2841
gtgactcatggtggaggcgtcttacgttttgctcgcctcagccgcgtttcgagcagctcgcgcggcgggcgatcacatgatcaagcgctatcggaccgagttggtggtggagaccaaatcgtcgctggcggacgtggtgaccgacgtcgatcgcgcctgcgaggaggccatccgccgcacactctccgacgcgtttcctcatcatcgcgttctgggcgaagagggcgtccggcccgggcgggaagcggcggtcgaagccctggcgaattgcctcgactgcacggatctctggattgtcgatccgctggacggcaccacgaactttgtccatcagctgccgctcagcgtcgtctccatcgcgtacgcgagcggcggcgaggtgaacttcggcgtcgtcctggatccctatcggggcgagtggttctacgcgctccgcgggcaaggcgcgtatgccgcgggcgatcacgacgtccgcgcgtggctcgccgcgccgtccgaggattggccgggcaagcgcatgcgcgtgtccggggtgtgcgaattgcggcgcgcggtcatggccacggggctccccgtccggcaccgcgatcgaaagcgcgtgatgcaaagagctacggacgtgatcgccgaggtgaagagcctgcgaacgctcggcgcggccgcgctgcacctggcttacgtggccgccgggcgcatcgacgtcttctgggaattcgatctaatcgcctgggacatcgccgcgggggcgcttttggtccaggaagcaggcggcgtcatccagtcgatgcaaggcgaaccctattcgctccgcgtgcgggacgtgtgcgcgggatccgatggcgagatgctccgggcgctcggggcgcgtcttgcagccgaatgagcaaggccatcagtcgagccaaggatggggatgaggggatggatatcaaggagcgcgcgagggcgcgcgtcgaagagataggagcgttgccggtgtaccgcgatcgccatctgacgctgctcacggacctgtatcaattgacgatgatgtacggccactttcgtgccggccgccacgagacccgcgtggtgtttgacctgttctaccggaagaatccttgcggcaacggctacgtgatcgcggccggactggaacaggtggtgtggtacatctacaacctcgcgttttcggaggacgatctcgcctatctgcggtcgctcgggatgttctccgaggactttctctcctatctgcgccatttcaggtttcgcggagatgtctacgcggtgcccgagggcacggtggtgtttccgaacgagccgatcctgcgcgtggaggggcccatcgcggaggttcaattgattgagtcggcggtgctcgcgttcatcaatcatcagagcctcatcgcgacgaaggcgcggcggatcgtcgaggcggcgaggacgaacgtcaggcatcccgggagcaccgtgattgaaatggggctcaggcgatcgcagaacgcggacgcggccgtcttcggcgcgcgcgcggcgttcatcgggggctgcgtggcgacgagtaacgtgctggcggcacagtcctacaacatccctgtggcgggcacgcaggcgcacagttggatccagagcttccccagcgagtacgaggcgtttcaggcgtaccgcgccgcgttcccggacaacaccgtcttgctcgtcgacacgtacgacgtgctgaggagtggcgttccgaacgccatccgggtcggcctggagatgaaggcggcgggtcaatccctcaaggccattcgaattgacagcggcgatctcgcttatttgtccaagcgagcccgccagatgttgaacgacgcagggctcgcggacgtgcagatcatcgcgtcgagcgatctcgacgagtacaccattcgcgatctgctgacgcaaggggccgagatcgacgcctggggcgtgggcacgcggctcatcacgagcgaagactgcccttcgctcggctgcgtgtacaagctcgtggcgcagcagtttggcgatcggatggagccgaggatcaagatctccgaaaaccccaacaagatcacgaacccgggcaagaagaaggtcctgcgcctgtacgtgaacggatcggccacggcggacctcatcgcgctcgacgaggaagtgtacgatccgtccgagccgctcgaactgtttcatccgattcatacgtacaagcgcaaagtggtgcagaactacgagatggaggagctgcttcgcccggtctttgtcggcggtgaactggtctacgagctgccgacggtgcaggagatccaggcgcgcgtggagacgcagctgtccgcgttctcgtcggaggtcaggcgacatctgaatccgcacgagtatcatgtggacctgtccaagccgctctgggatttgaagcagcggctgctgcacgaatggcggcggtag

SEQ ID NO: 2857 - protein, 279 aa, Alicyclobacillus acidocaldarius
MARAVEEFVEGRMQMDGTRRPRVRIFAHRGASREAPENTLPAFQIALRQGADVIETDVHWTKDRELVICHDPRIDAVSDGTGAIADMTYEELLRYDFGYRFTRDGGRTYPYRGCGIRMATLREALRAFPGAHFNVDLKPKCPHVGLFLRMLEEEDSLERVTLASFHHRTLVEARARCPRLKTSASPFEVARLAAMARAGWERGGRARMPFQAVQVPLRQYGVRVVTPRFIEFAHRLGLEVDVWTVDDPNVIRGLIRQGVDGIVTNSPQILQKLLLELEQ

SEQ ID NO: 2858 - DNA, 840 bp, Alicyclobacillus acidocaldarius
atggcgagagccgttgaagaattcgttgaagggcggatgcaaatggatgggacacggcgcccacgagttcggatcttcgcgcacaggggagcgagccgcgaggcgcctgagaacacgctgccagcgttccaaatcgcgctgcgccaaggggcagacgtgatcgagacggatgtccactggacgaaggaccgagaactggtcatctgtcacgatccacgcattgacgcggtttcggatggaacgggcgccatcgcggacatgacgtacgaggaactcttgcgttacgactttggatatcgattcacgcgcgacggagggagaacgtatccgtacaggggatgcgggattcgcatggcgacgctgcgcgaggcgctgcgcgcgtttccgggcgcccatttcaacgtggatttgaaaccgaagtgtcctcacgtcggtctatttctgcggatgctcgaggaagaagattcgcttgagcgcgtgacactggcttcctttcaccatcggacgctcgtggaggcccgggcgcgctgtcctcggctcaaaacgagcgcttcgcccttcgaggtggcgcgcttggcggccatggcgcgcgctggatgggagcgcgggggacgcgcgaggatgccatttcaggccgttcaggtgcctcttcgccaatacggcgttcgggtggtcacgccgcgtttcatcgagttcgctcaccgacttggattggaggtcgacgtgtggacggtggacgacccgaatgtgattcgaggtctcatccgacagggcgtcgacggcattgtcacaaattcgccgcagatcttgcaaaagctcctgctggaactggaacaataa

SEQ ID NO: 2859 - protein, 243 aa, Rubrobacter xylanophilus
FAHRGASARAPENTLEAFRLGVEAGAGGLEMDLHMTRDGEIVVIHDHTVDRTTDGSGAVREMSLRELRRLDAGYRFSPDGGRSHPYRGRGLRVPTLREVYEAFPRAAVNMEIKEPVPGIERRVLEVIDGAGARGRTLVAAFDHGIVRRFREASGGEVATSASRLEVVAFYALVRLGLWRFARPGYAALQIPVRRRGIELITPSLVAAAHALGVRVDAWTINEPEEMRRLLGLGVDVVMTDRPE

SEQ ID NO: 2860 - protein, 242 aa, Deinococcus geothermalis
AHQGGEERWPSNTMLAYRNAAALGVDMLDTDLHATRDGALVLSHDETLDRLTDTQGRIADMTLAQVLAADAGYAFTPDGGKTFPFRGQGVRVAQLAEVLAAFPNMPLTIEIKQTSPSLAAPFCKALRDAGVTDHVIVASFSDKALNEFRAACPEVITSMTEKELRPLVLLSKVGLAHLAPLPGRAAQVPVRSGNIEVVTPAFVRAMHARGVAVHVWTINDPAEMRRLIAMGVDGIITDRPDL

SEQ ID NO: 2861 - protein, 251 aa, Symbiobacterium thermophilum
PRPVVLAHQGASGHAPSNTMEAFRLALEQGADILELDVHMTRDGVVVVSHDETIDRMSDGTGLIKEMTLAELRRYDFGYRFTPDGGLTYPYRGKGVTIPTLEEVLQAFPEVPVNIEIKQADPPMEAQLWELIQRYGAEDRVLVASFHGTVAKRWRDLAGDRVATSAPVEHMYLVAAHYLSHLDRLYAPAHDAFQVPVAQKAGPLTVRFDTERFLRMAERVNVAVHYWTINDEDEMRRLYQLGAHGIITDYP

SEQ ID NO: 2862 - protein, 242 aa, Deinococcus radiodurans
AHQGGEALWPSNTLTAYRGAVALGVDLLEMDLHATRDGALVLSHDATLDRLTDTQGRIADLTLEQVLRADAGYTLTPAGGSGFPFRGQGVQVAQLKDVLREFPNTPLIIELKQASPSIAAPFCAELRRAGATGRVIAASFSDAALNEFRRLCPEVMTSMTERELRPLVLLSKVGLSALAPTPGQVAQVPVRSGGIEIVTPAFVRALHARGVAVQVWTIDDEAEMRRLVQMGVDGVITNRPDL

SEQ ID NO: 2863 - protein, 250 aa, Pelobacter carbinolicus
PRPRLFGHRGNSGDFPENTLPAFSDALACGTPYLELDVRATKDDEVVVIHDESLLRTCGIDRPVAGLTFAELQNYDAGATFTPDQGRSYPHRGCGIRVPLLADVLQAFPRALFNIEIKQETPAMETATLEVIRRADMTEQVLLAAENDAVMARLRPLCQTAGIPTSFSYGELVSFFTWLQAGGQSPYHPPAQALQIPETYEGQTLVTPQSIAAAHTLGIEIHVWTVNQAQDMERLLRMGVDGVMSDRPAV

SEQ ID NO: 2864 - protein, 279 aa, Artificial
  Alicyclobacillus acidocaldarius mutated SEQ ID NO 2857
MARAVEEFVEGRMQMDGTRRPRVRIFAHRGASREAPENTLPAFQLALRQGADVIETDVHWTKDRELVICHDPRIDAVSDGTGAIADMTYEELLRYDFGYRFTRDGGRTYPYRGCGIRMATLREALRAFPGAHFNVDLKPKCPHVGLFLRMLEEEDSLERVTLASFHHRTLVEARARCPRLKTSASPFEVARLAAMARAGWERGGRARMPFQAVQVPLRQYGVRVVTPRFIEFAHRLGLEVDVWTVDDPNVIRGLIRQGVDGIVTNSPQILQKLLLELEQ

SEQ ID NO: 2865 - protein, 279 aa, Artificial
  Alicyclobacillus acidocaldarius mutated SEQ ID NO 2857
MARAVEEFVEGRMQMDGTRRPRVRIFAHRGASREAPENTLPAFQIALRQGADVIETDVHWTKDRELVICHDPRIDAVSDGTGAIADMTYEELLRYDFGYRFTKDGGRTYPYRGCGIRMATLREALRAFPGAHFNVDLKPKCPHVGLFLRMLEEEDSLERVTLASFHHRTLVEARARCPRLKTSASPFEVARLAAMARAGWERGGRARMPFQAVQVPLRQYGVRVVTPRFIEFAHRLGLEVDVWTVDDPNVIRGLIRQGVDGIVTNSPQILQKLLLELEQ

SEQ ID NO: 2866 - protein, 279 aa, Artificial
  Alicyclobacillus acidocaldarius mutated SEQ ID NO 2857
MARAVEEFVEGRMQMDGTRRPRVRIFAHRGASREAPENTLPAFQIALKQGADVIETDVHWTKDRELVICHDPRIDAVSDGTGAIADMTYEELLRYDFGYRFTRDGGRTYPYRGCGIRMATLREALRAFPGAHFNVDLKPKCPHVGLFLRMLEEEDSLERVTLASFHHRTLVEARARCPRLKTSASPFEVARLAAMARAGWERGGRARMPFQAVQVPLRQYGVRVVTPRFIEFAHRLGLEVDVWTVDDPNVIRGLIRQGVDGIVTNSPQILQKLLLELEQ

SEQ ID NO: 2867 - protein, 279 aa, Artificial
  Alicyclobacillus acidocaldarius mutated SEQ ID NO 2857
MARAVEEFVEGRMQMDGTRRPRVRIFAHRGASREAPENTLPAFQIALRQGADVIETDVHWTKDRELVICHDPRIDAVSDGTGAIADMTYEELLRYDFGYRFTRDGGRTYPYRGCGIRMATLREALRAFPGAHFNVDLKPKCPHVGLFLRMLEEEDSLERVTLASFHHRTLVEARARCPRLKTSASPFEVARLAAMARAGWERGGRARMPFQAIQVPLRQYGVRVVTPRFIEFAHRLGLEVDVWTVDDPNVIRGLIRQGVDGIVTNSPQILQKLLLELEQ

SEQ ID NO: 2868 - protein, 279 aa, Artificial
  Alicyclobacillus acidocaldarius mutated SEQ ID NO 2857
MAKAVEEFVEGRMQMDGTRRPRVRIFAHRGASREAPENTLPAFQIALRQGADVIETDVHWTKDRELVICHDPRIDAVSDGTGAIADMTYEELLRYDFGYRFTRDGGRTYPYRGCGIRMATLREALRAFPGAHFNVDLKPKCPHVGLFLRMLEEEDSLERVTLASFHHRTLVEARARCPRLKTSASPFEVARLAAMARAGWERGGRARMPFQAVQVPLRQYGVRVVTPRFIEFAHRLGLEVDVWTVDDPNVIRGLIRQGVDGIVTNSPQILQKLLLELEQ

SEQ ID NO: 2869 - DNA, 840 bp, Artificial
  Alicyclobacillus acidocaldarius mutated SEQ ID NO 2858
atggcgagagccgttgaagaattcgttgaagggcggatgcaaatggatgggacacggcgcccacgagttcggatcttcgcgcacaggggagcgagccgcgaggcgcctgagaacacgctgccagcgttccaattagcgctgcgccaaggggcagacgtgatcgagacggatgtccactggacgaaggaccgagaactggtcatctgtcacgatccacgcattgacgcggtttcggatggaacgggcgccatcgcggacatgacgtacgaggaactcttgcgttacgactttggatatcgattcacgcgcgacggagggagaacgtatccgtacaggggatgcgggattcgcatggcgacgctgcgcgaggcgctgcgcgcgtttccgggcgcccatttcaacgtggatttgaaaccgaagtgtcctcacgtcggtctatttctgcggatgctcgaggaagaagattcgcttgagcgcgtgacactggcttcctttcaccatcggacgctcgtggaggcccgggcgcgctgtcctcggctcaaaacgagcgcttcgcccttcgaggtggcgcgcttggcggccatggcgcgcgctggatgggagcgcgggggacgcgcgaggatgccatttcaggccgttcaggtgcctcttcgccaatacggcgttcgggtggtcacgccgcgtttcatcgagttcgctcaccgacttggattggaggtcgacgtgtggacggtggacgacccgaatgtgattcgaggtctcatccgacagggcgtcgacggcattgtcacaaattcgccgcagatcttgcaaaagctcctgctggaactggaacaataa

SEQ ID NO: 2870 - DNA, 840 bp, Artificial
  Alicyclobacillus acidocaldarius mutated SEQ ID NO 2858
atggcgagagccgttgaagaattcgttgaagggcggatgcaaatggatgggacacggcgcccacgagttcggatcttcgcgcacaggggagcgagccgcgaggcgcctgagaacacgctgccagcgttccaaatcgcgctgcgccaaggggcagacgtgatcgagacggatgtccactggacgaaggaccgagaactggtcatctgtcacgatccacgcattgacgcggtttcggatggaacgggcgccatcgcggacatgacgtacgaggaactcttgcgttacgactttggatatcgattcacgaaagacggagggagaacgtatccgtacaggggatgcgggattcgcatggcgacgctgcgcgaggcgctgcgcgcgtttccgggcgcccatttcaacgtggatttgaaaccgaagtgtcctcacgtcggtctatttctgcggatgctcgaggaagaagattcgcttgagcgcgtgacactggcttcctttcaccatcggacgctcgtggaggcccgggcgcgctgtcctcggctcaaaacgagcgcttcgcccttcgaggtggcgcgcttggcggccatggcgcgcgctggatgggagcgcgggggacgcgcgaggatgccatttcaggccgttcaggtgcctcttcgccaatacggcgttcgggtggtcacgccgcgtttcatcgagttcgctcaccgacttggattggaggtcgacgtgtggacggtggacgacccgaatgtgattcgaggtctcatccgacagggcgtcgacggcattgtcacaaattcgccgcagatcttgcaaaagctcctgctggaactggaacaataa

SEQ ID NO: 2871 - DNA, 840 bp, Artificial
  Alicyclobacillus acidocaldarius mutated SEQ ID NO 2858
atggcgagagccgttgaagaattcgttgaagggcggatgcaaatggatgggacacggcgcccacgagttcggatcttcgcgcacaggggagcgagccgcgaggcgcctgagaacacgctgccagcgttccaaatcgcgctgaaacaaggggcagacgtgatcgagacggatgtccactggacgaaggaccgagaactggtcatctgtcacgatccacgcattgacgcggtttcggatggaacgggcgccatcgcggacatgacgtacgaggaactcttgcgttacgactttggatatcgattcacgcgcgacggagggagaacgtatccgtacaggggatgcgggattcgcatggcgacgctgcgcgaggcgctgcgcgcgtttccgggcgcccatttcaacgtggatttgaaaccgaagtgtcctcacgtcggtctatttctgcggatgctcgaggaagaagattcgcttgagcgcgtgacactggcttcctttcaccatcggacgctcgtggaggcccgggcgcgctgtcctcggctcaaaacgagcgcttcgcccttcgaggtggcgcgcttggcggccatggcgcgcgctggatgggagcgcgggggacgcgcgaggatgccatttcaggccgttcaggtgcctcttcgccaatacggcgttcgggtggtcacgccgcgtttcatcgagttcgctcaccgacttggattggaggtcgacgtgtggacggtggacgacccgaatgtgattcgaggtctcatccgacagggcgtcgacggcattgtcacaaattcgccgcagatcttgcaaaagctcctgctggaactggaacaataa

SEQ ID NO: 2872 - DNA, 840 bp, Artificial
  Alicyclobacillus acidocaldarius mutated SEQ ID NO 2858
atggcgagagccgttgaagaattcgttgaagggcggatgcaaatggatgggacacggcgcccacgagttcggatcttcgcgcacaggggagcgagccgcgaggcgcctgagaacacgctgccagcgttccaaatcgcgctgcgccaaggggcagacgtgatcgagacggatgtccactggacgaaggaccgagaactggtcatctgtcacgatccacgcattgacgcggtttcggatggaacgggcgccatcgcggacatgacgtacgaggaactcttgcgttacgactttggatatcgattcacgcgcgacggagggagaacgtatccgtacaggggatgcgggattcgcatggcgacgctgcgcgaggcgctgcgcgcgtttccgggcgcccatttcaacgtggatttgaaaccgaagtgtcctcacgtcggtctatttctgcggatgctcgaggaagaagattcgcttgagcgcgtgacactggcttcctttcaccatcggacgctcgtggaggcccgggcgcgctgtcctcggctcaaaacgagcgcttcgcccttcgaggtggcgcgcttggcggccatggcgcgcgctggatgggagcgcgggggacgcgcgaggatgccatttcaggccattcaggtgcctcttcgccaatacggcgttcgggtggtcacgccgcgtttcatcgagttcgctcaccgacttggattggaggtcgacgtgtggacggtggacgacccgaatgtgattcgaggtctcatccgacagggcgtcgacggcattgtcacaaattcgccgcagatcttgcaaaagctcctgctggaactggaacaataa

SEQ ID NO: 2873 - DNA, 840 bp, Artificial
  Alicyclobacillus acidocaldarius mutated SEQ ID NO 2858
atggcgaaagccgttgaagaattcgttgaagggcggatgcaaatggatgggacacggcgcccacgagttcggatcttcgcgcacaggggagcgagccgcgaggcgcctgagaacacgctgccagcgttccaaatcgcgctgcgccaaggggcagacgtgatcgagacggatgtccactggacgaaggaccgagaactggtcatctgtcacgatccacgcattgacgcggtttcggatggaacgggcgccatcgcggacatgacgtacgaggaactcttgcgttacgactttggatatcgattcacgcgcgacggagggagaacgtatccgtacaggggatgcgggattcgcatggcgacgctgcgcgaggcgctgcgcgcgtttccgggcgcccatttcaacgtggatttgaaaccgaagtgtcctcacgtcggtctatttctgcggatgctcgaggaagaagattcgcttgagcgcgtgacactggcttcctttcaccatcggacgctcgtggaggcccgggcgcgctgtcctcggctcaaaacgagcgcttcgcccttcgaggtggcgcgcttggcggccatggcgcgcgctggatgggagcgcgggggacgcgcgaggatgccatttcaggccgttcaggtgcctcttcgccaatacggcgttcgggtggtcacgccgcgtttcatcgagttcgctcaccgacttggattggaggtcgacgtgtggacggtggacgacccgaatgtgattcgaggtctcatccgacagggcgtcgacggcattgtcacaaattcgccgcagatcttgcaaaagctcctgctggaactggaacaataa

SEQ ID NO: 2874 - protein, 444 aa, Alicyclobacillus acidocaldarius
MRHYAFRRMLTMWTRWMAIETVLFRKQLVGFEGNRHDLKNSYSGERSVRMRSVELFVGAGGLAMGISNAGFRHVGLYEWDRYACDTIRFNKERNVGPVRDWPIYQLDVRSVDFTQYRGIELLAGGPPCQPFSLGGKHRGREDHRNMFPEMIRAVREIQPKVVLIENVKGLLRESFAKYFEYILLQICYPEIVPKENEDWTDHLSRLEQQHTKGRYHGLSYRVVFRLLNAADYGVPQKRERVFIVGFRSDLNIEWSFPNPTHSFDALLYDQWVTGEYWERHRVAKKHRPDIPDKLKKRIESLRMGLRLIQGAPWVTVRDAISGLPDPESEQDCGVPNHRFNPGARVYPGHTGSPLDEPAKTLKAGDHGVPGGENMLVKPDGTVRYFTVRESARLQTFPDEYVFSGSWTESMRQLGNAVPVRLAHFITKDIRTRLEWSVADAGKAV

SEQ ID NO: 2875 - DNA, 1335 bp, Alicyclobacillus acidocaldarius
ttgcgtcattacgcgtttcgacgaatgttgaccatgtggacaaggtggatggcgatcgagacggttttgtttcgtaaacagcttgttggttttgaaggaaatcgtcatgatttgaagaactcatactccggagagaggagtgttcgcatgaggtcggttgaactgttcgttggagccggcggtcttgcgatggggatatcaaacgccgggtttcggcacgtgggattatacgaatgggatcgatacgcgtgcgacaccatacgtttcaataaggaaagaaacgtggggccggtccgagattggccgatttatcaacttgacgtgcgaagtgtcgatttcactcaatatcgcggtattgaacttctcgcaggaggccccccatgtcagccgttttcattgggaggcaaacatcgtggacgcgaggatcaccggaatatgttccccgaaatgattagggcggtcagggagatccagccgaaggtcgtcttgatcgaaaacgtgaaaggattactgcgggagtccttcgcgaaatacttcgagtacatacttcttcaaatctgttatcccgaaatcgttcctaaggaaaacgaggattggacggatcacttgtctcgtttggaacagcaacacaccaaaggtcgctaccacggcctttcttatcgtgtggtgttccgcttgcttaacgctgcggattacggtgtacctcaaaaaagggaacgggtgtttattgtcggcttccgaagtgatttgaacatcgaatggtcgtttcccaatccaacgcattctttcgacgcccttctttacgatcaatgggttacgggggaatattgggaacggcaccgggttgcgaaaaaacatcgtcctgacattcccgacaaactcaaaaagagaatcgaaagtcttcggatgggactaagactaatacagggcgctccgtgggttactgtgcgcgacgccatttccggtcttcccgatccggaaagcgaacaagactgcggcgtacccaaccatcgttttaatcccggagcccgagtttatccgggacacaccggaagtccgctcgatgagcctgcgaaaaccctaaaagccggggatcacggcgttcccggcggagagaacatgcttgtgaaaccggatggcaccgtacgttatttcacggtgcgggagagcgcgcgcttgcagacgttcccggacgagtacgtgtttagcgggtcttggacggagagcatgcgccaattggggaacgcagttccggtacggttggctcatttcatcactaaagacatcagaacacgtcttgaatggagtgtcgctgatgcaggaaaagccgtataa

SEQ ID NO: 2876 - protein, 383 aa, Roseovarius  217
MRSVELFVGAGGLGIGVSQAGFRPAAVMDWDRWACDTLRENKERGLDPIAHWPIHEGDIRQFDFGTVDGTVDLVTGGPPCQPFSMGGRHRAFLDGRDMFPQAIRAVRELRPRAFIFENVKGLTRSSFANYLEYIRLQLTYPDLVAKRDEEWLAHLARLEDHHTKGTEKGLRYRVVMRVLNSANYGVPQRRERVFLVGFRADTGIEWHFPKPTHSRDALLWSQWRDEVYWDLHRVARKNRPEGGAAKARSLKIADRPLDEPWLTVRDAISDLPDPEHAPGTARGFHDHRFQPGARSYAGHTGSPLDEPAKTLKAGVHGVPGGENMLRRPDGSVRYFTIRESARLQTFPDDMVFHGSWTETMRQLGNAVPCQLARIVASGVRHKL

SEQ ID NO: 2877 - protein, 382 aa, Citrobacter freundii
MKSVELFAGAGGLAMGCEIAGFEHLAVVEWDKWACDTVRENKKSGFPLLSDWDLFEGDVREFDWSKIPKGIDLLAGGPPCQPFSIGGKHKANSDSRDMFPATAEAIRQIRPKAFIVENVKGLTRATFATYFQYIQLQLEFPEVAPRNGEDWSEHLKRLQEEKTSGKNKGRGLTYNVLATLVNAADYGIPQKRERVFIVGFRDDLEIEWSFPKPTHSYDALIYDQWVTGDYWKRHGLEMPTVPSQMVSRIAKLRKNPPDTLPWKTVRDAIADLPDPETKAAKMIRNHGFQAGARTYPGHTGSPLDLPAKTLKAGAHGVPGGENMLVRDDGSVRYFTVRESARIQTFPDSYRFHGSWTETMRQLGNAVPVHLAYCVASSVAEKL

SEQ ID NO: 2878 - protein, 389 aa, Rhizobium leguminosarum
MRAIELFAGAGGLGMGVSRAGFTPQAVVEWDRWCCDTIRENREKGIASLAGWPMPIEGDVRGVNFRGFEGKLDLVTGGPPCQPFSLGGKHQAHADRRDMWPEAVRAVRETRPRAFIFENVKGLTRESFATYVSHIVLQMTYPDIVAKSEEGWEGHLQRLERHHTSRRRVTGLEYRVVYRVLNAANHGVPQRRERVVFVGFRSDLDIKWAFPAETHSLDALLWDQVHGDYWDRHRVRKADRNIGDRYRQRAARLGQQPDTLPWRTTRDAIADLPDPEREPKQSMTYLNHRFQPGARSYPGHTGSPLDEPAKTLKAGVHGVPGGENMLLRPDGSVRYFTVRESARLQTFPDDFRLHGSWSEAMRQLGNAVPVELAHVVASSVNAHLQFKAS

SEQ ID NO: 2879 - protein, 365 aa, Neisseria gonorrhoeae
MKSLEIFSGAGGLAKGLELAGFQHASFIELNKDACNSLRSNFNPKLVYQGDVADFDLSSQEGIEVIAGGPPCQPFSLGGKHLAHEDRRDMFPHAVRYVEYYRPKAFIFENVKGLLRKSFADYFEYILLRLTYPNLGILQNEDWKGHLTRLKEIEFNLYKGIKYKVSYQLLNAADYGVPQKRERVVIVGIRADLDIDWKFPKRTHSEDRLNWEKYVTGEYWEKHNEPKRFNKDIAEKLQKKYGIFEPEKKPWQTVRDTLSDIPHPLGNHKITGHEYRDGARIYPGHTGSGIDEPSKTIKAGGHGVPGGENMIRYDDGTVRYFTSYEAKLLQTFPEEFVISGAWGEAMRQIGNAVPVKLSEILGKHL

SEQ ID NO: 2880 - protein, 375 aa, Acaryochloris marina
KLSCLELFTGAGGLAKGLEKAGVQHTAFVEWNKDACITLANNYSAQLVHNVDIRTFKFSQFGHVDIVSGGPPCQPFSMGGKHKGNMDKRDMFPYACKAISVCTPKAFVFENVKGLLRKSFSSYFEYILLRLRYPDLSLQASERWEDHLARLEKIHTSGKYDGIKYNVVFRLVDAANYGVPQRRERVFIVGIREDLNIEWSFPEESHSLDSLLWSQFITGAYWIRNAVNPLEIEHLDQRTQQRAKQLMQQPSLFSPSLEPWKTVRDQIGKLPAPDIQGSFDNEHVLREGARSYPGHTGSYIDMPSKALKAGDHGVPGGENMIRYQDGRIRYYTTFEAKRIQTFPDNYRISGSWTEAMRQIGNAVPVELGYRIANSL

SEQ ID NO: 2881 - protein, 444 aa, Artificial
  Alicyclobacillus acidocaldarius mutated SEQ ID NO 2874
MRHYAFRRMITMWTRWMAIETVLFRKQLVGFEGNRHDLKNSYSGERSVRMRSVELFVGAGGLAMGISNAGFRHVGLYEWDRYACDTIRFNKERNVGPVRDWPIYQLDVRSVDFTQYRGIELLAGGPPCQPFSLGGKHRGREDHRNMFPEMIRAVREIQPKVVLIENVKGLLRESFAKYFEYILLQICYPEIVPKENEDWTDHLSRLEQQHTKGRYHGLSYRVVFRLLNAADYGVPQKRERVFIVGFRSDLNIEWSFPNPTHSFDALLYDQWVTGEYWERHRVAKKHRPDIPDKLKKRIESLRMGLRLIQGAPWVTVRDAISGLPDPESEQDCGVPNHRFNPGARVYPGHTGSPLDEPAKTLKAGDHGVPGGENMLVKPDGTVRYFTVRESARLQTFPDEYVFSGSWTESMRQLGNAVPVRLAHFITKDIRTRLEWSVADAGKAV

SEQ ID NO: 2882 - protein, 444 aa, Artificial
  Alicyclobacillus acidocaldarius mutated SEQ ID NO 2874
MRHYAFRRMLTMWTRWMAIETVLFRKQLVGFEGNRHDLKNSYSGERSVRMRSVELFVGAGGLAMGISNAGFRHVGLYEWDRYACDTIRFNKERNVGPVRDWPIYQLDVRSVDFTQYRGIELLAGGPPCQPFSLGGKHRGREDHRNMFPEMIRAVREIQPKVVLIENVKGLLRESFAKYFEYILLQICYPEIVPKENEDWTDHLSRLEQQHTKGRYHGLSYRVVFRLLNAADYGVPQKRERVFIVGFRSDLNIEWSFPNPTHSFDALLYDQWVTGEYWEKHRVAKKHRPDIPDKLKKRIESLRMGLRLIQGAPWVTVRDAISGLPDPESEQDCGVPNHRFNPGARVYPGHTGSPLDEPAKTLKAGDHGVPGGENMLVKPDGTVRYFTVRESARLQTFPDEYVFSGSWTESMRQLGNAVPVRLAHFITKDIRTRLEWSVADAGKAV

SEQ ID NO: 2883 - protein, 444 aa, Artificial
  Alicyclobacillus acidocaldarius mutated SEQ ID NO 2874
MRHYAFRRMLTMWTRWMAIETVLFRKQLVGFEGNRHDLKNSYSGERSVRMRSVELFVGAGGLAMGISNAGFRHVGLYEWDRYACDTIRFNKERNVGPVRDWPIYQLDVRSVDFTQYRGIELLAGGPPCQPFSLGGKHRGREDHRNMFPEMIRAVREIQPKVVLIENVKGLLRESFAKYFEYILLQICYPEIVPKENEDWTDHLSRLEQQHTKGRYHGLSYRVVFRLLNAADYGVPQKRERVFIVGFRSDLNIEWSFPNPTHSFDALLYDQWVTGEYWERHRVAKKHRPDIPDKLKKRIESLRMGLRLINGAPWVTVRDAISGLPDPESEQDCGVPNHRFNPGARVYPGHTGSPLDEPAKTLKAGDHGVPGGENMLVKPDGTVRYFTVRESARLQTFPDEYVFSGSWTESMRQLGNAVPVRLAHFITKDIRTRLEWSVADAGKAV

SEQ ID NO: 2884 - protein, 444 aa, Artificial
  Alicyclobacillus acidocaldarius mutated SEQ ID NO 2874
MRHYAFRRMLTMWTRWMAIETVLFRKQLVGFEGNRHDLKNSYSGERSVRMRSVELFVGAGGLAMGISNAGFRHVGLYEWDRYACDTIRFNKERNVGPVRDWPIYQLDVRSVDFTQYRGIELLAGGPPCQPFSLGGKHRGREDHRNMFPEMIRAVREIQPKVVLIENVKGLLRESFAKYFEYILLQICYPEIVPKENEDWTDHLSRLEQQHTKGRYHGLSYRVVFRLLNAADYGVPQKRERVFIVGFRSDLNIEWSFPNPTHSFDALLYDQWVTGEYWERHRVAKKHRPDIPDKLKKRIESLRMGLRIIQGAPWVTVRDAISGLPDPESEQDCGVPNHRFNPGARVYPGHTGSPLDEPAKTLKAGDHGVPGGENMLVKPDGTVRYFTVRESARLQTFPDEYVFSGSWTESMRQLGNAVPVRLAHFITKDIRTRLEWSVADAGKAV

SEQ ID NO: 2885 - protein, 444 aa, Artificial
  Alicyclobacillus acidocaldarius mutated SEQ ID NO 2874
MRHYAFRRMLTMWTRWMAIETVLFRKQLVGFEGNRHDLKNSYSGERSVRMRSVELFVGAGGLAMGISNAGFRHVGLYEWDRYACDTIRFNKERNVGPVRDWPIYQLDVRSVDFTQYRGIELLAGGPPCQPFSLGGKHRGREDHRNMFPEMIRAVREIQPKVVLIENVKGLLRESFAKYFEYILLQICYPEIVPKENEDWTDHLSRLEQQHTKGRYHGLSYRVVFRLLNAADYGVPQKRERVFIVGFRSDLNIEWSFPNPTHSFDALLYDQWVTGEYWERHRVAKRHRPDIPDKLKKRIESLRMGLRLIQGAPWVTVRDAISGLPDPESEQDCGVPNHRFNPGARVYPGHTGSPLDEPAKTLKAGDHGVPGGENMLVKPDGTVRYFTVRESARLQTFPDEYVFSGSWTESMRQLGNAVPVRLAHFITKDIRTRLEWSVADAGKAV

SEQ ID NO: 2886 - DNA, 1335 bp, Artificial
  Alicyclobacillus acidocaldarius mutated SEQ ID NO 2875
ttgcgtcattacgcgtttcgacgaatgattaccatgtggacaaggtggatggcgatcgagacggttttgtttcgtaaacagcttgttggttttgaaggaaatcgtcatgatttgaagaactcatactccggagagaggagtgttcgcatgaggtcggttgaactgttcgttggagccggcggtcttgcgatggggatatcaaacgccgggtttcggcacgtgggattatacgaatgggatcgatacgcgtgcgacaccatacgtttcaataaggaaagaaacgtggggccggtccgagattggccgatttatcaacttgacgtgcgaagtgtcgatttcactcaatatcgcggtattgaacttctcgcaggaggccccccatgtcagccgttttcattgggaggcaaacatcgtggacgcgaggatcaccggaatatgttccccgaaatgattagggcggtcagggagatccagccgaaggtcgtcttgatcgaaaacgtgaaaggattactgcgggagtccttcgcgaaatacttcgagtacatacttcttcaaatctgttatcccgaaatcgttcctaaggaaaacgaggattggacggatcacttgtctcgtttggaacagcaacacaccaaaggtcgctaccacggcctttcttatcgtgtggtgttccgcttgcttaacgctgcggattacggtgtacctcaaaaaagggaacgggtgtttattgtcggcttccgaagtgatttgaacatcgaatggtcgtttcccaatccaacgcattctttcgacgcccttctttacgatcaatgggttacgggggaatattgggaacggcaccgggttgcgaaaaaacatcgtcctgacattcccgacaaactcaaaaagagaatcgaaagtcttcggatgggactaagactaatacagggcgctccgtgggttactgtgcgcgacgccatttccggtcttcccgatccggaaagcgaacaagactgcggcgtacccaaccatcgttttaatcccggagcccgagtttatccgggacacaccggaagtccgctcgatgagcctgcgaaaaccctaaaagccggggatcacggcgttcccggcggagagaacatgcttgtgaaaccggatggcaccgtacgttatttcacggtgcgggagagcgcgcgcttgcagacgttcccggacgagtacgtgtttagcgggtcttggacggagagcatgcgccaattggggaacgcagttccggtacggttggctcatttcatcactaaagacatcagaacacgtcttgaatggagtgtcgctgatgcaggaaaagccgtataa

SEQ ID NO: 2887 - DNA, 1335 bp, Artificial
  Alicyclobacillus acidocaldarius mutated SEQ ID NO 2875
ttgcgtcattacgcgtttcgacgaatgttgaccatgtggacaaggtggatggcgatcgagacggttttgtttcgtaaacagcttgttggttttgaaggaaatcgtcatgatttgaagaactcatactccggagagaggagtgttcgcatgaggtcggttgaactgttcgttggagccggcggtcttgcgatggggatatcaaacgccgggtttcggcacgtgggattatacgaatgggatcgatacgcgtgcgacaccatacgtttcaataaggaaagaaacgtggggccggtccgagattggccgatttatcaacttgacgtgcgaagtgtcgatttcactcaatatcgcggtattgaacttctcgcaggaggccccccatgtcagccgttttcattgggaggcaaacatcgtggacgcgaggatcaccggaatatgttccccgaaatgattagggcggtcagggagatccagccgaaggtcgtcttgatcgaaaacgtgaaaggattactgcgggagtccttcgcgaaatacttcgagtacatacttcttcaaatctgttatcccgaaatcgttcctaaggaaaacgaggattggacggatcacttgtctcgtttggaacagcaacacaccaaaggtcgctaccacggcctttcttatcgtgtggtgttccgcttgcttaacgctgcggattacggtgtacctcaaaaaagggaacgggtgtttattgtcggcttccgaagtgatttgaacatcgaatggtcgtttcccaatccaacgcattctttcgacgcccttctttacgatcaatgggttacgggggaatattgggaaaaacaccgggttgcgaaaaaacatcgtcctgacattcccgacaaactcaaaaagagaatcgaaagtcttcggatgggactaagactaatacagggcgctccgtgggttactgtgcgcgacgccatttccggtcttcccgatccggaaagcgaacaagactgcggcgtacccaaccatcgttttaatcccggagcccgagtttatccgggacacaccggaagtccgctcgatgagcctgcgaaaaccctaaaagccggggatcacggcgttcccggcggagagaacatgcttgtgaaaccggatggcaccgtacgttatttcacggtgcgggagagcgcgcgcttgcagacgttcccggacgagtacgtgtttagcgggtcttggacggagagcatgcgccaattggggaacgcagttccggtacggttggctcatttcatcactaaagacatcagaacacgtcttgaatggagtgtcgctgatgcaggaaaagccgtataa

SEQ ID NO: 2888 - DNA, 1335 bp, Artificial
  Alicyclobacillus acidocaldarius mutated SEQ ID NO 2875
ttgcgtcattacgcgtttcgacgaatgttgaccatgtggacaaggtggatggcgatcgagacggttttgtttcgtaaacagcttgttggttttgaaggaaatcgtcatgatttgaagaactcatactccggagagaggagtgttcgcatgaggtcggttgaactgttcgttggagccggcggtcttgcgatggggatatcaaacgccgggtttcggcacgtgggattatacgaatgggatcgatacgcgtgcgacaccatacgtttcaataaggaaagaaacgtggggccggtccgagattggccgatttatcaacttgacgtgcgaagtgtcgatttcactcaatatcgcggtattgaacttctcgcaggaggccccccatgtcagccgttttcattgggaggcaaacatcgtggacgcgaggatcaccggaatatgttccccgaaatgattagggcggtcagggagatccagccgaaggtcgtcttgatcgaaaacgtgaaaggattactgcgggagtccttcgcgaaatacttcgagtacatacttcttcaaatctgttatcccgaaatcgttcctaaggaaaacgaggattggacggatcacttgtctcgtttggaacagcaacacaccaaaggtcgctaccacggcctttcttatcgtgtggtgttccgcttgcttaacgctgcggattacggtgtacctcaaaaaagggaacgggtgtttattgtcggcttccgaagtgatttgaacatcgaatggtcgtttcccaatccaacgcattctttcgacgcccttctttacgatcaatgggttacgggggaatattgggaacggcaccgggttgcgaaaaaacatcgtcctgacattcccgacaaactcaaaaagagaatcgaaagtcttcggatgggactaagactaataaatggcgctccgtgggttactgtgcgcgacgccatttccggtcttcccgatccggaaagcgaacaagactgcggcgtacccaaccatcgttttaatcccggagcccgagtttatccgggacacaccggaagtccgctcgatgagcctgcgaaaaccctaaaagccggggatcacggcgttcccggcggagagaacatgcttgtgaaaccggatggcaccgtacgttatttcacggtgcgggagagcgcgcgcttgcagacgttcccggacgagtacgtgtttagcgggtcttggacggagagcatgcgccaattggggaacgcagttccggtacggttggctcatttcatcactaaagacatcagaacacgtcttgaatggagtgtcgctgatgcaggaaaagccgtataa

SEQ ID NO: 2889 - DNA, 1335 bp, Artificial
  Alicyclobacillus acidocaldarius mutated SEQ ID NO 2875
ttgcgtcattacgcgtttcgacgaatgttgaccatgtggacaaggtggatggcgatcgagacggttttgtttcgtaaacagcttgttggttttgaaggaaatcgtcatgatttgaagaactcatactccggagagaggagtgttcgcatgaggtcggttgaactgttcgttggagccggcggtcttgcgatggggatatcaaacgccgggtttcggcacgtgggattatacgaatgggatcgatacgcgtgcgacaccatacgtttcaataaggaaagaaacgtggggccggtccgagattggccgatttatcaacttgacgtgcgaagtgtcgatttcactcaatatcgcggtattgaacttctcgcaggaggccccccatgtcagccgttttcattgggaggcaaacatcgtggacgcgaggatcaccggaatatgttccccgaaatgattagggcggtcagggagatccagccgaaggtcgtcttgatcgaaaacgtgaaaggattactgcgggagtccttcgcgaaatacttcgagtacatacttcttcaaatctgttatcccgaaatcgttcctaaggaaaacgaggattggacggatcacttgtctcgtttggaacagcaacacaccaaaggtcgctaccacggcctttcttatcgtgtggtgttccgcttgcttaacgctgcggattacggtgtacctcaaaaaagggaacgggtgtttattgtcggcttccgaagtgatttgaacatcgaatggtcgtttcccaatccaacgcattctttcgacgcccttctttacgatcaatgggttacgggggaatattgggaacggcaccgggttgcgaaaaaacatcgtcctgacattcccgacaaactcaaaaagagaatcgaaagtcttcggatgggactaagaattatacagggcgctccgtgggttactgtgcgcgacgccatttccggtcttcccgatccggaaagcgaacaagactgcggcgtacccaaccatcgttttaatcccggagcccgagtttatccgggacacaccggaagtccgctcgatgagcctgcgaaaaccctaaaagccggggatcacggcgttcccggcggagagaacatgcttgtgaaaccggatggcaccgtacgttatttcacggtgcgggagagcgcgcgcttgcagacgttcccggacgagtacgtgtttagcgggtcttggacggagagcatgcgccaattggggaacgcagttccggtacggttggctcatttcatcactaaagacatcagaacacgtcttgaatggagtgtcgctgatgcaggaaaagccgtataa

SEQ ID NO: 2890 - DNA, 1335 bp, Artificial
  Alicyclobacillus acidocaldarius mutated SEQ ID NO 2875
ttgcgtcattacgcgtttcgacgaatgttgaccatgtggacaaggtggatggcgatcgagacggttttgtttcgtaaacagcttgttggttttgaaggaaatcgtcatgatttgaagaactcatactccggagagaggagtgttcgcatgaggtcggttgaactgttcgttggagccggcggtcttgcgatggggatatcaaacgccgggtttcggcacgtgggattatacgaatgggatcgatacgcgtgcgacaccatacgtttcaataaggaaagaaacgtggggccggtccgagattggccgatttatcaacttgacgtgcgaagtgtcgatttcactcaatatcgcggtattgaacttctcgcaggaggccccccatgtcagccgttttcattgggaggcaaacatcgtggacgcgaggatcaccggaatatgttccccgaaatgattagggcggtcagggagatccagccgaaggtcgtcttgatcgaaaacgtgaaaggattactgcgggagtccttcgcgaaatacttcgagtacatacttcttcaaatctgttatcccgaaatcgttcctaaggaaaacgaggattggacggatcacttgtctcgtttggaacagcaacacaccaaaggtcgctaccacggcctttcttatcgtgtggtgttccgcttgcttaacgctgcggattacggtgtacctcaaaaaagggaacgggtgtttattgtcggcttccgaagtgatttgaacatcgaatggtcgtttcccaatccaacgcattctttcgacgcccttctttacgatcaatgggttacgggggaatattgggaacggcaccgggttgcgaaacgtcatcgtcctgacattcccgacaaactcaaaaagagaatcgaaagtcttcggatgggactaagactaatacagggcgctccgtgggttactgtgcgcgacgccatttccggtcttcccgatccggaaagcgaacaagactgcggcgtacccaaccatcgttttaatcccggagcccgagtttatccgggacacaccggaagtccgctcgatgagcctgcgaaaaccctaaaagccggggatcacggcgttcccggcggagagaacatgcttgtgaaaccggatggcaccgtacgttatttcacggtgcgggagagcgcgcgcttgcagacgttcccggacgagtacgtgtttagcgggtcttggacggagagcatgcgccaattggggaacgcagttccggtacggttggctcatttcatcactaaagacatcagaacacgtcttgaatggagtgtcgctgatgcaggaaaagccgtataa

SEQ ID NO: 2891 - protein, 275 aa, Alicyclobacillus acidocaldarius
MQSMPIRRSYLQWPGGKSHIVSALRAFLPPGRRLIEPFVGASSVFLNTDYPEYLLGDANPDLILVHRTLQAYGEAFIGACRELFVPENNAPERYYALRQEFNATQNLWRRAILFVYLNRHGIHGLMRYNRRGAFNTPFGYRRKIYFPEAEMRLFAEHAKRASFVHADFRDLMSQARPGDVVYCDPPYVPLSDTANFTEYAPGGFSWHDHMALAGYARELARRGVTVEISNHRTPATESLYRGAQLVSVRAPRNIGVQHRQAARTAEEILAIFWPP

SEQ ID NO: 2892 - DNA, 828 bp, Alicyclobacillus acidocaldarius
gtgcagtccatgcccatccgtcgctcttatctccaatggcccggcggcaaatcccacatcgtctccgccctacgcgcgttcctgccacccggccgtcggctgatcgagcctttcgtcggcgcgagttcggtgtttttgaacactgactatcccgaatatctactcggcgatgccaatccagacttgatcctcgtgcatcgaacactacaggcttatggcgaagcctttatcggcgcctgccgtgaactgtttgtgcctgagaacaacgcgccagaacggtactatgcgctccgccaggaatttaacgccactcaaaacctatggcggcgagcaattctcttcgtttacctcaatcgacacggaatccatggcctcatgcgctacaaccgccgcggcgctttcaacactccgttcggctatcgtcggaaaatctatttcccagaagcagagatgcgcctgtttgccgagcacgccaaacgcgcctcgttcgtccacgccgactttcgcgacctgatgtctcaggcgcgtcctggcgacgtcgtctactgcgatccaccctatgtgccactgtccgacaccgcgaactttaccgaatacgcgccgggcggcttctcgtggcatgaccacatggcgctggctggatatgcgcgtgagctcgctcgccgcggtgtgaccgtggagatctcgaatcaccgcacgccagcaaccgaatccctctatcgaggtgcccagctcgtctccgtccgcgcgccgcgcaatatcggagtccaacatcgacaggccgcccgtacagccgaggagatcctggcgatcttttggccaccctaa

SEQ ID NO: 2893 - protein, 269 aa, Idiomarina baltica
MKRNRAFLKWAGGKYGLVEPIKACLPEGRKLIEPFVGAGSVFLNTDYDRYLLNDINPDLITLYQFVKRRPKTFIADARRLFTARNNQSDAYYALRKSFNESNDPYYRSLLFLYLNRHGYNGLCRYNSRGIFNVPFGDYRKPYFPEAEIEVFAEKAKRAKFVCSSFEQVFRRARKGDVIYCDPPYAPLVQASNFTSYATGGFSLDEQSELARHAIRAACKRHIPVLISNHDTPLTRALYERAKISSLKVARNISQKGDARKPVAELLALF

SEQ ID NO: 2894 - protein, 272 aa, Vibrio harveyi
MKKQRAFLKWAGGKYGLVEDIQRHLPPARKLVEPFVGAGSVFLNTDYDHYLLADINPDLINLYNLLKERPEEYISEAKRWFVAENNRKEAYLNIRAEFNKTDDVMYRSLAFLYMNRFGFNGLCRYNKKGGFNVPFGSYKKPYFPEAELEFFAEKAKKATFVCEGYPETFSRARKGSVVYCDPPYAPLSNTANFTSYAGNGFTLDDQAALADIAEKAATERGIPVLISNHDTTLTRRLYHGAELNVVKVKRTISRNGSGRNKVDELLALFRAP

SEQ ID NO: 2895 - protein, 272 aa, Vibrio harveyi
MKKQRAFLKWAGGKYGLVEDIQRHLPPARKLVEPFVGAGSVFLNTDYDHYLLADINPDLINLYNLLKERPEEYISEAKRWFVAENNRKEAYLDIRAEFNKTDDVMYRSLAFLYMNRFGFNGLCRYNKKGGFNVPFGSYKKPYFPEAELEFFAEKAKKATFVCEGYPETFSRARKGSVVYCDPPYAPLSNTANFTSYAGNGFTLDDQAALADIAERAATERGIPVLISNHDTTLTRRLYHGAELNVVKVKRTISRNGSGRNKVDELLALFRAP

SEQ ID NO: 2896 - protein, 269 aa, Vibrionales bacterium
MKKQRAFLKWAGGKYGLVEDIQRHLPPARKLVEPFVGAGSVFLNTDYEQYLLADINPDLINLYNLLKTDPETYIAEAKRWFCPENNRKEVFLDIRAQFNDTDNVMYRSLAFLYMNRFGFNGLCRYNKKGGFNVPFGSYKKPYFPEAELEFFAEKAKKATFVCEGYHETFSRARKGCVVYCDPPYAPLSNTANFTSYAGNGFSLDDQAALADVAEKAATERGIPVLISNHDTTLTRRLYHGAELNVVKVKRTISRNGAGRNKVDELLALF

SEQ ID NO: 2897 - protein, 272 aa, Vibrio fischeri
MKKHRAFLKWAGGKYSLVEEIQRHLPDARKLIEPFVGAGSVFLNTDYDHYLLADINPDLINLYNHLKDEPERFIEDARALFQPEYNKKEVYLALRVEFNQCTDTYRRSLLFLYMNRHGFNGLCRYNKKGGFNVPFGSYKKPYFPEKEMVFFAEKAKKATFVCEGYMDTFKRARKGAVVYCDPPYAPLSTTANFTSYAGNGFSLDDQAALADIAEKAAFERDIPVLISNHDTTLTRRLYHGATLNTIKVKRTISRNGAGRNKVDELMALFHAP

SEQ ID NO: 2898 - protein, 275 aa, Artificial
  Alicyclobacillus acidocaldarius mutated SEQ ID NO 2891
MQSMPIRRSYLQWPGGKSHIVSALRAFLPPGRRLIEPFVGASSVFLNTDYPEYLLGDANPDLILVHRTLQAYGEAFIGACRELFVPENNAPERYYALRQEFNATQNLWRRAILFVYLNRHGIHGLMRYNRRGAFNTPFGYRRKIYFPEAEMRLFAEHAKRASFVHADFRDIMSQARPGDVVYCDPPYVPLSDTANFTEYAPGGFSWHDHMALAGYARELARRGVTVEISNHRTPATESLYRGAQLVSVRAPRNIGVQHRQAARTAEEILAIFWPP

SEQ ID NO: 2899 - protein, 275 aa, Artificial
  Alicyclobacillus acidocaldarius mutated SEQ ID NO 2891
MQSMPIRRSYLQWPGGKSHIVSALRAFLPPGRRLIEPFVGASSVFLNTDYPEYLLGDANPDLILVHRTLQAYGEAFIGACRELFVPENNAPERYYALRQEFNATQNLWRRAILFVYLNRHGLHGLMRYNRRGAFNTPFGYRRKIYFPEAEMRLFAEHAKRASFVHADFRDLMSQARPGDVVYCDPPYVPLSDTANFTEYAPGGFSWHDHMALAGYARELARRGVTVEISNHRTPATESLYRGAQLVSVRAPRNIGVQHRQAARTAEEILAIFWPP

SEQ ID NO: 2900 - protein, 275 aa, Artificial
  Alicyclobacillus acidocaldarius mutated SEQ ID NO 2891
MQSMPIRRSYLQWPGGKSHIVSALRAFLPPGRRLIEPFVGASSVFLNTDYPEYLLGDANPDLILVHRTLQAYGEAFIGACRELFVPENNAPERYYALRQEFNATQNLWRRAILFVYLNRHGIHGLMRYNRRGAFNTPFGYRRKIYFPEAEMRLFAEHAKRASFVHADFRDLMSQARPGDVVYCDPPYVPLSDTANFTEYAPGGFSWHDHMALAGYAREIARRGVTVEISNHRTPATESLYRGAQLVSVRAPRNIGVQHRQAARTAEEILAIFWPP

SEQ ID NO: 2901 - protein, 275 aa, Artificial
  Alicyclobacillus acidocaldarius mutated SEQ ID NO 2891
MQSMPIRRSYLQWPGGKSHIVSALRAFLPPGRRLIEPFVGASSVFLNTDYPEYLLGDANPDLILVHRTLQAYGEAFIGACRELFVPENNAPERYYALRQEFNATQNLWRRAILFVYLNRHGIHGLMRYNRRGAFNTPFGYRRKIYFPEAEMRLFAEHAKRASFVHADFKDLMSQARPGDVVYCDPPYVPLSDTANFTEYAPGGFSWHDHMALAGYARELARRGVTVEISNHRTPATESLYRGAQLVSVRAPRNIGVQHRQAARTAEEILAIFWPP

SEQ ID NO: 2902 - protein, 275 aa, Artificial
  Alicyclobacillus acidocaldarius mutated SEQ ID NO 2891
MQSMPIRRSYLQWPGGKSHIVSALRAFLPPGRRLIEPFVGASSVFLNTDYPEYLLGDANPDLILVHRTLQAYGEAFIGACRELFVPENNAPERYYALRQEFNATNNLWRRAILFVYLNRHGIHGLMRYNRRGAFNTPFGYRRKIYFPEAEMRLFAEHAKRASFVHADFRDLMSQARPGDVVYCDPPYVPLSDTANFTEYAPGGFSWHDHMALAGYARELARRGVTVEISNHRTPATESLYRGAQLVSVRAPRNIGVQHRQAARTAEEILAIFWPP

SEQ ID NO: 2903 - DNA, 828 bp, Artificial
  Alicyclobacillus acidocaldarius mutated SEQ ID NO 2892
gtgcagtccatgcccatccgtcgctcttatctccaatggcccggcggcaaatcccacatcgtctccgccctacgcgcgttcctgccacccggccgtcggctgatcgagcctttcgtcggcgcgagttcggtgtttttgaacactgactatcccgaatatctactcggcgatgccaatccagacttgatcctcgtgcatcgaacactacaggcttatggcgaagcctttatcggcgcctgccgtgaactgtttgtgcctgagaacaacgcgccagaacggtactatgcgctccgccaggaatttaacgccactcaaaacctatggcggcgagcaattctcttcgtttacctcaatcgacacggaatccatggcctcatgcgctacaaccgccgcggcgctttcaacactccgttcggctatcgtcggaaaatctatttcccagaagcagagatgcgcctgtttgccgagcacgccaaacgcgcctcgttcgtccacgccgactttcgcgacattatgtctcaggcgcgtcctggcgacgtcgtctactgcgatccaccctatgtgccactgtccgacaccgcgaactttaccgaatacgcgccgggcggcttctcgtggcatgaccacatggcgctggctggatatgcgcgtgagctcgctcgccgcggtgtgaccgtggagatctcgaatcaccgcacgccagcaaccgaatccctctatcgaggtgcccagctcgtctccgtccgcgcgccgcgcaatatcggagtccaacatcgacaggccgcccgtacagccgaggagatcctggcgatcttttggccaccctaa

SEQ ID NO: 2904 - DNA, 828 bp, Artificial
  Alicyclobacillus acidocaldarius mutated SEQ ID NO 2892
gtgcagtccatgcccatccgtcgctcttatctccaatggcccggcggcaaatcccacatcgtctccgccctacgcgcgttcctgccacccggccgtcggctgatcgagcctttcgtcggcgcgagttcggtgtttttgaacactgactatcccgaatatctactcggcgatgccaatccagacttgatcctcgtgcatcgaacactacaggcttatggcgaagcctttatcggcgcctgccgtgaactgtttgtgcctgagaacaacgcgccagaacggtactatgcgctccgccaggaatttaacgccactcaaaacctatggcggcgagcaattctcttcgtttacctcaatcgacacggattacatggcctcatgcgctacaaccgccgcggcgctttcaacactccgttcggctatcgtcggaaaatctatttcccagaagcagagatgcgcctgtttgccgagcacgccaaacgcgcctcgttcgtccacgccgactttcgcgacctgatgtctcaggcgcgtcctggcgacgtcgtctactgcgatccaccctatgtgccactgtccgacaccgcgaactttaccgaatacgcgccgggcggcttctcgtggcatgaccacatggcgctggctggatatgcgcgtgagctcgctcgccgcggtgtgaccgtggagatctcgaatcaccgcacgccagcaaccgaatccctctatcgaggtgcccagctcgtctccgtccgcgcgccgcgcaatatcggagtccaacatcgacaggccgcccgtacagccgaggagatcctggcgatcttttggccaccctaa

SEQ ID NO: 2905 - DNA, 828 bp, Artificial
  Alicyclobacillus acidocaldarius mutated SEQ ID NO 2892
gtgcagtccatgcccatccgtcgctcttatctccaatggcccggcggcaaatcccacatcgtctccgccctacgcgcgttcctgccacccggccgtcggctgatcgagcctttcgtcggcgcgagttcggtgtttttgaacactgactatcccgaatatctactcggcgatgccaatccagacttgatcctcgtgcatcgaacactacaggcttatggcgaagcctttatcggcgcctgccgtgaactgtttgtgcctgagaacaacgcgccagaacggtactatgcgctccgccaggaatttaacgccactcaaaacctatggcggcgagcaattctcttcgtttacctcaatcgacacggaatccatggcctcatgcgctacaaccgccgcggcgctttcaacactccgttcggctatcgtcggaaaatctatttcccagaagcagagatgcgcctgtttgccgagcacgccaaacgcgcctcgttcgtccacgccgactttcgcgacctgatgtctcaggcgcgtcctggcgacgtcgtctactgcgatccaccctatgtgccactgtccgacaccgcgaactttaccgaatacgcgccgggcggcttctcgtggcatgaccacatggcgctggctggatatgcgcgtgagattgctcgccgcggtgtgaccgtggagatctcgaatcaccgcacgccagcaaccgaatccctctatcgaggtgcccagctcgtctccgtccgcgcgccgcgcaatatcggagtccaacatcgacaggccgcccgtacagccgaggagatcctggcgatcttttggccaccctaa

SEQ ID NO: 2906 - DNA, 828 bp, Artificial
  Alicyclobacillus acidocaldarius mutated SEQ ID NO 2892
gtgcagtccatgcccatccgtcgctcttatctccaatggcccggcggcaaatcccacatcgtctccgccctacgcgcgttcctgccacccggccgtcggctgatcgagcctttcgtcggcgcgagttcggtgtttttgaacactgactatcccgaatatctactcggcgatgccaatccagacttgatcctcgtgcatcgaacactacaggcttatggcgaagcctttatcggcgcctgccgtgaactgtttgtgcctgagaacaacgcgccagaacggtactatgcgctccgccaggaatttaacgccactcaaaacctatggcggcgagcaattctcttcgtttacctcaatcgacacggaatccatggcctcatgcgctacaaccgccgcggcgctttcaacactccgttcggctatcgtcggaaaatctatttcccagaagcagagatgcgcctgtttgccgagcacgccaaacgcgcctcgttcgtccacgccgactttaaagacctgatgtctcaggcgcgtcctggcgacgtcgtctactgcgatccaccctatgtgccactgtccgacaccgcgaactttaccgaatacgcgccgggcggcttctcgtggcatgaccacatggcgctggctggatatgcgcgtgagctcgctcgccgcggtgtgaccgtggagatctcgaatcaccgcacgccagcaaccgaatccctctatcgaggtgcccagctcgtctccgtccgcgcgccgcgcaatatcggagtccaacatcgacaggccgcccgtacagccgaggagatcctggcgatcttttggccaccctaa

SEQ ID NO: 2907 - DNA, 828 bp, Artificial
  Alicyclobacillus acidocaldarius mutated SEQ ID NO 2892
gtgcagtccatgcccatccgtcgctcttatctccaatggcccggcggcaaatcccacatcgtctccgccctacgcgcgttcctgccacccggccgtcggctgatcgagcctttcgtcggcgcgagttcggtgtttttgaacactgactatcccgaatatctactcggcgatgccaatccagacttgatcctcgtgcatcgaacactacaggcttatggcgaagcctttatcggcgcctgccgtgaactgtttgtgcctgagaacaacgcgccagaacggtactatgcgctccgccaggaatttaacgccactaataacctatggcggcgagcaattctcttcgtttacctcaatcgacacggaatccatggcctcatgcgctacaaccgccgcggcgctttcaacactccgttcggctatcgtcggaaaatctatttcccagaagcagagatgcgcctgtttgccgagcacgccaaacgcgcctcgttcgtccacgccgactttcgcgacctgatgtctcaggcgcgtcctggcgacgtcgtctactgcgatccaccctatgtgccactgtccgacaccgcgaactttaccgaatacgcgccgggcggcttctcgtggcatgaccacatggcgctggctggatatgcgcgtgagctcgctcgccgcggtgtgaccgtggagatctcgaatcaccgcacgccagcaaccgaatccctctatcgaggtgcccagctcgtctccgtccgcgcgccgcgcaatatcggagtccaacatcgacaggccgcccgtacagccgaggagatcctggcgatcttttggccaccctaa

SEQ ID NO: 2908 - protein, 295 aa, Alicyclobacillus acidocaldarius
MGVMLLSFIEGLPPFTALMIDHVSTARQKPRRKRIAFGWYGGKYSHLSWLLPLLPRAHHYCEPFGGSAAVLLNRDPSPVETYNDLDGEVVNFFRVLREQRDALIEAIALTPFSREEFVRAIVEPTGGLTELERARRFYVRARQARMALAQTATPGRWAACRNTSQRGMAGNVSRWLGSAANLAEIAARLVRVQIEHRPAMDVIRAYDSPDTLFYCDPPYIHATRTDPRAYRYEMSDEEHMELARVLHNVRGKVAISGYHCDLMDELYRDWRCIDAPPKQCHASKRWRQEALWVNY

SEQ ID NO: 2909 - DNA, 888 bp, Alicyclobacillus acidocaldarius
gtgggggtgatgcttttgtcattcatagaaggtcttccgccattcacggcgctaatgatcgatcacgtgagcacggcgcgccagaaaccaaggagaaagcgaatcgcgtttggctggtacggcggcaagtacagtcacttgtcgtggctcctgccgctgttgccgcgagcgcatcattattgcgagccgttcggaggctcggcagcggtcttactgaatcgggatccttcacctgtggagacgtataacgatctggacggggaagtcgtcaatttctttcgcgtgcttcgcgagcagcgcgacgccttgattgaggcgatcgcgctcacgccgttcagtcgagaagagtttgtccgggccatcgttgagccaacaggtggtctaactgaactcgagcgcgcaaggcggttctacgtccgagcaagacaggctcgcatggcactggcgcagaccgctacaccggggcgttgggcggcatgccgcaacacgagccagcgcgggatggcaggcaatgtgtcccgttggcttggaagtgcggccaatttggccgagatcgcagcgcgtctggtccgcgtgcagatcgaacatcgccctgcgatggacgtgattcgtgcctacgacagtcctgatacgttgttttactgcgacccgccatacatccatgcgacccgaacagatccgagagcctatcgttacgagatgagcgacgaggagcacatggaacttgcgcgggttttgcacaatgttcggggcaaggttgcgatttccggttatcattgcgatctgatggacgagctgtatcgagattggcggtgtatcgacgcgccgccaaaacagtgccatgcgtcgaagaggtggcgtcaggaagctctgtgggtcaactattga

SEQ ID NO: 2910 - protein, 263 aa, Nodularia spumigena
KKIAFGWYGGKYSHLDWLLPLLPTITHYCEPFGGSAAVLLNREPAPVETYNDIDGQVVNFFRVLRDQRDELIQAIGLTPFSREEFRIAIAKDETGLSDLEKARRFFVRARQVRTGLAQTASIGRWAHCKLTSRAGMAGAVSRWLGSVEHLPEIVQRLLRVQIENDTAIDIIQRYDSSETLFYCDPPYPHDSRGDSKAYAYEMTDDEHRQLAGVLRSVKGKVALSGYDCTLMQELYGDWNCIKAPQKQCHSIKELRQEVLWVNY

SEQ ID NO: 2911 - protein, 265 aa, Lyngbya majuscula
KNKLIAFGWYGGKYSHLDWLLPLLPKTTHYCEPFGGSASILINREPSPVETYNDIDGELVNFFRVLRDEKNELIRAIAFTPFSRSEFELAISKDTTNLSNLERARRFFIRARQVRTGLAQTASSGRWAHCLLTSRAGMAGAVSRWLGSIDDLSKIVQRLQRVQIENSSSFDIIRRYDSEETLFYCDPPYPHNTRGDSKAYAYEMTDEEHRKLAEIVHNIKGKVAVSGYECTLMNELYGDWKQISAPTKSCHSVKKPRTERLWINY

SEQ ID NO: 2912 - protein, 269 aa, Chloroflexus aurantiacus
QRRTRRLIAFGWYGGKYSHLDWLLPLLPPCHHYCEPFGGSAAVLLNRDPAPVETYNDIDGEVTNFFRVLRDQPDQLTRAIALTPFSREEFALACEIDPSLEPIERARRFYVRARQVRTGLAQSASLGRWANCKQTSRSGMAGAISRWFGAIEDLPDIAIRLLRVQIENRPALEVIRLYDSPDTLFYCDPPYVHETRGDNNAYAYEMSNEEHQQLADVLNSVQGFVAISGYDCDLMNELYSPPKWIKHVGPTRTIHSTKDQRTEILWTNY

SEQ ID NO: 2913 - protein, 269 aa, Roseiflexus  RS-1
RRERKRVIAFGWYGGKYSHLDWLLPLLPFCHHYCEPFGGSAAVLFNREPSPVETYNDIDGEVVNFFRVLRDDPERLVRAIGLTPFSREEFAIACEIDPALDPVERARRFYVRARQVRTGLAQSATLGRWANCKNTSRSGMAGAVSRWLGAVEDLPEIALRLLRVQIENRPAIEVIRLYDSADTLFYCDPPYIHETRGDDNAYAYEMNYEEHCELAMSLNSVRGLVAISGYECDLMNDLYPSSRWYKSVAPSKTIHSTKDKRTEILWTNY

SEQ ID NO: 2914 - protein, 258 aa, Chloroflexus aggregans
KRSKKRILAFGWYGGKYSHLDWLLPLLPSCHHYCEPFGGSAAVLLNREPSPVETYNDIDGDVVHFFRVLRDEPERLVRAIGLTPFSREEFAIACEIDPSLDPVECARRFYVRARQVRTGLAQSATLGRWANCKNTSRAGMAGAVSRWLGAIEDLPDIALRLLRVQIENRPSIEVIRLYDSPDTLFYCDPPYVHDTWGDNNAYAYEMNNEEHRQLALVLNSVQGFVAISGYDCDLMNDLYPSPNWYKNIAPTKTIHSTK

SEQ ID NO: 2915 - protein, 295 aa, Artificial
  Alicyclobacillus acidocaldarius mutated SEQ ID NO 2908
MGVMLLSFLEGLPPFTALMIDHVSTARQKPRRKRIAFGWYGGKYSHLSWLLPLLPRAHHYCEPFGGSAAVLLNRDPSPVETYNDLDGEVVNFFRVLREQRDALIEAIALTPFSREEFVRAIVEPTGGLTELERARRFYVRARQARMALAQTATPGRWAACRNTSQRGMAGNVSRWLGSAANLAEIAARLVRVQIEHRPAMDVIRAYDSPDTLFYCDPPYIHATRTDPRAYRYEMSDEEHMELARVLHNVRGKVAISGYHCDLMDELYRDWRCIDAPPKQCHASKRWRQEALWVNY

SEQ ID NO: 2916 - protein, 295 aa, Artificial
  Alicyclobacillus acidocaldarius mutated SEQ ID NO 2908
MGVMLLSFIEGLPPFTALMIDHVSTARQKPKRKRIAFGWYGGKYSHLSWLLPLLPRAHHYCEPFGGSAAVLLNRDPSPVETYNDLDGEVVNFFRVLREQRDALIEAIALTPFSREEFVRAIVEPTGGLTELERARRFYVRARQARMALAQTATPGRWAACRNTSQRGMAGNVSRWLGSAANLAEIAARLVRVQIEHRPAMDVIRAYDSPDTLFYCDPPYIHATRTDPRAYRYEMSDEEHMELARVLHNVRGKVAISGYHCDLMDELYRDWRCIDAPPKQCHASKRWRQEALWVNY

SEQ ID NO: 2917 - protein, 295 aa, Artificial
  Alicyclobacillus acidocaldarius mutated SEQ ID NO 2908
MGVMLLSFIEGLPPFTALMIDHVSTARQKPRRKRIAFGWYGGKYSHLSWLLPLLPRAHHYCEPFGGSAAVLLNRDPSPVETYNDLDGEVVNFFRVLREQRDALIEAIALTPFSREEFVRAIVEPTGGLTELERARRFYVRARQARMALAQTATPGRWAACRNTSQRGMAGNVSRWLGSAANLAEIAARLVRVQIEHRPAMDVIRAYDSPDTLFYCDPPYIHATKTDPRAYRYEMSDEEHMELARVLHNVRGKVAISGYHCDLMDELYRDWRCIDAPPKQCHASKRWRQEALWVNY

SEQ ID NO: 2918 - protein, 295 aa, Artificial
  Alicyclobacillus acidocaldarius mutated SEQ ID NO 2908
MGVMLLSFIEGLPPFTALMIDHVSTARQKPRRKRIAFGWYGGKYSHLSWLLPLLPKAHHYCEPFGGSAAVLLNRDPSPVETYNDLDGEVVNFFRVLREQRDALIEAIALTPFSREEFVRAIVEPTGGLTELERARRFYVRARQARMALAQTATPGRWAACRNTSQRGMAGNVSRWLGSAANLAEIAARLVRVQIEHRPAMDVIRAYDSPDTLFYCDPPYIHATRTDPRAYRYEMSDEEHMELARVLHNVRGKVAISGYHCDLMDELYRDWRCIDAPPKQCHASKRWRQEALWVNY

SEQ ID NO: 2919 - protein, 295 aa, Artificial
  Alicyclobacillus acidocaldarius mutated SEQ ID NO 2908
MGVMLLSFIEGLPPFTALMIDHVSTARQKPRRKRIAFGWYGGKYSHLSWLLPLLPRAHHYCEPFGGSAAVLLNRDPSPVETYNDLDGEVVNFFRVLREQRDALIEAIALTPFSREEFVRALVEPTGGLTELERARRFYVRARQARMALAQTATPGRWAACRNTSQRGMAGNVSRWLGSAANLAEIAARLVRVQIEHRPAMDVIRAYDSPDTLFYCDPPYIHATRTDPRAYRYEMSDEEHMELARVLHNVRGKVAISGYHCDLMDELYRDWRCIDAPPKQCHASKRWRQEALWVNY

SEQ ID NO: 2920 - DNA, 888 bp, Artificial
  Alicyclobacillus acidocaldarius mutated SEQ ID NO 2909
gtgggggtgatgcttttgtcattcttagaaggtcttccgccattcacggcgctaatgatcgatcacgtgagcacggcgcgccagaaaccaaggagaaagcgaatcgcgtttggctggtacggcggcaagtacagtcacttgtcgtggctcctgccgctgttgccgcgagcgcatcattattgcgagccgttcggaggctcggcagcggtcttactgaatcgggatccttcacctgtggagacgtataacgatctggacggggaagtcgtcaatttctttcgcgtgcttcgcgagcagcgcgacgccttgattgaggcgatcgcgctcacgccgttcagtcgagaagagtttgtccgggccatcgttgagccaacaggtggtctaactgaactcgagcgcgcaaggcggttctacgtccgagcaagacaggctcgcatggcactggcgcagaccgctacaccggggcgttgggcggcatgccgcaacacgagccagcgcgggatggcaggcaatgtgtcccgttggcttggaagtgcggccaatttggccgagatcgcagcgcgtctggtccgcgtgcagatcgaacatcgccctgcgatggacgtgattcgtgcctacgacagtcctgatacgttgttttactgcgacccgccatacatccatgcgacccgaacagatccgagagcctatcgttacgagatgagcgacgaggagcacatggaacttgcgcgggttttgcacaatgttcggggcaaggttgcgatttccggttatcattgcgatctgatggacgagctgtatcgagattggcggtgtatcgacgcgccgccaaaacagtgccatgcgtcgaagaggtggcgtcaggaagctctgtgggtcaactattga

SEQ ID NO: 2921 - DNA, 888 bp, Artificial
  Alicyclobacillus acidocaldarius mutated SEQ ID NO 2909
gtgggggtgatgcttttgtcattcatagaaggtcttccgccattcacggcgctaatgatcgatcacgtgagcacggcgcgccagaaaccaaaaagaaagcgaatcgcgtttggctggtacggcggcaagtacagtcacttgtcgtggctcctgccgctgttgccgcgagcgcatcattattgcgagccgttcggaggctcggcagcggtcttactgaatcgggatccttcacctgtggagacgtataacgatctggacggggaagtcgtcaatttctttcgcgtgcttcgcgagcagcgcgacgccttgattgaggcgatcgcgctcacgccgttcagtcgagaagagtttgtccgggccatcgttgagccaacaggtggtctaactgaactcgagcgcgcaaggcggttctacgtccgagcaagacaggctcgcatggcactggcgcagaccgctacaccggggcgttgggcggcatgccgcaacacgagccagcgcgggatggcaggcaatgtgtcccgttggcttggaagtgcggccaatttggccgagatcgcagcgcgtctggtccgcgtgcagatcgaacatcgccctgcgatggacgtgattcgtgcctacgacagtcctgatacgttgttttactgcgacccgccatacatccatgcgacccgaacagatccgagagcctatcgttacgagatgagcgacgaggagcacatggaacttgcgcgggttttgcacaatgttcggggcaaggttgcgatttccggttatcattgcgatctgatggacgagctgtatcgagattggcggtgtatcgacgcgccgccaaaacagtgccatgcgtcgaagaggtggcgtcaggaagctctgtgggtcaactattga

SEQ ID NO: 2922 - DNA, 888 bp, Artificial
  Alicyclobacillus acidocaldarius mutated SEQ ID NO 2909
gtgggggtgatgcttttgtcattcatagaaggtcttccgccattcacggcgctaatgatcgatcacgtgagcacggcgcgccagaaaccaaggagaaagcgaatcgcgtttggctggtacggcggcaagtacagtcacttgtcgtggctcctgccgctgttgccgcgagcgcatcattattgcgagccgttcggaggctcggcagcggtcttactgaatcgggatccttcacctgtggagacgtataacgatctggacggggaagtcgtcaatttctttcgcgtgcttcgcgagcagcgcgacgccttgattgaggcgatcgcgctcacgccgttcagtcgagaagagtttgtccgggccatcgttgagccaacaggtggtctaactgaactcgagcgcgcaaggcggttctacgtccgagcaagacaggctcgcatggcactggcgcagaccgctacaccggggcgttgggcggcatgccgcaacacgagccagcgcgggatggcaggcaatgtgtcccgttggcttggaagtgcggccaatttggccgagatcgcagcgcgtctggtccgcgtgcagatcgaacatcgccctgcgatggacgtgattcgtgcctacgacagtcctgatacgttgttttactgcgacccgccatacatccatgcgaccaaaacagatccgagagcctatcgttacgagatgagcgacgaggagcacatggaacttgcgcgggttttgcacaatgttcggggcaaggttgcgatttccggttatcattgcgatctgatggacgagctgtatcgagattggcggtgtatcgacgcgccgccaaaacagtgccatgcgtcgaagaggtggcgtcaggaagctctgtgggtcaactattga

SEQ ID NO: 2923 - DNA, 888 bp, Artificial
  Alicyclobacillus acidocaldarius mutated SEQ ID NO 2909
gtgggggtgatgcttttgtcattcatagaaggtcttccgccattcacggcgctaatgatcgatcacgtgagcacggcgcgccagaaaccaaggagaaagcgaatcgcgtttggctggtacggcggcaagtacagtcacttgtcgtggctcctgccgctgttgccgaaagcgcatcattattgcgagccgttcggaggctcggcagcggtcttactgaatcgggatccttcacctgtggagacgtataacgatctggacggggaagtcgtcaatttctttcgcgtgcttcgcgagcagcgcgacgccttgattgaggcgatcgcgctcacgccgttcagtcgagaagagtttgtccgggccatcgttgagccaacaggtggtctaactgaactcgagcgcgcaaggcggttctacgtccgagcaagacaggctcgcatggcactggcgcagaccgctacaccggggcgttgggcggcatgccgcaacacgagccagcgcgggatggcaggcaatgtgtcccgttggcttggaagtgcggccaatttggccgagatcgcagcgcgtctggtccgcgtgcagatcgaacatcgccctgcgatggacgtgattcgtgcctacgacagtcctgatacgttgttttactgcgacccgccatacatccatgcgacccgaacagatccgagagcctatcgttacgagatgagcgacgaggagcacatggaacttgcgcgggttttgcacaatgttcggggcaaggttgcgatttccggttatcattgcgatctgatggacgagctgtatcgagattggcggtgtatcgacgcgccgccaaaacagtgccatgcgtcgaagaggtggcgtcaggaagctctgtgggtcaactattga

SEQ ID NO: 2924 - DNA, 888 bp, Artificial
  Alicyclobacillus acidocaldarius mutated SEQ ID NO 2909
gtgggggtgatgcttttgtcattcatagaaggtcttccgccattcacggcgctaatgatcgatcacgtgagcacggcgcgccagaaaccaaggagaaagcgaatcgcgtttggctggtacggcggcaagtacagtcacttgtcgtggctcctgccgctgttgccgcgagcgcatcattattgcgagccgttcggaggctcggcagcggtcttactgaatcgggatccttcacctgtggagacgtataacgatctggacggggaagtcgtcaatttctttcgcgtgcttcgcgagcagcgcgacgccttgattgaggcgatcgcgctcacgccgttcagtcgagaagagtttgtccgggccttagttgagccaacaggtggtctaactgaactcgagcgcgcaaggcggttctacgtccgagcaagacaggctcgcatggcactggcgcagaccgctacaccggggcgttgggcggcatgccgcaacacgagccagcgcgggatggcaggcaatgtgtcccgttggcttggaagtgcggccaatttggccgagatcgcagcgcgtctggtccgcgtgcagatcgaacatcgccctgcgatggacgtgattcgtgcctacgacagtcctgatacgttgttttactgcgacccgccatacatccatgcgacccgaacagatccgagagcctatcgttacgagatgagcgacgaggagcacatggaacttgcgcgggttttgcacaatgttcggggcaaggttgcgatttccggttatcattgcgatctgatggacgagctgtatcgagattggcggtgtatcgacgcgccgccaaaacagtgccatgcgtcgaagaggtggcgtcaggaagctctgtgggtcaactattga

SEQ ID NO: 2925 - protein, 165 aa, Alicyclobacillus acidocaldarius
MPFCPADIALRRGRSLMQQTWAVFANGAQVRVFWVDGEPWFDAVGVCEAMGLRNIEKAIRRLDDDEKGLVTVDNAGGREEILVVRESGMLRLALAGREPHARAFQRWVVREVLPLAIRGQRPNALEEQLRLEKVSLLVEILAAYQDRLSDGGIEHLAKTIANLLT

SEQ ID NO: 2926 - DNA, 498 bp, Alicyclobacillus acidocaldarius
atgccgttttgccctgcagacatcgctcttcggagggggcgatctctcatgcaacaaacctgggcggtcttcgcgaatggcgcgcaggtgcgtgtgttttgggttgatggcgaaccatggtttgacgccgtcggggtgtgtgaggcgatggggctgcgtaacattgagaaggcgatacgaaggttggacgacgacgagaagggtttggtgacggtcgacaacgcaggcgggcgcgaggagatcctggttgttcgcgagtcggggatgttgcgtttggcgcttgcaggccgagaaccccacgcgcgtgcatttcaacgttgggtggtgcgcgaggtgttacctcttgcgatccgaggtcagcgtcccaacgctttggaggaacaactgcgacttgagaaggtctcgttgctcgtcgagatcctcgcagcatatcaagaccgattgtcggacggagggatcgaacatcttgccaaaacaatcgcaaatctcctaacttaa

SEQ ID NO: 2927 - protein, 119 aa, Escherichia coli
FESQADIRVIVINGEPWFIASDVCRAIGIANHRDAVRKLDDDEKGVASTDTPGGEQESIIISESGLYTLILRCRDAVTPGTIPYRFRKWVTGEVLPQIRRTGSYIKNSLPQEERIKMVA

SEQ ID NO: 2928 - protein, 119 aa, Phage phiV10; identical to SEQ ID NO: 2927

SEQ ID NO: 2929 - protein, 121 aa, Clostridium thermocellum
GKQVRTFIIDGEPWWVAKDVCDILELGDTHKAMERLDEDERNTIPVTDSLGRLQETYVVNEAGLYNLILGSRKQEAKEFKRWITHEVIPQIRKTGIYALEPKQLLAVAIIEAQKIIEEQDR

SEQ ID NO: 2930 - protein, 89 aa, Bacteroides caccae
NSTPIRVQVINNEPWFVAKDVCDVLGISKYRDAIARLDDDEGCPIEVDTLGGMQKMAAVNESGLYTLILQSRKPEAKPFRKWVTSEVLP

SEQ ID NO: 2931 - protein, 102 aa, Thermoanaerobacter  X514
GNTVRTVMKDGNPWWVLKDVCSVLDIGNSRDVMARLDSDEKGVDIIDTPGGKQEVSIINESGLYSVILVSRKPEAKKFKRWVTHEVLPSIRRHGLYATDELL

SEQ ID NO: 2932 - protein, 165 aa, Artificial
  Alicyclobacillus acidocaldarius mutated SEQ ID NO 2925
MPFCPADIALRRGKSLMQQTWAVFANGAQVRVFWVDGEPWFDAVGVCEAMGLRNIEKAIRRLDDDEKGLVTVDNAGGREEILVVRESGMLRLALAGREPHARAFQRWVVREVLPLAIRGQRPNALEEQLRLEKVSLLVEILAAYQDRLSDGGIEHLAKTIANLLT

SEQ ID NO: 2933 - protein, 165 aa, Artificial
  Alicyclobacillus acidocaldarius mutated SEQ ID NO 2925
MPFCPADIALRRGRSLMQQTWAVFANGAQVRVFWVDGEPWFDAVGVCEAMGLRNIEKAIRRLDDDEKGLVTVDNAGGREEILVVRESGMLKLALAGREPHARAFQRWVVREVLPLAIRGQRPNALEEQLRLEKVSLLVEILAAYQDRLSDGGIEHLAKTIANLLT

SEQ ID NO: 2934 - protein, 165 aa, Artificial
  Alicyclobacillus acidocaldarius mutated SEQ ID NO 2925
MPFCPADIALRRGRSLMQQTWAVFANGAQVRVFWVDGEPWFDAVGVCEAMGLRNIEKAIRRLDDDEKGLVTVDNAGGREEILVVRESGMLRLALAGREPHARAFQRWVVREVLPLAIRGQKPNALEEQLRLEKVSLLVEILAAYQDRLSDGGIEHLAKTIANLLT

SEQ ID NO: 2935 - protein, 165 aa, Artificial
  Alicyclobacillus acidocaldarius mutated SEQ ID NO 2925
MPFCPADIALRRGRSLMQQTWAVFANGAQVRVFWVDGEPWFDAVGVCEAMGLRNIEKAIRRLDDDEKGLVTVDNAGGREEILVVRESGMLRLALAGREPHARAFQRWVVREVLPLAIKGQRPNALEEQLRLEKVSLLVEILAAYQDRLSDGGIEHLAKTIANLLT

SEQ ID NO: 2936 - protein, 165 aa, Artificial
  Alicyclobacillus acidocaldarius mutated SEQ ID NO 2925
MPFCPADIALRRGRSLMQQTWAVFANGAQVRVFWVDGEPWFDAVGVCEAMGLRNIEKAIRRLDDDEKGLVTVDNAGGREEILVVRESGMLRLALAGREPHARAFQRWVVREVLPLAIRGQRPNALEEQLRLEKVSLLVEILAAYQDRLSDGGIEHLAKTIANLIT

SEQ ID NO: 2937 - DNA, 498 bp, Artificial
  Alicyclobacillus acidocaldarius mutated SEQ ID NO 2926
atgccgttttgccctgcagacatcgctcttcggagggggaaatctctcatgcaacaaacctgggcggtcttcgcgaatggcgcgcaggtgcgtgtgttttgggttgatggcgaaccatggtttgacgccgtcggggtgtgtgaggcgatggggctgcgtaacattgagaaggcgatacgaaggttggacgacgacgagaagggtttggtgacggtcgacaacgcaggcgggcgcgaggagatcctggttgttcgcgagtcggggatgttgcgtttggcgcttgcaggccgagaaccccacgcgcgtgcatttcaacgttgggtggtgcgcgaggtgttacctcttgcgatccgaggtcagcgtcccaacgctttggaggaacaactgcgacttgagaaggtctcgttgctcgtcgagatcctcgcagcatatcaagaccgattgtcggacggagggatcgaacatcttgccaaaacaatcgcaaatctcctaacttaa

SEQ ID NO: 2938 - DNA, 498 bp, Artificial
  Alicyclobacillus acidocaldarius mutated SEQ ID NO 2926
atgccgttttgccctgcagacatcgctcttcggagggggcgatctctcatgcaacaaacctgggcggtcttcgcgaatggcgcgcaggtgcgtgtgttttgggttgatggcgaaccatggtttgacgccgtcggggtgtgtgaggcgatggggctgcgtaacattgagaaggcgatacgaaggttggacgacgacgagaagggtttggtgacggtcgacaacgcaggcgggcgcgaggagatcctggttgttcgcgagtcggggatgttgaaattggcgcttgcaggccgagaaccccacgcgcgtgcatttcaacgttgggtggtgcgcgaggtgttacctcttgcgatccgaggtcagcgtcccaacgctttggaggaacaactgcgacttgagaaggtctcgttgctcgtcgagatcctcgcagcatatcaagaccgattgtcggacggagggatcgaacatcttgccaaaacaatcgcaaatctcctaacttaa

SEQ ID NO: 2939 - DNA, 498 bp, Artificial
  Alicyclobacillus acidocaldarius mutated SEQ ID NO 2926
atgccgttttgccctgcagacatcgctcttcggagggggcgatctctcatgcaacaaacctgggcggtcttcgcgaatggcgcgcaggtgcgtgtgttttgggttgatggcgaaccatggtttgacgccgtcggggtgtgtgaggcgatggggctgcgtaacattgagaaggcgatacgaaggttggacgacgacgagaagggtttggtgacggtcgacaacgcaggcgggcgcgaggagatcctggttgttcgcgagtcggggatgttgcgtttggcgcttgcaggccgagaaccccacgcgcgtgcatttcaacgttgggtggtgcgcgaggtgttacctcttgcgatccgaggtcagaaacccaacgctttggaggaacaactgcgacttgagaaggtctcgttgctcgtcgagatcctcgcagcatatcaagaccgattgtcggacggagggatcgaacatcttgccaaaacaatcgcaaatctcctaacttaa

SEQ ID NO: 2940 - DNA, 498 bp, Artificial
  Alicyclobacillus acidocaldarius mutated SEQ ID NO 2926
atgccgttttgccctgcagacatcgctcttcggagggggcgatctctcatgcaacaaacctgggcggtcttcgcgaatggcgcgcaggtgcgtgtgttttgggttgatggcgaaccatggtttgacgccgtcggggtgtgtgaggcgatggggctgcgtaacattgagaaggcgatacgaaggttggacgacgacgagaagggtttggtgacggtcgacaacgcaggcgggcgcgaggagatcctggttgttcgcgagtcggggatgttgcgtttggcgcttgcaggccgagaaccccacgcgcgtgcatttcaacgttgggtggtgcgcgaggtgttacctcttgcgatcaaaggtcagcgtcccaacgctttggaggaacaactgcgacttgagaaggtctcgttgctcgtcgagatcctcgcagcatatcaagaccgattgtcggacggagggatcgaacatcttgccaaaacaatcgcaaatctcctaacttaa

SEQ ID NO: 2941 - DNA, 498 bp, Artificial
  Alicyclobacillus acidocaldarius mutated SEQ ID NO 2926
atgccgttttgccctgcagacatcgctcttcggagggggcgatctctcatgcaacaaacctgggcggtcttcgcgaatggcgcgcaggtgcgtgtgttttgggttgatggcgaaccatggtttgacgccgtcggggtgtgtgaggcgatggggctgcgtaacattgagaaggcgatacgaaggttggacgacgacgagaagggtttggtgacggtcgacaacgcaggcgggcgcgaggagatcctggttgttcgcgagtcggggatgttgcgtttggcgcttgcaggccgagaaccccacgcgcgtgcatttcaacgttgggtggtgcgcgaggtgttacctcttgcgatccgaggtcagcgtcccaacgctttggaggaacaactgcgacttgagaaggtctcgttgctcgtcgagatcctcgcagcatatcaagaccgattgtcggacggagggatcgaacatcttgccaaaacaatcgcaaatctcattacttaa

SEQ ID NO: 2942 - protein, 110 aa, Alicyclobacillus acidocaldarius
MCCLTGLERMRDLLEKERELVNKGELVAEVQARVGLPKSQVLQVLNTFCEVTTERLQAGEEVSLPPLGKFQYVMRSARRQRNPQTGEMIDVPEKATVRFRPSGALKGRVN

SEQ ID NO: 2943 - DNA, 333 bp, Alicyclobacillus acidocaldarius
ttgtgttgccttacaggtctcgaacgaatgagagatcttcttgaaaaggagcgagagctcgtgaacaagggtgaactggtggcggaagttcaggcaagggtgggcttacccaagtctcaggtgttacaagtgctcaatacgttctgcgaggtgacgacggaacgattgcaagcgggtgaagaagtgtccttaccgccccttgggaaattccagtacgtgatgcgctccgcgcgtcggcaacggaatcctcagaccggcgagatgatcgacgttcccgaaaaggccacggtgcgctttcggccatccggggctttgaaggggcgtgtgaactga

SEQ ID NO: 2944 - protein, 91 aa, Prosthecochloris aestuarii
LMSKAELVEKIASQAGLTKADAERAVNSFVSVVTDSLKAGEDVTLVGFGTFSVGERAERQGRNPQTGETITIAARKAVKFKPGKALKEEVD

SEQ ID NO: 2945 - protein, 90 aa, Halorhodospira halophila
MNKADLAEKVAAETGVSKRVATDAVSAVFTGIEESLASGEDVSIPGFGKFAVVARPERQGRNPQTGELIDIPAGMNVRFKPGAPLKRSVD

SEQ ID NO: 2946 - protein, 89 aa, Bacillus phage
MNKTELIAKVAEKQGVSKKEGAPSVEKVFDTISEALKSGEKVSIPGFGTFEVRERAARKGRNPQTGEEIDIPATKAPAFKPAKALKDAV

SEQ ID NO: 2947 - protein, 89 aa, Pelodictyon luteolum
MSKAELVEKIAAQAKLTKVDAERAVNAFINVVTSSLKGGDDVTLVGFGTFTTGDRAARQGRNPQTGKAITIPAKKVVKFKPGKALKDEV

SEQ ID NO: 2948 - protein, 89 aa, Prosthecochloris vibrioformis
MSKAELVEKIAAQANLTKVDAEKSVNAFINVVTSSLKAGDDVTLVGFGTFTTGDRAERQGRNPQTGKTITIPAKTVVKFKPGKALKDEV

SEQ ID NO: 2949 - protein, 110 aa, Artificial
  Alicyclobacillus acidocaldarius mutated SEQ ID NO 2942
MCCLTGLERMRDILEKERELVNKGELVAEVQARVGLPKSQVLQVLNTFCEVTTERLQAGEEVSLPPLGKFQYVMRSARRQRNPQTGEMIDVPEKATVRFRPSGALKGRVN

SEQ ID NO: 2950 - protein, 110 aa, Artificial
  Alicyclobacillus acidocaldarius mutated SEQ ID NO 2942
MCCLTGLERMRDLLEKERELVNKGELVAEVQARVGLPKSNVLQVLNTFCEVTTERLQAGEEVSLPPLGKFQYVMRSARRQRNPQTGEMIDVPEKATVRFRPSGALKGRVN

SEQ ID NO: 2951 - protein, 110 aa, Artificial
  Alicyclobacillus acidocaldarius mutated SEQ ID NO 2942
MCCLTGLERMRDLLEKERELVNKGELVAEVQARVGLPKSQVLNVLNTFCEVTTERLQAGEEVSLPPLGKFQYVMRSARRQRNPQTGEMIDVPEKATVRFRPSGALKGRVN

SEQ ID NO: 2952 - protein, 110 aa, Artificial
  Alicyclobacillus acidocaldarius mutated SEQ ID NO 2942
MCCLTGLERMKDLLEKERELVNKGELVAEVQARVGLPKSQVLQVLNTFCEVTTERLQAGEEVSLPPLGKFQYVMRSARRQRNPQTGEMIDVPEKATVRFRPSGALKGRVN

SEQ ID NO: 2953 - protein, 110 aa, Artificial
  Alicyclobacillus acidocaldarius mutated SEQ ID NO 2942
MCCLTGLERMRDLLEKERELVNKGELIAEVQARVGLPKSQVLQVLNTFCEVTTERLQAGEEVSLPPLGKFQYVMRSARRQRNPQTGEMIDVPEKATVRFRPSGALKGRVN

SEQ ID NO: 2954 - DNA, 333 bp, Artificial
  Alicyclobacillus acidocaldarius mutated SEQ ID NO 2943
ttgtgttgccttacaggtctcgaacgaatgagagatattcttgaaaaggagcgagagctcgtgaacaagggtgaactggtggcggaagttcaggcaagggtgggcttacccaagtctcaggtgttacaagtgctcaatacgttctgcgaggtgacgacggaacgattgcaagcgggtgaagaagtgtccttaccgccccttgggaaattccagtacgtgatgcgctccgcgcgtcggcaacggaatcctcagaccggcgagatgatcgacgttcccgaaaaggccacggtgcgctttcggccatccggggctttgaaggggcgtgtgaactga

SEQ ID NO: 2955 - DNA, 333 bp, Artificial
  Alicyclobacillus acidocaldarius mutated SEQ ID NO 2943
ttgtgttgccttacaggtctcgaacgaatgagagatcttcttgaaaaggagcgagagctcgtgaacaagggtgaactggtggcggaagttcaggcaagggtgggcttacccaagtctaatgtgttacaagtgctcaatacgttctgcgaggtgacgacggaacgattgcaagcgggtgaagaagtgtccttaccgccccttgggaaattccagtacgtgatgcgctccgcgcgtcggcaacggaatcctcagaccggcgagatgatcgacgttcccgaaaaggccacggtgcgctttcggccatccggggctttgaaggggcgtgtgaactga

SEQ ID NO: 2956 - DNA, 333 bp, Artificial
  Alicyclobacillus acidocaldarius mutated SEQ ID NO 2943
ttgtgttgccttacaggtctcgaacgaatgagagatcttcttgaaaaggagcgagagctcgtgaacaagggtgaactggtggcggaagttcaggcaagggtgggcttacccaagtctcaggtgttaaatgtgctcaatacgttctgcgaggtgacgacggaacgattgcaagcgggtgaagaagtgtccttaccgccccttgggaaattccagtacgtgatgcgctccgcgcgtcggcaacggaatcctcagaccggcgagatgatcgacgttcccgaaaaggccacggtgcgctttcggccatccggggctttgaaggggcgtgtgaactga

SEQ ID NO: 2957 - DNA, 333 bp, Artificial
  Alicyclobacillus acidocaldarius mutated SEQ ID NO 2943
ttgtgttgccttacaggtctcgaacgaatgaaagatcttcttgaaaaggagcgagagctcgtgaacaagggtgaactggtggcggaagttcaggcaagggtgggcttacccaagtctcaggtgttacaagtgctcaatacgttctgcgaggtgacgacggaacgattgcaagcgggtgaagaagtgtccttaccgccccttgggaaattccagtacgtgatgcgctccgcgcgtcggcaacggaatcctcagaccggcgagatgatcgacgttcccgaaaaggccacggtgcgctttcggccatccggggctttgaaggggcgtgtgaactga

SEQ ID NO: 2958 - DNA, 333 bp, Artificial
  Alicyclobacillus acidocaldarius mutated SEQ ID NO 2943
ttgtgttgccttacaggtctcgaacgaatgagagatcttcttgaaaaggagcgagagctcgtgaacaagggtgaactgattgcggaagttcaggcaagggtgggcttacccaagtctcaggtgttacaagtgctcaatacgttctgcgaggtgacgacggaacgattgcaagcgggtgaagaagtgtccttaccgccccttgggaaattccagtacgtgatgcgctccgcgcgtcggcaacggaatcctcagaccggcgagatgatcgacgttcccgaaaaggccacggtgcgctttcggccatccggggctttgaaggggcgtgtgaactga

SEQ ID NO: 2959 - protein, 211 aa, Alicyclobacillus acidocaldarius
MSSTWPQGEGGCCMYYPIPYVIEQTSRGERTYDIYSRLLKDRIVILGTPIDDQVANSIVAQLLFLAADDPEKDIQMYINSPGGSVTAGMAIYDTMQHIRPAVSTLCIGMAASMGAFLLAAGEKGKRYALPNAEIMIHQPLGGVEGQASDIKIHAEWILKTKDKLNRLLSERTGQPLEVIERDTDRDHFMTAEEAKAYGLIDEVLHPLHPVR

SEQ ID NO: 2960 - DNA, 636 bp, Alicyclobacillus acidocaldarius
ttgtcctctacatggccgcagggagagggaggctgttgcatgtattatccgattccgtacgtgatcgaacaaacgagccgcggcgagcggacgtacgacatttattctcggttgctgaaggatcggatcgtgatcctgggaacgccgatcgacgatcaggtcgcgaactcgatcgtcgcacagcttctgttcctggcggccgacgatcctgagaaagatatccagatgtacatcaacagcccaggcggttctgtgaccgcaggcatggccatatacgataccatgcaacacatccgcccggcggtgtccacgctgtgtatcggcatggccgcgagcatgggcgcgttcctgttggcggcgggcgagaagggaaaacggtatgccctgccgaatgcagagatcatgattcaccagccgctcggcggcgtcgagggccaggcttctgacatcaaaatccacgcagagtggattttgaagacgaaggataagctgaatcgcctgctttccgaacggacggggcagccgctcgaggtgatcgagagggacacggatcgcgaccacttcatgacggccgaagaggcgaaagcctacggcctgattgacgaagtgttgcatccgctgcatccggttcggtga

SEQ ID NO: 2961 - protein, 187 aa, Paenibacillus  JDR-2
VPIVVEQTNRGERSYDIYSRLLKDRIIFLGSAIDDDVANSVIAQLLFLAADDPEKDIHLYINSPGGSVTAGMAIYDTMQYIKPDVSTICMGMAASMGSLLLTAGAKGKRFALPNAEVMIHQPLGGVRGQASDIKIHADWILKTKQKLNEIYVERTGQPYEKIDRDTDRDNFMSAEDALNYGLIDKVI

SEQ ID NO: 2962 - protein, 187 aa, Bacillus licheniformis
IPTVIEQTNRGERAYDIYSRLLKDRIIMLGSAIDDNVANSIVSQLLFLEAEDPEKDISIYINSPGGSITAGMAIYDTMQFIKPQVSTICTGMAASMGAFLLAAGEKGKRYALPNSEVMIHQPLGGAQGQATEIEIAAKRILSLRDKLNKILAERTGQPLEVIERDTDRDNFKTAEEAKEYGLIDKVL

SEQ ID NO: 2963 - protein, 189 aa, Geobacillus thermodenitrificans
YLIPTVIEQTNRGERAYDIYSRLLKDRIIFLGSPIDDQVANSIVSQLLFLAAEDPEKDISLYINSPGGSITAGLAIYDTMQFIKPDVSTICIGMAASMGAFLLAAGAKGKRFALPNSEVMIHQPLGGAQGQATEIEIAAKRILFLRDKLNRILAENTGQPIEVIERDTDRDNFMTAQKAQEYGIIDRVL

SEQ ID NO: 2964 - protein, 189 aa, Geobacillus kaustophilus
YLIPTVIEQTNRGERAYDIYSRLLKDRIVFLGSPIDDQVANSIVSQLLFLAAEDPDKDISLYINSPGGSITAGLAIYDTMQFIKPDVSTICIGMAASMGAFLLAAGAKGKRFALPNSEIMIHQPLGGAQGQATEIEIAAKRILFLRDKLNRILSENTGQPIEVIERDTDRDNFMTAQKAMEYGIIDRVL

SEQ ID NO: 2965 - protein, 187 aa, Bacillus pumilus
IPTVIEQTNRGERAYDIYSRLLKDRIIMLGSAIDDNVANSIVSQLLFLEAEDPEKDISIYINSPGGSITAGMAIYDTMQFIKPKVSTICIGMAASMGAFLLAAGEKGKRYALPNSEVMIHQPLGGAQGQATEIEIAAKRILSLRDKLNQVLAERTGQPIEVIERDTDRDNFKTAEEALQYGLIDKVL

SEQ ID NO: 2966 - protein, 211 aa, Artificial
  Alicyclobacillus acidocaldarius mutated SEQ ID NO 2959
MSSTWPNGEGGCCMYYPIPYVIEQTSRGERTYDIYSRLLKDRIVILGTPIDDQVANSIVAQLLFLAADDPEKDIQMYINSPGGSVTAGMAIYDTMQHIRPAVSTLCIGMAASMGAFLLAAGEKGKRYALPNAEIMIHQPLGGVEGQASDIKIHAEWILKTKDKLNRLLSERTGQPLEVIERDTDRDHFMTAEEAKAYGLIDEVLHPLHPVR

SEQ ID NO: 2967 - protein, 211 aa, Artificial
  Alicyclobacillus acidocaldarius mutated SEQ ID NO 2959
MSSTWPQGEGGCCMYYPIPYVIEQTSRGERTYDIYSRLLKDRIVILGTPIDDQVANSIVAQLLFLAADDPEKDIQMYINSPGGSVTAGMAIYDTMQHIRPAVSTLCIGMAASMGAFLLAAGEKGKRYALPNAEIMIHQPLGGVEGQASDIKIHAEWILKTKDKLNRLLSERTGQPLEIIERDTDRDHFMTAEEAKAYGLIDEVLHPLHPVR

SEQ ID NO: 2968 - protein, 211 aa, Artificial
  Alicyclobacillus acidocaldarius mutated SEQ ID NO 2959
MSSTWPQGEGGCCMYYPIPYVIEQTSRGERTYDIYSRLLKDRIVILGTPIDDQVANSIVAQLLFLAADDPEKDIQMYINSPGGSVTAGMAIYDTMQHIRPAVSTLCIGMAASMGAFLLAAGEKGKRYALPNAEIMIHQPLGGVEGQASDIKIHAEWILKTKDKLNRLLSERTGQPLEVIERDTDRDHFMTAEEAKAYGLIDEVLHPLHPVK

SEQ ID NO: 2969 - protein, 211 aa, Artificial
  Alicyclobacillus acidocaldarius mutated SEQ ID NO 2959
MSSTWPQGEGGCCMYYPIPYVIEQTSRGERTYDIYSRLLKDRIVILGTPIDDQVANSIVAQLLFLAADDPEKDIQMYINSPGGSVTAGMAIYDTMQHIRPAVSTLCIGMAASMGAFLLAAGEKGKRYALPNAEIMIHQPLGGVEGQASDIKIHAEWILKTKDKLNRLLSERTGQPLEVIERDTDRDHFMTAEEARAYGLIDEVLHPLHPVR

SEQ ID NO: 2970 - protein, 211 aa, Artificial
  Alicyclobacillus acidocaldarius mutated SEQ ID NO 2959
MSSTWPQGEGGCCMYYPIPYVIEQTSRGERTYDIYSRLLKDRIVILGTPIDDQVANSIVAQLLFLAADDPEKDINMYINSPGGSVTAGMAIYDTMQHIRPAVSTLCIGMAASMGAFLLAAGEKGKRYALPNAEIMIHQPLGGVEGQASDIKIHAEWILKTKDKLNRLLSERTGQPLEVIERDTDRDHFMTAEEAKAYGLIDEVLHPLHPVR

SEQ ID NO: 2971 - DNA, 636 bp, Artificial
  Alicyclobacillus acidocaldarius mutated SEQ ID NO 2960
ttgtcctctacatggccgaatggagagggaggctgttgcatgtattatccgattccgtacgtgatcgaacaaacgagccgcggcgagcggacgtacgacatttattctcggttgctgaaggatcggatcgtgatcctgggaacgccgatcgacgatcaggtcgcgaactcgatcgtcgcacagcttctgttcctggcggccgacgatcctgagaaagatatccagatgtacatcaacagcccaggcggttctgtgaccgcaggcatggccatatacgataccatgcaacacatccgcccggcggtgtccacgctgtgtatcggcatggccgcgagcatgggcgcgttcctgttggcggcgggcgagaagggaaaacggtatgccctgccgaatgcagagatcatgattcaccagccgctcggcggcgtcgagggccaggcttctgacatcaaaatccacgcagagtggattttgaagacgaaggataagctgaatcgcctgctttccgaacggacggggcagccgctcgaggtgatcgagagggacacggatcgcgaccacttcatgacggccgaagaggcgaaagcctacggcctgattgacgaagtgttgcatccgctgcatccggttcggtga

SEQ ID NO: 2972 - DNA, 636 bp, Artificial
  Alicyclobacillus acidocaldarius mutated SEQ ID NO 2960
ttgtcctctacatggccgcagggagagggaggctgttgcatgtattatccgattccgtacgtgatcgaacaaacgagccgcggcgagcggacgtacgacatttattctcggttgctgaaggatcggatcgtgatcctgggaacgccgatcgacgatcaggtcgcgaactcgatcgtcgcacagcttctgttcctggcggccgacgatcctgagaaagatatccagatgtacatcaacagcccaggcggttctgtgaccgcaggcatggccatatacgataccatgcaacacatccgcccggcggtgtccacgctgtgtatcggcatggccgcgagcatgggcgcgttcctgttggcggcgggcgagaagggaaaacggtatgccctgccgaatgcagagatcatgattcaccagccgctcggcggcgtcgagggccaggcttctgacatcaaaatccacgcagagtggattttgaagacgaaggataagctgaatcgcctgctttccgaacggacggggcagccgctcgagattatcgagagggacacggatcgcgaccacttcatgacggccgaagaggcgaaagcctacggcctgattgacgaagtgttgcatccgctgcatccggttcggtga

SEQ ID NO: 2973 - DNA, 636 bp, Artificial
  Alicyclobacillus acidocaldarius mutated SEQ ID NO 2960
ttgtcctctacatggccgcagggagagggaggctgttgcatgtattatccgattccgtacgtgatcgaacaaacgagccgcggcgagcggacgtacgacatttattctcggttgctgaaggatcggatcgtgatcctgggaacgccgatcgacgatcaggtcgcgaactcgatcgtcgcacagcttctgttcctggcggccgacgatcctgagaaagatatccagatgtacatcaacagcccaggcggttctgtgaccgcaggcatggccatatacgataccatgcaacacatccgcccggcggtgtccacgctgtgtatcggcatggccgcgagcatgggcgcgttcctgttggcggcgggcgagaagggaaaacggtatgccctgccgaatgcagagatcatgattcaccagccgctcggcggcgtcgagggccaggcttctgacatcaaaatccacgcagagtggattttgaagacgaaggataagctgaatcgcctgctttccgaacggacggggcagccgctcgaggtgatcgagagggacacggatcgcgaccacttcatgacggccgaagaggcgaaagcctacggcctgattgacgaagtgttgcatccgctgcatccggttaaatga

SEQ ID NO: 2974 - DNA, 636 bp, Artificial
  Alicyclobacillus acidocaldarius mutated SEQ ID NO 2960
ttgtcctctacatggccgcagggagagggaggctgttgcatgtattatccgattccgtacgtgatcgaacaaacgagccgcggcgagcggacgtacgacatttattctcggttgctgaaggatcggatcgtgatcctgggaacgccgatcgacgatcaggtcgcgaactcgatcgtcgcacagcttctgttcctggcggccgacgatcctgagaaagatatccagatgtacatcaacagcccaggcggttctgtgaccgcaggcatggccatatacgataccatgcaacacatccgcccggcggtgtccacgctgtgtatcggcatggccgcgagcatgggcgcgttcctgttggcggcgggcgagaagggaaaacggtatgccctgccgaatgcagagatcatgattcaccagccgctcggcggcgtcgagggccaggcttctgacatcaaaatccacgcagagtggattttgaagacgaaggataagctgaatcgcctgctttccgaacggacggggcagccgctcgaggtgatcgagagggacacggatcgcgaccacttcatgacggccgaagaggcgcgtgcctacggcctgattgacgaagtgttgcatccgctgcatccggttcggtga

SEQ ID NO: 2975 - DNA, 636 bp, Artificial
  Alicyclobacillus acidocaldarius mutated SEQ ID NO 2960
ttgtcctctacatggccgcagggagagggaggctgttgcatgtattatccgattccgtacgtgatcgaacaaacgagccgcggcgagcggacgtacgacatttattctcggttgctgaaggatcggatcgtgatcctgggaacgccgatcgacgatcaggtcgcgaactcgatcgtcgcacagcttctgttcctggcggccgacgatcctgagaaagatatcaatatgtacatcaacagcccaggcggttctgtgaccgcaggcatggccatatacgataccatgcaacacatccgcccggcggtgtccacgctgtgtatcggcatggccgcgagcatgggcgcgttcctgttggcggcgggcgagaagggaaaacggtatgccctgccgaatgcagagatcatgattcaccagccgctcggcggcgtcgagggccaggcttctgacatcaaaatccacgcagagtggattttgaagacgaaggataagctgaatcgcctgctttccgaacggacggggcagccgctcgaggtgatcgagagggacacggatcgcgaccacttcatgacggccgaagaggcgaaagcctacggcctgattgacgaagtgttgcatccgctgcatccggttcggtga

SEQ ID NO: 2976 - protein, 954 aa, Alicyclobacillus acidocaldarius
MYVVPKVKAPKKLIEVTLPLDDINAEAAREKSIRHGHPSTLHLWWARRPLAAARAVLFAQLVNDPGGERGYKPGMTREQAQKERERLFGIMRRLVKWENSNDEEVLREAREEIWKSWRETCEMNKGLPGFDPDKLPAFHDPFAGGGSIPLEAQRLGLEAYASDLNPVAVLINKALIEIPPKFSGRPPVNPEARSKVGLLEQEWKGASGLADDIRYYGEWMRDEAFKRIGHLYPQVELPPEYGGGKATVIAWIWARTVKSPNPAYSHVDVPLVRSFWLSTKKGKEVWVEPVIHEDGSGYHFEVRTEGKPKIEGTVNRRGGTCIMSGSPIPFDYIRAEGKAERMGQRLMTVVVEGPRGRLYIAPTDDMEGMALSLKEPDGLPQTQLPKRALGFRVQEYGMTMHKHLFTNRQLVALKTFSDLVVEAREKVYEDALSSGMTDDGIGLEDGGIGARAYADAVAVYLGLVLDKCADYWSSICSWNSPKELVRNTFSRQAIPMVWDFAEANPFSDSTGNWMGMVDWVWKAVENAPIKTTLGEAHLADAQTQSISVGKIVSTDPPYYDNVGYSDLSDFFYVWLRRSLNPILPGLFATLMTPKEDELVAAPERHQSKGDANSFFIHGMSKAMSTLANSTHPGFPVTIYYAFKQSDTENEGTSSEGWVAFLEALLQAGFAVTGTWPLRTEMSNRMRGLDSNALASSIVIVCRRRPANAETISRRAFLRELNTVIPDALSDMMHGGPDRSPIAAVDLQQAAIGPGMAVFSKYAAVLEADGSPMTVKTALQLINRVVDAYLHASEAEVDADTLFCINWFDQFGWSEADFGRADVLARAKGTSVDAVRAAGVLTADHGKVRLLRWQDYPSDWSPGKDYDTPVWEALHHLIRALQQDGEQAAGALLAGMYSVSESIRSLAYRLYTLCERKGWAEDARAYNELIASWDAIAEVAQKAGLSGSQLTLDVE

SEQ ID NO: 2977 - DNA, 2865 bp, Alicyclobacillus acidocaldarius
gtgtacgtcgtgccaaaggtgaaggcacccaagaagctcattgaggtgacactgccgcttgatgatatcaacgccgaagccgcaagggagaaatccattcgccacggccatccttccactctgcatttgtggtgggcgcgccgccccttggctgcagcacgggccgtattgtttgcgcagctggtgaacgatcccggcggtgaacgcggctacaaacccggcatgacgagagaacaggcgcaaaaggaacgcgagcgtctgttcggaatcatgcgccggttggtgaagtgggagaactcgaacgacgaagaagtcttgcgcgaagctcgtgaagagatttggaagagctggcgggagacttgcgagatgaacaaggggttgccgggatttgatccggacaagctgcccgcttttcacgatccgttcgcgggcggcggctctattccgcttgaggcccaacgtttaggactggaagcctatgcatcggacctgaatccggtggccgtcttgatcaacaaggcgctcatcgaaattccgccgaagttctcgggcagacctcctgtcaatccagaggcgcggtccaaagtgggactgcttgagcaggagtggaaaggtgcaagtggattggcggacgacattcgttactacggagagtggatgcgcgacgaagcattcaagcgcatcggtcacctgtatccgcaggtggaattgccccccgaatacggaggagggaaggccacggtcatcgcgtggatttgggcacgaacggtaaagagcccaaatccggcgtacagtcatgtggatgtacctttggttcgctcattttggctatctaccaaaaagggaaaggaagtatgggttgaacctgtcattcacgaggatggctctggctatcattttgaggtgcggacggaaggtaagccgaagattgaaggcactgtgaatcgccgtggcgggacatgcatcatgtctggttcaccgataccgtttgactacattcgtgcggaaggaaaggcagagcgaatgggtcagcggctcatgacggtagtggtggagggtccgcggggcaggctctacatcgcaccgaccgatgacatggaaggcatggcacttagcttgaaggagccagatggtttgccacagactcaattgccgaaacgtgcgctcggattccgtgtccaagaatatgggatgacgatgcacaaacatttgtttacgaaccgacagcttgttgccctcaaaaccttttctgatctcgttgtagaggcgcgggaaaaggtgtacgaggatgcacttagcagcgggatgacggacgatggaatagggcttgaggatggcggaattggtgcgcgcgcatatgcggatgcggtggcggtgtatttaggtcttgtcttggataagtgtgctgactattggtcgtctatatgtagctggaattctccgaaggaactcgttaggaacacgttttccagacaagccatccccatggtatgggattttgctgaggcgaaccctttttcggactcgacgggaaactggatgggcatggtggattgggtgtggaaagcagtagagaatgctccgattaagacaactttaggcgaagctcatctggcagatgcacagacacagtctataagtgtaggcaaaattgtttcgacggatcctccatactatgacaatgttggatattcagacctgtcagactttttttacgtgtggttgcgtcgatctctgaatccgattcttcctggactattcgcaacattgatgacacccaaagaggatgaattagtggccgcgcctgagcgtcatcagtccaagggcgatgccaattcattcttcatacacggcatgtccaaggcgatgtcgaccttggcaaattcaacgcaccccggctttccggttacaatctattacgcattcaagcagtcagatacagagaacgaggggacttcctcggaaggttgggttgcgttcctcgaagcccttcttcaagcgggatttgccgttaccggtacatggcccttgcggaccgaaatgtcaaatcgcatgcgtggtttagattcaaatgcccttgcttcttccatagtcattgtgtgccgtcggcggcccgccaacgctgagacaatatcgcggagagcatttctgagggaattgaacacggttatccctgatgctctatcggacatgatgcacggcggcccagaccgctctcccatcgccgcagtcgatctccaacaagcggcaattggacccggtatggccgtattctcgaagtacgccgcggtacttgaggcagatgggtccccgatgacagtgaagacggctttgcagttaatcaatcgggtggttgacgcttatttgcatgcctccgaagcggaggtcgacgccgacacgttgttttgcattaactggtttgaccaattcggatggtctgaggccgactttggtcgtgcggacgttttggcgcgtgccaaggggacgagcgtggatgcggtacgcgctgcgggggttctgactgcggatcacggcaaggtccgattgctgcggtggcaggattacccgtccgattggagtccgggcaaggactatgacacacccgtgtgggaggcgcttcatcatctgattcgtgctctacagcaggatggggagcaggctgcaggagcgctgcttgcgggcatgtacagtgtttccgagtctatccgctcattggcgtatcggctctatacattgtgtgagcgcaagggatgggcggaggatgcaagggcctataacgaactgatcgcgagctgggatgccattgctgaagtggcccaaaaggctgggctgtcgggttcccaattgactctggatgtggaatag

SEQ ID NO: 2978 - protein, 959 aa, Magnetococcus  MC-1
IKAPKKLIEVALPLDDINAAAAREKSIRHGHPSTLHLWWARRPLAAARAVLFAQMVNDPGGERGYYAGKTKAQADAEREELFKIIRELVLWENTNNEEVLNKARAAIRKSWRETCELNKGKSGFDPDKLPAFHDPFAGGGAIPLEAQRLGMESHASDLNPVAVLINKAMIEIPPKFAGRKPVGPIPEGEKQGRMESDWPGATGLAEDVRRYGHWMREEAFKRIGHLYPQVEITAEMAKERPDLKGIVGQKLTVIAWLWARTVRSPNPAFSHIAVPLVSSFLLSTKKGKEAYIEPVVDANSYYFSVKKGTPSKDSARGTSAGKRGGFRCIFSDAPIDYNYIRDEGSAGRIGTRLMAIVAEGVRGRIYLSATPELEIIANSAKPEWSPDVKLHGKCRVNVSNYGLDVYSDLFTPRQLVALTTFSNLVQEARVKAVNDAKITGMADDGMGIDEGGFGAGAYGDAVAVYLGFIVDKVSESLSTICTWSSSPKNELIVSTFRRQAIPMTWDFGEANPFANSSGSLEKIVPAVSKVIKTSLCGSVDGNAIQFDARTVNLSDRVVSTDPPYYDNIGYADLSDFFYVWSRRALKSIFPSLYSTLAVPKAEELVATPYRHGSKEEAEAFFMNGMICAINNFANQAHPSFPVTIYYAFKQSETKETGTTSTGWETFLEAVIQAGFGITGTWPMRTERGARSIGIGANALASSIILVCRKRDNSAESISRRQFQRELREILPEALETMIGGKEGASPVAPVDLAQASIGPGMAVYSKYAAVLNQDGNPMSVHDALILINREITDFLTPDSGSFDNDTLFCSTWFDQYGWKAGPFGEADTLSRAKGTSVDGVQEAGVVQSGGGKVRLFKWDEYPDDWDPKKDNRTPVWEALHHLIRALNKDGESVSGGLLARMPERAEAIRQLAYHLYTLCERKKWADDARAYNELITSWHGIAAASHEVGHLGTQCTLDL

SEQ ID NO: 2979 - protein, 966 aa, Nitrosococcus oceani
EIKTPKKLIEVALPLDDINTAAAREKSIRHGHPSTLHLWWARRPLAAARAVLFAQMVNDPGYQQGEGFKYGVNKKEAEIKREKLFQIIRDLVKWENTNNEEVLNRAREAIWESWRETCHLNRNHPQAAELFNPDKLPAFHDPFAGGGAIPLEAQRLGLESYASDLNPVAVMINKAMIEIPPKFAGQRPVGPLPQGEKQGKLMDDWSGARGLAEDVRRYGHWMREEAFERIGNLYPRIKITQEMVAERPDLKPYQGQELTVIAWLWARTVKSPNPAFSHADIPLASSFLLSTKKGKESYVNPLVEGHNYQFEVCMGVPPAEARNGTKLGRGANFTCLLSDTPIDPKYIYAQAQSGNLGQRLMAVVAEGKSGRIYLTPTAEMEQAASAASPDWKPDALMPENPRWFSPPMYGMKSYGDLFTPRQLVALNTFSDLVQEACYKAIADAKAAGMTDDGIGIDDGGRGATAYGDALAVYLTFAINKLADRGSTICTWDSSRSSTRNTFGRQAIPMTWDFAEPNPLSDSTGNFMGGIGWANDVLSRMIPSSGGIAVQQDAATQNISAEKVISTDPPYYDNIGYADLSDFFYVWMRRSLKSFYPSLFATMAVPKAEELVAIPYRHGTKEKAETFFLDGMTQAIHNMADKGHPAFPVSIYYAFKQSETKEGATSNTGWETFLEAVIRAGFSIDGTWPMRTEMSNRMIGSGTNALASSVVLVCKKREIEAESISRRDFQRELREQMPDALEAMIGGETGTTPIAPVDLAQAAIGPGMAIFSKYEAVLNQDGSRMSVHDALILINRAITEYLSPESGSFDADTQFCSSWFDQYGWSTGPFGEANVLAQAKGTTVDGVNTAGVVESGGGKVRLLKWAEYEADWDPIKDNRTPIWEACHQMIRSLNNQGESAAGELLAKMPEKGEPIRQLAYHLYTLCERKKWAEDARAYNELIGSWHAIVTASHEVGHSGSQAELGLD

SEQ ID NO: 2980 - protein, 951 aa, Sinorhizobium meliloti
VRTPKKLIEVALPLDAINEAAAREKSIRHGHPSTLHLWWARRPLAAARAVIFAQMVNDPSWKWELEHPGEIPPNNIKASWAASRNRLFAIIKDLVEWENTTNEVVLEKARAEIRKSWRETCDLNKDHPQAAGLFNPERLPAFHDPFAGGGALPLEAQRLGLASYASDLNPVAVLINKATIEIPPKFAGRPPVNPEARTSRDAWSKQWFRAQGLAEDVRYYGRWMRMVAQKRIGHLYPPVEITSDMAKERPDLRPLVGQQLTVIAWLWARTVKSPNPAFRHVDVPLASSFVLSTKTGAEAYVDPVIDKDTYHFAVRSGRAPSQAREGTKFSRGNFRCLLSQAPIDGDYIKAEAKAGRMGERLMAIVAEGRNGRIYLSPSSDQENIASAAHPDWKPDVEFFQQALGFRVGNYGMTKWSDLFTARQLVALTTFTELIAEVRKQIVADAIAAGMIDDQTGLDKGGEGASAYAEAVSVYLAIALSRLTDICNALCRWEVTKTQVRNLFSRQAIPMLWDFAENNVFGGAAGDYIISLGNMVKALEKLPARDPGVSRQQDAQTQSISAGKAISTDPPYYDNIGYADLSDFFYVWLREPLRSIYPGLFATVVTPKAEELVATPARHGGSEAAELFFLGGMTAAMQRLAELAHPSTPVTIYYAFKQSETESDTGTSSTGWETFLDAVIRSGLALTGTWPMRTELGNRMRGQDSNALASSIVMVCRPRPATAETVSRRAFLRELNQVLPEALDEMTRGSGDDRSPVAPVDLSQAIIGPGMAVFSKYAAVLEADGTPMTVQAALRLINRFLAEDDFDHDSQFCLHWFEQYGWKEGRFGEADTLARAKGTSVDGVKQSGVIYASGGIVRLLKWAEYPSDWDPVGDGRLPVWEALHHLIRIFKSEGESGAGNVLAAVAAKAEPARQLAYRLYTLCERAGWAEDARAYNDIITSWSAIESAAAAA

SEQ ID NO: 2981 - protein, 1009 aa, Methylococcus capsulatus
VKAPKKLIEVALPLDAINEASAREKSIRHGHPSTLHLWWARRPLAAARAVIFAQMVNDPGYQQGGGFRYGVNKEKAQLERERLFKIIEELVQWENTNNEAVLSRARAEIWKSWRETCELNKNHPCAAELFNPDKLPAFHDPFAGGGAIPLEAQRLGLESYASDLNPVAVTINKAMIEIPPRFAGRAPVGPVPPSPDGRGVGGEGLFAQDWAGAKGLAEDVRRYGAWMRSEAEKRIGHLYPQVEVTRELAQGRQDLQPLVGQKLTVIAWLWARTVKSPNPAFSHVEVPLASTFVLSSKAGKEAYVQPMISPLPLGEGLGVRAGSEGYYRFTVQVAGTPGFDKADYARAKSGTKLARGANFECLLSNTPIEPNHIYTEANAGRMGARLMAIVAEGARGRVYLPPLPEHEAIARQAQPEWKPEVAMPDNPRWFSPPLYGLKNYGDLFTPRQLVALTTFSDLVIDAIERCRRDAAAAGLPDDGVPLDAGGTGATAYAQAVGVYLAIAISRFSDRNNSICTWDSGPTGTKASTGGSARTASLRNLFARQAIPMAWDFGEANPFSDSGGGFSSAFEWIEPAVRSLRGGCAGYGDGADAQTQTLSRDKVVSTDPPYYDNIGYADLSDFFYVWLRRSLKPIFPGLYATLAVPKAEELVATPYRHGSKEAAEAFFLDGMRRALKNLAEQAHPAFPVTIYYAFKQSETTDAAGTSSTGWETFLQAVLDAGFALTGTWPMRTELGNRMIGAGTNALASSIVLVCRQRATDAPTASRREFLRELNATLPEAIADMIGADPSPQPLSPRERGYGRVAPVDLSQAIIGPGMAIFSQYAAVLEADGTPMTVKTALALINRFLAEDDFDHDTQFCLHWFEQQGWASGKYGEADVLARAKGTAVDALVAAGVAESAKGSVRLLKWPEYPADWSPESDTRTPIWEALHQLIRALNQAGETEAGRLLARMPARAEPIRALAYRLYTLCERKGWAEDARAYNELVTAWSGIEQAANEAGVVGAQMQLEL

SEQ ID NO: 2982 - protein, 950 aa, Chlorobium phaeobacteroides
IKSPRKLIEVALPLDAINAACAYEKMPGIGAHPRGIHLWWARRPLAAARAVLFAQLVNDPGYQQGCGFKYGKNKKEAAIERKRLFKIIEELVLWENTTNEEVLERARVEIRRSWREVCELNKEHPQAAELFNPEKMPAFHDPFAGGGAIPLEAQRLGLEAYASDLNPVAVLINKAMIEIPPKFAGRPPVGPEIENKQGKSLELPKIWPGATGLAEDVRRYGSWMRDEAQKRIGHLYPPVEVTEEMARERSDLKPLVGKKLTVIAWLWTRTVKSPNPAFTHVNVPLVSSYILANKDGKEVYVKPVIEGDKYYFLIKNGTPTTEAKDGTKATVRGANFRCIVSGAVIGSDYIKTEGKAGRIGQRLMAIVAEGTRGRVYLPPTLDAETVAKDAAPTWRPSGDVPERLTGGTCVPYGLKEWGDIFTPRQLVALTILSDLLSEVRELVREDALASGLSDSEKGLGDGGSGVIAYAEAVSVYLAFAINRCADFCNSVTRWVPGNQKVMNLFGKQAIPMTWDYPEAAILADTVGGFAPASKYVADCIGKLSPAAVGFASQADAQTQSISMAKIISTDPPYYDNIAYADLSDFFYVWLRKSLRLFLPGLFSTITVPKVEELVAAPYRHGTKQKAETFFLTGMTEAIHNLAEQAHPEGPVTIYYAFKQSETSGQDGTSSPGWVTFLSAVLSAGFAIVGTWPLRSEQEFRMIGMGANALASSIVLVCRKRSADAPSVSRREFIRELNGVLPEALDEMTKGSGEERSPVAPVDLSQAIIGPGMAVFSKYSAVLEADGTPMSVRTALQLINRFLAEDDFDPDTQFCLHWFEQYGWNENLFGEADVLARSKSTSVDAMKEAGVLQSGSGKVRLLKWAEYPSDWDPRTDKRMPVWEALHQLIRALKQGGESASGALLAALGGKAEAVRQLAYRLYTLCERLGQAEDARAYNELITSWTGIESVA

SEQ ID NO: 2983 - protein, 954 aa, Artificial
  Alicyclobacillus acidocaldarius mutated SEQ ID NO 2976
MYVVPKVKAPKKLIEVTLPLDDINAEAAREKSIRHGHPSTLHLWWARRPLAAARAVLFAQLVNDPGGERGYKPGMTREQAQKERERLFGIMRRLVKWENSNDEEVLREAREEIWKSWRETCEMNKGLPGFDPDKLPAFHDPFAGGGSIPLEAQRLGLEAYASDLNPVAVLINKALIEIPPKFSGRPPVNPEARSKVGLLEQEWKGASGLADDIRYYGEWMRDEAFKRIGHLYPQVELPPEYGGGKATVIAWIWARTVKSPNPAYSHVDVPLVRSFWLSTKKGREVWVEPVIHEDGSGYHFEVRTEGKPKIEGTVNRRGGTCIMSGSPIPFDYIRAEGKAERMGQRLMTVVVEGPRGRLYIAPTDDMEGMALSLKEPDGLPQTQLPKRALGFRVQEYGMTMHKHLFTNRQLVALKTFSDLVVEAREKVYEDALSSGMTDDGIGLEDGGIGARAYADAVAVYLGLVLDKCADYWSSICSWNSPKELVRNTFSRQAIPMVWDFAEANPFSDSTGNWMGMVDWVWKAVENAPIKTTLGEAHLADAQTQSISVGKIVSTDPPYYDNVGYSDLSDFFYVWLRRSLNPILPGLFATLMTPKEDELVAAPERHQSKGDANSFFIHGMSKAMSTLANSTHPGFPVTIYYAFKQSDTENEGTSSEGWVAFLEALLQAGFAVTGTWPLRTEMSNRMRGLDSNALASSIVIVCRRRPANAETISRRAFLRELNTVIPDALSDMMHGGPDRSPIAAVDLQQAAIGPGMAVFSKYAAVLEADGSPMTVKTALQLINRVVDAYLHASEAEVDADTLFCINWFDQFGWSEADFGRADVLARAKGTSVDAVRAAGVLTADHGKVRLLRWQDYPSDWSPGKDYDTPVWEALHHLIRALQQDGEQAAGALLAGMYSVSESIRSLAYRLYTLCERKGWAEDARAYNELIASWDAIAEVAQKAGLSGSQLTLDVE

SEQ ID NO: 2984 - protein, 954 aa, Artificial
  Alicyclobacillus acidocaldarius mutated SEQ ID NO 2976
MYVVPKVKAPKKLIEVTLPLDDINAEAAREKSIRHGHPSTLHLWWARRPLAAARAVLFAQLVNDPGGERGYKPGMTREQAQKERERLFGIMRRLVKWENSNDEEVLREAREEIWKSWRETCEMNKGLPGFDPDKLPAFHDPFAGGGSIPLEAQRLGLEAYASDLNPVAVLINKALIEIPPKFSGRPPVNPEARSKVGLLEQEWKGASGLADDIRYYGEWMRDEAFKRIGHLYPQVELPPEYGGGKATVIAWIWARTVKSPNPAYSHVDVPLVRSFWLSTKKGKEVWVEPVIHEDGSGYHFEVRTEGKPKIEGTVNRRGGTCIMSGSPIPFDYIRAEGKAERMGNRLMTVVVEGPRGRLYIAPTDDMEGMALSLKEPDGLPQTQLPKRALGFRVQEYGMTMHKHLFTNRQLVALKTFSDLVVEAREKVYEDALSSGMTDDGIGLEDGGIGARAYADAVAVYLGLVLDKCADYWSSICSWNSPKELVRNTFSRQAIPMVWDFAEANPFSDSTGNWMGMVDWVWKAVENAPIKTTLGEAHLADAQTQSISVGKIVSTDPPYYDNVGYSDLSDFFYVWLRRSLNPILPGLFATLMTPKEDELVAAPERHQSKGDANSFFIHGMSKAMSTLANSTHPGFPVTIYYAFKQSDTENEGTSSEGWVAFLEALLQAGFAVTGTWPLRTEMSNRMRGLDSNALASSIVIVCRRRPANAETISRRAFLRELNTVIPDALSDMMHGGPDRSPIAAVDLQQAAIGPGMAVFSKYAAVLEADGSPMTVKTALQLINRVVDAYLHASEAEVDADTLFCINWFDQFGWSEADFGRADVLARAKGTSVDAVRAAGVLTADHGKVRLLRWQDYPSDWSPGKDYDTPVWEALHHLIRALQQDGEQAAGALLAGMYSVSESIRSLAYRLYTLCERKGWAEDARAYNELIASWDAIAEVAQKAGLSGSQLTLDVE

SEQ ID NO: 2985 - protein, 954 aa, Artificial
  Alicyclobacillus acidocaldarius mutated SEQ ID NO 2976
MYVVPKVKAPKKLIEVTLPLDDINAEAAREKSIRHGHPSTLHLWWARRPLAAARAVLFAQLVNDPGGERGYKPGMTREQAQKERERLFGIMRRLVKWENSNDEEVLREAREEIWKSWRETCEMNKGLPGFDPDKLPAFHDPFAGGGSIPLEAQRLGLEAYASDLNPVAVLINKALIEIPPKFSGRPPVNPEARSKVGLLEQEWKGASGLADDIRYYGEWMRDEAFKRIGHLYPQVELPPEYGGGKATVIAWIWARTVKSPNPAYSHVDVPLVRSFWLSTKKGKEVWVEPVIHEDGSGYHFEVRTEGKPKIEGTVNRRGGTCIMSGSPIPFDYIRAEGKAERMGQRLMTVVVEGPRGRLYIAPTDDMEGMALSLKEPDGLPQTQLPKRALGFRVQEYGMTMHKHLFTNRQLVALKTFSDLVVEAREKVYEDALSSGMTDDGIGLEDGGIGARAYADAVAVYLGLVLDKCADYWSSICSWNSPKELVRNTFSRQAIPMVWDFAEANPFSDSTGNWMGMVDWVWKAVENAPIKTTLGEAHLADAQTQSISVGKIVSTDPPYYDNVGYSDLSDFFYVWLRRSLNPILPGLFATLMTPKEDELVAAPERHQSKGDANSFFIHGMSKAMSTLANSTHPGFPVTIYYAFKQSDTENEGTSSEGWVAFLEALLNAGFAVTGTWPLRTEMSNRMRGLDSNALASSIVIVCRRRPANAETISRRAFLRELNTVIPDALSDMMHGGPDRSPIAAVDLQQAAIGPGMAVFSKYAAVLEADGSPMTVKTALQLINRVVDAYLHASEAEVDADTLFCINWFDQFGWSEADFGRADVLARAKGTSVDAVRAAGVLTADHGKVRLLRWQDYPSDWSPGKDYDTPVWEALHHLIRALQQDGEQAAGALLAGMYSVSESIRSLAYRLYTLCERKGWAEDARAYNELIASWDAIAEVAQKAGLSGSQLTLDVE

SEQ ID NO: 2986 - protein, 954 aa, Artificial
  Alicyclobacillus acidocaldarius mutated SEQ ID NO 2976
MYVVPKVKAPKKLIEVTLPLDDINAEAAREKSIRHGHPSTLHLWWARRPLAAARAVLFAQLVNDPGGERGYKPGMTREQAQKERERLFGIMRRLVKWENSNDEEVLREAREEIWKSWRETCEMNKGLPGFDPDKLPAFHDPFAGGGSIPLEAQRLGLEAYASDLNPVAVLINKALIEIPPKFSGRPPVNPEARSKVGLLEQEWKGASGLADDIRYYGEWMRDEAFKRIGHLYPQVELPPEYGGGKATVIAWIWARTVKSPNPAYSHVDVPLVRSFWLSTKKGKEVWVEPVIHEDGSGYHFEVRTEGKPKIEGTVNRRGGTCIMSGSPIPFDYIRAEGKAERMGQRLMTVVVEGPRGRLYIAPTDDMEGMALSLKEPDGLPQTQLPKRALGFRVQEYGMTMHKHLFTNRQLVALKTFSDLVVEAREKVYEDALSSGMTDDGIGLDDGGIGARAYADAVAVYLGLVLDKCADYWSSICSWNSPKELVRNTFSRQAIPMVWDFAEANPFSDSTGNWMGMVDWVWKAVENAPIKTTLGEAHLADAQTQSISVGKIVSTDPPYYDNVGYSDLSDFFYVWLRRSLNPILPGLFATLMTPKEDELVAAPERHQSKGDANSFFIHGMSKAMSTLANSTHPGFPVTIYYAFKQSDTENEGTSSEGWVAFLEALLQAGFAVTGTWPLRTEMSNRMRGLDSNALASSIVIVCRRRPANAETISRRAFLRELNTVIPDALSDMMHGGPDRSPIAAVDLQQAAIGPGMAVFSKYAAVLEADGSPMTVKTALQLINRVVDAYLHASEAEVDADTLFCINWFDQFGWSEADFGRADVLARAKGTSVDAVRAAGVLTADHGKVRLLRWQDYPSDWSPGKDYDTPVWEALHHLIRALQQDGEQAAGALLAGMYSVSESIRSLAYRLYTLCERKGWAEDARAYNELIASWDAIAEVAQKAGLSGSQLTLDVE

SEQ ID NO: 2987 - protein, 954 aa, Artificial
  Alicyclobacillus acidocaldarius mutated SEQ ID NO 2976
MYVVPKVKAPKKLIEVTLPLDDINAEAAREKSIRHGHPSTLHLWWARRPLAAARAVLFAQLVNDPGGERGYKPGMTREQAQKERERLFGIMRRLVKWENSNDEEVLREAREEIWKSWRETCEMNKGLPGFDPDKLPAFHDPFAGGGSIPLEAQRLGLEAYASDLNPVAVLINKALIEIPPKFSGRPPVNPEARSKVGLLEQEWKGASGLADDIRYYGEWMRDEAFKRIGHLYPQVELPPEYGGGKATVIAWIWARTVKSPNPAYSHVDVPLVRSFWLSTKKGKEVWVEPVIHEDGSGYHFEVRTEGKPKIEGTVNRRGGTCIMSGSPIPFDYIRAEGKAERMGQRLMTVVVEGPRGRLYIAPTDDMEGMALSLKEPDGLPQTQLPKRALGFRVQEYGMTMHKHLFTNRQLVALKTFSDLVVEAREKVYEDALSSGMTDDGIGLEDGGIGARAYADAVAVYLGLILDKCADYWSSICSWNSPKELVRNTFSRQAIPMVWDFAEANPFSDSTGNWMGMVDWVWKAVENAPIKTTLGEAHLADAQTQSISVGKIVSTDPPYYDNVGYSDLSDFFYVWLRRSLNPILPGLFATLMTPKEDELVAAPERHQSKGDANSFFIHGMSKAMSTLANSTHPGFPVTIYYAFKQSDTENEGTSSEGWVAFLEALLQAGFAVTGTWPLRTEMSNRMRGLDSNALASSIVIVCRRRPANAETISRRAFLRELNTVIPDALSDMMHGGPDRSPIAAVDLQQAAIGPGMAVFSKYAAVLEADGSPMTVKTALQLINRVVDAYLHASEAEVDADTLFCINWFDQFGWSEADFGRADVLARAKGTSVDAVRAAGVLTADHGKVRLLRWQDYPSDWSPGKDYDTPVWEALHHLIRALQQDGEQAAGALLAGMYSVSESIRSLAYRLYTLCERKGWAEDARAYNELIASWDAIAEVAQKAGLSGSQLTLDVE

SEQ ID NO: 2988 - DNA, 2865 bp, Artificial
  Alicyclobacillus acidocaldarius mutated SEQ ID NO 2977
gtgtacgtcgtgccaaaggtgaaggcacccaagaagctcattgaggtgacactgccgcttgatgatatcaacgccgaagccgcaagggagaaatccattcgccacggccatccttccactctgcatttgtggtgggcgcgccgccccttggctgcagcacgggccgtattgtttgcgcagctggtgaacgatcccggcggtgaacgcggctacaaacccggcatgacgagagaacaggcgcaaaaggaacgcgagcgtctgttcggaatcatgcgccggttggtgaagtgggagaactcgaacgacgaagaagtcttgcgcgaagctcgtgaagagatttggaagagctggcgggagacttgcgagatgaacaaggggttgccgggatttgatccggacaagctgcccgcttttcacgatccgttcgcgggcggcggctctattccgcttgaggcccaacgtttaggactggaagcctatgcatcggacctgaatccggtggccgtcttgatcaacaaggcgctcatcgaaattccgccgaagttctcgggcagacctcctgtcaatccagaggcgcggtccaaagtgggactgcttgagcaggagtggaaaggtgcaagtggattggcggacgacattcgttactacggagagtggatgcgcgacgaagcattcaagcgcatcggtcacctgtatccgcaggtggaattgccccccgaatacggaggagggaaggccacggtcatcgcgtggatttgggcacgaacggtaaagagcccaaatccggcgtacagtcatgtggatgtacctttggttcgctcattttggctatctaccaaaaagggacgtgaagtatgggttgaacctgtcattcacgaggatggctctggctatcattttgaggtgcggacggaaggtaagccgaagattgaaggcactgtgaatcgccgtggcgggacatgcatcatgtctggttcaccgataccgtttgactacattcgtgcggaaggaaaggcagagcgaatgggtcagcggctcatgacggtagtggtggagggtccgcggggcaggctctacatcgcaccgaccgatgacatggaaggcatggcacttagcttgaaggagccagatggtttgccacagactcaattgccgaaacgtgcgctcggattccgtgtccaagaatatgggatgacgatgcacaaacatttgtttacgaaccgacagcttgttgccctcaaaaccttttctgatctcgttgtagaggcgcgggaaaaggtgtacgaggatgcacttagcagcgggatgacggacgatggaatagggcttgaggatggcggaattggtgcgcgcgcatatgcggatgcggtggcggtgtatttaggtcttgtcttggataagtgtgctgactattggtcgtctatatgtagctggaattctccgaaggaactcgttaggaacacgttttccagacaagccatccccatggtatgggattttgctgaggcgaaccctttttcggactcgacgggaaactggatgggcatggtggattgggtgtggaaagcagtagagaatgctccgattaagacaactttaggcgaagctcatctggcagatgcacagacacagtctataagtgtaggcaaaattgtttcgacggatcctccatactatgacaatgttggatattcagacctgtcagactttttttacgtgtggttgcgtcgatctctgaatccgattcttcctggactattcgcaacattgatgacacccaaagaggatgaattagtggccgcgcctgagcgtcatcagtccaagggcgatgccaattcattcttcatacacggcatgtccaaggcgatgtcgaccttggcaaattcaacgcaccccggctttccggttacaatctattacgcattcaagcagtcagatacagagaacgaggggacttcctcggaaggttgggttgcgttcctcgaagcccttcttcaagcgggatttgccgttaccggtacatggcccttgcggaccgaaatgtcaaatcgcatgcgtggtttagattcaaatgcccttgcttcttccatagtcattgtgtgccgtcggcggcccgccaacgctgagacaatatcgcggagagcatttctgagggaattgaacacggttatccctgatgctctatcggacatgatgcacggcggcccagaccgctctcccatcgccgcagtcgatctccaacaagcggcaattggacccggtatggccgtattctcgaagtacgccgcggtacttgaggcagatgggtccccgatgacagtgaagacggctttgcagttaatcaatcgggtggttgacgcttatttgcatgcctccgaagcggaggtcgacgccgacacgttgttttgcattaactggtttgaccaattcggatggtctgaggccgactttggtcgtgcggacgttttggcgcgtgccaaggggacgagcgtggatgcggtacgcgctgcgggggttctgactgcggatcacggcaaggtccgattgctgcggtggcaggattacccgtccgattggagtccgggcaaggactatgacacacccgtgtgggaggcgcttcatcatctgattcgtgctctacagcaggatggggagcaggctgcaggagcgctgcttgcgggcatgtacagtgtttccgagtctatccgctcattggcgtatcggctctatacattgtgtgagcgcaagggatgggcggaggatgcaagggcctataacgaactgatcgcgagctgggatgccattgctgaagtggcccaaaaggctgggctgtcgggttcccaattgactctggatgtggaatag

SEQ ID NO: 2989 - DNA, 2865 bp, Artificial
  Alicyclobacillus acidocaldarius mutated SEQ ID NO 2977
gtgtacgtcgtgccaaaggtgaaggcacccaagaagctcattgaggtgacactgccgcttgatgatatcaacgccgaagccgcaagggagaaatccattcgccacggccatccttccactctgcatttgtggtgggcgcgccgccccttggctgcagcacgggccgtattgtttgcgcagctggtgaacgatcccggcggtgaacgcggctacaaacccggcatgacgagagaacaggcgcaaaaggaacgcgagcgtctgttcggaatcatgcgccggttggtgaagtgggagaactcgaacgacgaagaagtcttgcgcgaagctcgtgaagagatttggaagagctggcgggagacttgcgagatgaacaaggggttgccgggatttgatccggacaagctgcccgcttttcacgatccgttcgcgggcggcggctctattccgcttgaggcccaacgtttaggactggaagcctatgcatcggacctgaatccggtggccgtcttgatcaacaaggcgctcatcgaaattccgccgaagttctcgggcagacctcctgtcaatccagaggcgcggtccaaagtgggactgcttgagcaggagtggaaaggtgcaagtggattggcggacgacattcgttactacggagagtggatgcgcgacgaagcattcaagcgcatcggtcacctgtatccgcaggtggaattgccccccgaatacggaggagggaaggccacggtcatcgcgtggatttgggcacgaacggtaaagagcccaaatccggcgtacagtcatgtggatgtacctttggttcgctcattttggctatctaccaaaaagggaaaggaagtatgggttgaacctgtcattcacgaggatggctctggctatcattttgaggtgcggacggaaggtaagccgaagattgaaggcactgtgaatcgccgtggcgggacatgcatcatgtctggttcaccgataccgtttgactacattcgtgcggaaggaaaggcagagcgaatgggtaatcggctcatgacggtagtggtggagggtccgcggggcaggctctacatcgcaccgaccgatgacatggaaggcatggcacttagcttgaaggagccagatggtttgccacagactcaattgccgaaacgtgcgctcggattccgtgtccaagaatatgggatgacgatgcacaaacatttgtttacgaaccgacagcttgttgccctcaaaaccttttctgatctcgttgtagaggcgcgggaaaaggtgtacgaggatgcacttagcagcgggatgacggacgatggaatagggcttgaggatggcggaattggtgcgcgcgcatatgcggatgcggtggcggtgtatttaggtcttgtcttggataagtgtgctgactattggtcgtctatatgtagctggaattctccgaaggaactcgttaggaacacgttttccagacaagccatccccatggtatgggattttgctgaggcgaaccctttttcggactcgacgggaaactggatgggcatggtggattgggtgtggaaagcagtagagaatgctccgattaagacaactttaggcgaagctcatctggcagatgcacagacacagtctataagtgtaggcaaaattgtttcgacggatcctccatactatgacaatgttggatattcagacctgtcagactttttttacgtgtggttgcgtcgatctctgaatccgattcttcctggactattcgcaacattgatgacacccaaagaggatgaattagtggccgcgcctgagcgtcatcagtccaagggcgatgccaattcattcttcatacacggcatgtccaaggcgatgtcgaccttggcaaattcaacgcaccccggctttccggttacaatctattacgcattcaagcagtcagatacagagaacgaggggacttcctcggaaggttgggttgcgttcctcgaagcccttcttcaagcgggatttgccgttaccggtacatggcccttgcggaccgaaatgtcaaatcgcatgcgtggtttagattcaaatgcccttgcttcttccatagtcattgtgtgccgtcggcggcccgccaacgctgagacaatatcgcggagagcatttctgagggaattgaacacggttatccctgatgctctatcggacatgatgcacggcggcccagaccgctctcccatcgccgcagtcgatctccaacaagcggcaattggacccggtatggccgtattctcgaagtacgccgcggtacttgaggcagatgggtccccgatgacagtgaagacggctttgcagttaatcaatcgggtggttgacgcttatttgcatgcctccgaagcggaggtcgacgccgacacgttgttttgcattaactggtttgaccaattcggatggtctgaggccgactttggtcgtgcggacgttttggcgcgtgccaaggggacgagcgtggatgcggtacgcgctgcgggggttctgactgcggatcacggcaaggtccgattgctgcggtggcaggattacccgtccgattggagtccgggcaaggactatgacacacccgtgtgggaggcgcttcatcatctgattcgtgctctacagcaggatggggagcaggctgcaggagcgctgcttgcgggcatgtacagtgtttccgagtctatccgctcattggcgtatcggctctatacattgtgtgagcgcaagggatgggcggaggatgcaagggcctataacgaactgatcgcgagctgggatgccattgctgaagtggcccaaaaggctgggctgtcgggttcccaattgactctggatgtggaatag

SEQ ID NO: 2990 - DNA, 2865 bp, Artificial
  Alicyclobacillus acidocaldarius mutated SEQ ID NO 2977
gtgtacgtcgtgccaaaggtgaaggcacccaagaagctcattgaggtgacactgccgcttgatgatatcaacgccgaagccgcaagggagaaatccattcgccacggccatccttccactctgcatttgtggtgggcgcgccgccccttggctgcagcacgggccgtattgtttgcgcagctggtgaacgatcccggcggtgaacgcggctacaaacccggcatgacgagagaacaggcgcaaaaggaacgcgagcgtctgttcggaatcatgcgccggttggtgaagtgggagaactcgaacgacgaagaagtcttgcgcgaagctcgtgaagagatttggaagagctggcgggagacttgcgagatgaacaaggggttgccgggatttgatccggacaagctgcccgcttttcacgatccgttcgcgggcggcggctctattccgcttgaggcccaacgtttaggactggaagcctatgcatcggacctgaatccggtggccgtcttgatcaacaaggcgctcatcgaaattccgccgaagttctcgggcagacctcctgtcaatccagaggcgcggtccaaagtgggactgcttgagcaggagtggaaaggtgcaagtggattggcggacgacattcgttactacggagagtggatgcgcgacgaagcattcaagcgcatcggtcacctgtatccgcaggtggaattgccccccgaatacggaggagggaaggccacggtcatcgcgtggatttgggcacgaacggtaaagagcccaaatccggcgtacagtcatgtggatgtacctttggttcgctcattttggctatctaccaaaaagggaaaggaagtatgggttgaacctgtcattcacgaggatggctctggctatcattttgaggtgcggacggaaggtaagccgaagattgaaggcactgtgaatcgccgtggcgggacatgcatcatgtctggttcaccgataccgtttgactacattcgtgcggaaggaaaggcagagcgaatgggtcagcggctcatgacggtagtggtggagggtccgcggggcaggctctacatcgcaccgaccgatgacatggaaggcatggcacttagcttgaaggagccagatggtttgccacagactcaattgccgaaacgtgcgctcggattccgtgtccaagaatatgggatgacgatgcacaaacatttgtttacgaaccgacagcttgttgccctcaaaaccttttctgatctcgttgtagaggcgcgggaaaaggtgtacgaggatgcacttagcagcgggatgacggacgatggaatagggcttgaggatggcggaattggtgcgcgcgcatatgcggatgcggtggcggtgtatttaggtcttgtcttggataagtgtgctgactattggtcgtctatatgtagctggaattctccgaaggaactcgttaggaacacgttttccagacaagccatccccatggtatgggattttgctgaggcgaaccctttttcggactcgacgggaaactggatgggcatggtggattgggtgtggaaagcagtagagaatgctccgattaagacaactttaggcgaagctcatctggcagatgcacagacacagtctataagtgtaggcaaaattgtttcgacggatcctccatactatgacaatgttggatattcagacctgtcagactttttttacgtgtggttgcgtcgatctctgaatccgattcttcctggactattcgcaacattgatgacacccaaagaggatgaattagtggccgcgcctgagcgtcatcagtccaagggcgatgccaattcattcttcatacacggcatgtccaaggcgatgtcgaccttggcaaattcaacgcaccccggctttccggttacaatctattacgcattcaagcagtcagatacagagaacgaggggacttcctcggaaggttgggttgcgttcctcgaagcccttcttaatgcgggatttgccgttaccggtacatggcccttgcggaccgaaatgtcaaatcgcatgcgtggtttagattcaaatgcccttgcttcttccatagtcattgtgtgccgtcggcggcccgccaacgctgagacaatatcgcggagagcatttctgagggaattgaacacggttatccctgatgctctatcggacatgatgcacggcggcccagaccgctctcccatcgccgcagtcgatctccaacaagcggcaattggacccggtatggccgtattctcgaagtacgccgcggtacttgaggcagatgggtccccgatgacagtgaagacggctttgcagttaatcaatcgggtggttgacgcttatttgcatgcctccgaagcggaggtcgacgccgacacgttgttttgcattaactggtttgaccaattcggatggtctgaggccgactttggtcgtgcggacgttttggcgcgtgccaaggggacgagcgtggatgcggtacgcgctgcgggggttctgactgcggatcacggcaaggtccgattgctgcggtggcaggattacccgtccgattggagtccgggcaaggactatgacacacccgtgtgggaggcgcttcatcatctgattcgtgctctacagcaggatggggagcaggctgcaggagcgctgcttgcgggcatgtacagtgtttccgagtctatccgctcattggcgtatcggctctatacattgtgtgagcgcaagggatgggcggaggatgcaagggcctataacgaactgatcgcgagctgggatgccattgctgaagtggcccaaaaggctgggctgtcgggttcccaattgactctggatgtggaatag

SEQ ID NO: 2991 - DNA, 2865 bp, Artificial
  Alicyclobacillus acidocaldarius mutated SEQ ID NO 2977
gtgtacgtcgtgccaaaggtgaaggcacccaagaagctcattgaggtgacactgccgcttgatgatatcaacgccgaagccgcaagggagaaatccattcgccacggccatccttccactctgcatttgtggtgggcgcgccgccccttggctgcagcacgggccgtattgtttgcgcagctggtgaacgatcccggcggtgaacgcggctacaaacccggcatgacgagagaacaggcgcaaaaggaacgcgagcgtctgttcggaatcatgcgccggttggtgaagtgggagaactcgaacgacgaagaagtcttgcgcgaagctcgtgaagagatttggaagagctggcgggagacttgcgagatgaacaaggggttgccgggatttgatccggacaagctgcccgcttttcacgatccgttcgcgggcggcggctctattccgcttgaggcccaacgtttaggactggaagcctatgcatcggacctgaatccggtggccgtcttgatcaacaaggcgctcatcgaaattccgccgaagttctcgggcagacctcctgtcaatccagaggcgcggtccaaagtgggactgcttgagcaggagtggaaaggtgcaagtggattggcggacgacattcgttactacggagagtggatgcgcgacgaagcattcaagcgcatcggtcacctgtatccgcaggtggaattgccccccgaatacggaggagggaaggccacggtcatcgcgtggatttgggcacgaacggtaaagagcccaaatccggcgtacagtcatgtggatgtacctttggttcgctcattttggctatctaccaaaaagggaaaggaagtatgggttgaacctgtcattcacgaggatggctctggctatcattttgaggtgcggacggaaggtaagccgaagattgaaggcactgtgaatcgccgtggcgggacatgcatcatgtctggttcaccgataccgtttgactacattcgtgcggaaggaaaggcagagcgaatgggtcagcggctcatgacggtagtggtggagggtccgcggggcaggctctacatcgcaccgaccgatgacatggaaggcatggcacttagcttgaaggagccagatggtttgccacagactcaattgccgaaacgtgcgctcggattccgtgtccaagaatatgggatgacgatgcacaaacatttgtttacgaaccgacagcttgttgccctcaaaaccttttctgatctcgttgtagaggcgcgggaaaaggtgtacgaggatgcacttagcagcgggatgacggacgatggaatagggcttgatgatggcggaattggtgcgcgcgcatatgcggatgcggtggcggtgtatttaggtcttgtcttggataagtgtgctgactattggtcgtctatatgtagctggaattctccgaaggaactcgttaggaacacgttttccagacaagccatccccatggtatgggattttgctgaggcgaaccctttttcggactcgacgggaaactggatgggcatggtggattgggtgtggaaagcagtagagaatgctccgattaagacaactttaggcgaagctcatctggcagatgcacagacacagtctataagtgtaggcaaaattgtttcgacggatcctccatactatgacaatgttggatattcagacctgtcagactttttttacgtgtggttgcgtcgatctctgaatccgattcttcctggactattcgcaacattgatgacacccaaagaggatgaattagtggccgcgcctgagcgtcatcagtccaagggcgatgccaattcattcttcatacacggcatgtccaaggcgatgtcgaccttggcaaattcaacgcaccccggctttccggttacaatctattacgcattcaagcagtcagatacagagaacgaggggacttcctcggaaggttgggttgcgttcctcgaagcccttcttcaagcgggatttgccgttaccggtacatggcccttgcggaccgaaatgtcaaatcgcatgcgtggtttagattcaaatgcccttgcttcttccatagtcattgtgtgccgtcggcggcccgccaacgctgagacaatatcgcggagagcatttctgagggaattgaacacggttatccctgatgctctatcggacatgatgcacggcggcccagaccgctctcccatcgccgcagtcgatctccaacaagcggcaattggacccggtatggccgtattctcgaagtacgccgcggtacttgaggcagatgggtccccgatgacagtgaagacggctttgcagttaatcaatcgggtggttgacgcttatttgcatgcctccgaagcggaggtcgacgccgacacgttgttttgcattaactggtttgaccaattcggatggtctgaggccgactttggtcgtgcggacgttttggcgcgtgccaaggggacgagcgtggatgcggtacgcgctgcgggggttctgactgcggatcacggcaaggtccgattgctgcggtggcaggattacccgtccgattggagtccgggcaaggactatgacacacccgtgtgggaggcgcttcatcatctgattcgtgctctacagcaggatggggagcaggctgcaggagcgctgcttgcgggcatgtacagtgtttccgagtctatccgctcattggcgtatcggctctatacattgtgtgagcgcaagggatgggcggaggatgcaagggcctataacgaactgatcgcgagctgggatgccattgctgaagtggcccaaaaggctgggctgtcgggttcccaattgactctggatgtggaatag

SEQ ID NO: 2992 - DNA, 2865 bp, Artificial
  Alicyclobacillus acidocaldarius mutated SEQ ID NO 2977
gtgtacgtcgtgccaaaggtgaaggcacccaagaagctcattgaggtgacactgccgcttgatgatatcaacgccgaagccgcaagggagaaatccattcgccacggccatccttccactctgcatttgtggtgggcgcgccgccccttggctgcagcacgggccgtattgtttgcgcagctggtgaacgatcccggcggtgaacgcggctacaaacccggcatgacgagagaacaggcgcaaaaggaacgcgagcgtctgttcggaatcatgcgccggttggtgaagtgggagaactcgaacgacgaagaagtcttgcgcgaagctcgtgaagagatttggaagagctggcgggagacttgcgagatgaacaaggggttgccgggatttgatccggacaagctgcccgcttttcacgatccgttcgcgggcggcggctctattccgcttgaggcccaacgtttaggactggaagcctatgcatcggacctgaatccggtggccgtcttgatcaacaaggcgctcatcgaaattccgccgaagttctcgggcagacctcctgtcaatccagaggcgcggtccaaagtgggactgcttgagcaggagtggaaaggtgcaagtggattggcggacgacattcgttactacggagagtggatgcgcgacgaagcattcaagcgcatcggtcacctgtatccgcaggtggaattgccccccgaatacggaggagggaaggccacggtcatcgcgtggatttgggcacgaacggtaaagagcccaaatccggcgtacagtcatgtggatgtacctttggttcgctcattttggctatctaccaaaaagggaaaggaagtatgggttgaacctgtcattcacgaggatggctctggctatcattttgaggtgcggacggaaggtaagccgaagattgaaggcactgtgaatcgccgtggcgggacatgcatcatgtctggttcaccgataccgtttgactacattcgtgcggaaggaaaggcagagcgaatgggtcagcggctcatgacggtagtggtggagggtccgcggggcaggctctacatcgcaccgaccgatgacatggaaggcatggcacttagcttgaaggagccagatggtttgccacagactcaattgccgaaacgtgcgctcggattccgtgtccaagaatatgggatgacgatgcacaaacatttgtttacgaaccgacagcttgttgccctcaaaaccttttctgatctcgttgtagaggcgcgggaaaaggtgtacgaggatgcacttagcagcgggatgacggacgatggaatagggcttgaggatggcggaattggtgcgcgcgcatatgcggatgcggtggcggtgtatttaggtcttattttggataagtgtgctgactattggtcgtctatatgtagctggaattctccgaaggaactcgttaggaacacgttttccagacaagccatccccatggtatgggattttgctgaggcgaaccctttttcggactcgacgggaaactggatgggcatggtggattgggtgtggaaagcagtagagaatgctccgattaagacaactttaggcgaagctcatctggcagatgcacagacacagtctataagtgtaggcaaaattgtttcgacggatcctccatactatgacaatgttggatattcagacctgtcagactttttttacgtgtggttgcgtcgatctctgaatccgattcttcctggactattcgcaacattgatgacacccaaagaggatgaattagtggccgcgcctgagcgtcatcagtccaagggcgatgccaattcattcttcatacacggcatgtccaaggcgatgtcgaccttggcaaattcaacgcaccccggctttccggttacaatctattacgcattcaagcagtcagatacagagaacgaggggacttcctcggaaggttgggttgcgttcctcgaagcccttcttcaagcgggatttgccgttaccggtacatggcccttgcggaccgaaatgtcaaatcgcatgcgtggtttagattcaaatgcccttgcttcttccatagtcattgtgtgccgtcggcggcccgccaacgctgagacaatatcgcggagagcatttctgagggaattgaacacggttatccctgatgctctatcggacatgatgcacggcggcccagaccgctctcccatcgccgcagtcgatctccaacaagcggcaattggacccggtatggccgtattctcgaagtacgccgcggtacttgaggcagatgggtccccgatgacagtgaagacggctttgcagttaatcaatcgggtggttgacgcttatttgcatgcctccgaagcggaggtcgacgccgacacgttgttttgcattaactggtttgaccaattcggatggtctgaggccgactttggtcgtgcggacgttttggcgcgtgccaaggggacgagcgtggatgcggtacgcgctgcgggggttctgactgcggatcacggcaaggtccgattgctgcggtggcaggattacccgtccgattggagtccgggcaaggactatgacacacccgtgtgggaggcgcttcatcatctgattcgtgctctacagcaggatggggagcaggctgcaggagcgctgcttgcgggcatgtacagtgtttccgagtctatccgctcattggcgtatcggctctatacattgtgtgagcgcaagggatgggcggaggatgcaagggcctataacgaactgatcgcgagctgggatgccattgctgaagtggcccaaaaggctgggctgtcgggttcccaattgactctggatgtggaatag

SEQ ID NO: 2993 - protein, 192 aa, Alicyclobacillus acidocaldarius
MSLIPYVIEQTSRGERSYDIYSRLLKDRIIFLGTPIDDDVANAVVAQLLFLAADDPDKDIQMYINSPGGSVSAGLAIYDTMQHIKPDVSTMCVGMAASMAAVLLAAGAKGKRYALPNSEVMIHQPLGGARGQASDIEIHARHILKTRERLNRILAERTGQPLERVAQDTDRDNFMSAEEAKAYGLIDEVIYR

SEQ ID NO: 2994 - DNA, 579 bp, Alicyclobacillus acidocaldarius
atgagtctcatcccgtacgtaatcgagcagacgtcgcgaggagagcgaagctatgacatttactcgcgcctgctgaaggatcggatcatcttcttgggtacgcccatcgacgacgatgtcgcgaacgcggtcgtggcgcagcttttgttcctcgccgcggatgatccggacaaagacatccagatgtacatcaatagtccgggaggatcggtgtcggcaggccttgcgatatatgataccatgcagcacatcaagcccgacgtgagcaccatgtgcgtcggcatggcggcgagcatggcggccgttctcttggcagcgggtgcaaagggcaagcggtacgcgcttccgaattccgaggtgatgatccaccaaccgctcgggggcgcgcggggtcaggcttcggatattgaaatccatgctcggcacatcctgaagacgagggaacgccttaaccgcattttggcagaacgaacgggacaaccgctcgagcgggtcgcgcaggatacggaccgcgacaatttcatgtcggcggaggaagcgaaggcgtacggattgattgacgaagtcatttaccgctga

SEQ ID NO: 2995 - protein, 190 aa, Bacillus halodurans
MNLIPTVIEQTNRGERAYDIYSRLLKDRIIMLGTAIDDNVANSIVAQLLFLQAEDPDKDISLYINSPGGSITAGMAIYDTMQYIKPNVSTICIGMAASMGAFLLAAGAKGKRFALPNSEVMIHQPLGGTRGQASDIEIHTRRILEMRETLNRILAERTGQPLEQIAKDTDRDNFMTAEKAREYGLIDKVI

SEQ ID NO: 2996 - protein, 190 aa, Paenibacillus  JDR-2
MNLVPIVVEQTNRGERSYDIYSRLLKDRIIFLGSAIDDDVANSVIAQLLFLAADDPEKDIHLYINSPGGSVTAGMAIYDTMQYIKPDVSTICMGMAASMGSLLLTAGAKGKRFALPNAEVMIHQPLGGVRGQASDIKIHADWILKTKQKLNEIYVERTGQPYEKIDRDTDRDNFMSAEDALNYGLIDKVI

SEQ ID NO: 2997 - protein, 190 aa, Bacillus selenitireducens
MNLVPTVIEQTNRGERAYDIYSRLLKDRIIMLGTPIDDNVANSIVAQLLFLAADDPDKDISLYINSPGGSITAGMAIYDTMQFIKPKVQTICIGMAASMGAFLLTAGEPGKRYALPNSEVMIHQPLGGAQGQASDIEIHAKRIVEMKEKLNQILAERTGQDIEQIRKDTDRDNFLSAAQAKEYGLIDEVM

SEQ ID NO: 2998 - protein, 190 aa, Clostridium bartlettii
MALVPTVVEQTGRGERAYDIYSRLLKDRIIFLSDEVNDTTASLVVAQLLFLEAEDPDKDIHLYINSPGGSVTAGMAIYDTMQYIKPDVSTICIGMAASMGAFLLNAGAKGKRFALPNSEIMIHQPLGGAKGQATDIEIHAKWILKIKERLNKILSERTGQPIEKIQEDTERDNFMSAQEAKEYGLIDEVI

SEQ ID NO: 2999 - protein, 190 aa, Bacillus clausii
MNLIPTVIEQTNRGERAYDIYSRLLKDRIIMLGSGVDDNVANSIVAQMLFLQAEDPEKDISLYINSPGGSITAGMAIYDTMQFIKPDVSTICIGMAASMGAFLLTAGAKGKRMALPNSEVMIHQPLGGMQGQAADMEIHARRIIQMREKLNQIMAERSGQPYERIARDTDRDNFMTAEQAKEYGLIDKVI

SEQ ID NO: 3000 - protein, 192 aa, Artificial
  Alicyclobacillus acidocaldarius mutated SEQ ID NO 2993
MSLIPYVIEQTSRGERSYDIYSRLLKDRIIFLGTPIDDDVANAVVAQLLFLAADDPDKDIQMYINSPGGSVSAGLAIYDTMQHIKPDVSTMCVGMAASMAAVLLAAGAKGKRYALPNSEVMIHQPLGGARGQASDIEIHAKHILKTRERLNRILAERTGQPLERVAQDTDRDNFMSAEEAKAYGLIDEVIYR

SEQ ID NO: 3001 - protein, 192 aa, Artificial
  Alicyclobacillus acidocaldarius mutated SEQ ID NO 2993
MSLIPYVIEQTSRGERSYDIYSRLLKDRIIFLGTPIDDDVANAVVAQLLFLAADDPDKDIQMYINSPGGSVSAGLAIYDTMQHIKPDVSTMCVGMAASMAAVLLAAGARGKRYALPNSEVMIHQPLGGARGQASDIEIHARHILKTRERLNRILAERTGQPLERVAQDTDRDNFMSAEEAKAYGLIDEVIYR

SEQ ID NO: 3002 - protein, 192 aa, Artificial
  Alicyclobacillus acidocaldarius mutated SEQ ID NO 2993
MSLIPYVIEQTSRGERSYDIYSRLLKDRIIFLGTPIDDDVANAVVAQLLFLAADDPDKDIQMYINSPGGSVSAGLAIYDTMQHIKPDVSTMCVGMAASMAAVLLAAGAKGKRYALPNSEVMIHQPLGGARGQASDIEIHARHILKTRERLNRILAERTGQPLERVAQDTDRDNFMSADEAKAYGLIDEVIYR

SEQ ID NO: 3003 - protein, 192 aa, Artificial
  Alicyclobacillus acidocaldarius mutated SEQ ID NO 2993
MSLIPYVIEQTSRGERSYDIYSRLLKDRIIFLGTPIDDDVANAVVAQLLFLAADDPDKDIQMYINSPGGSVSAGLAIYDTMQHIKPDVSTMCVGMAASMAAVLLAAGAKGKRYALPNSEVMIHQPLGGARGQASDIEIHARHILKTRERLNRILAERTGQPLERVAQDTDRDNFMSAEEAKAYGLIDEVIYK

SEQ ID NO: 3004 - protein, 192 aa, Artificial
  Alicyclobacillus acidocaldarius mutated SEQ ID NO 2993
MSLIPYVIEQTSRGERSYDIYSRLLKDRIIFLGTPIDDDVANAVVAQLLFLAADDPDKDIQMYINSPGGSVSAGLAIYDTMQHIKPDVSTMCVGMAASMAAVLLAAGAKGKRYALPNSEVMIHQPLGGARGQASDIEIHARHILKTREKLNRILAERTGQPLERVAQDTDRDNFMSAEEAKAYGLIDEVIYR

SEQ ID NO: 3005 - DNA, 579 bp, Artificial
  Alicyclobacillus acidocaldarius mutated SEQ ID NO 2994
atgagtctcatcccgtacgtaatcgagcagacgtcgcgaggagagcgaagctatgacatttactcgcgcctgctgaaggatcggatcatcttcttgggtacgcccatcgacgacgatgtcgcgaacgcggtcgtggcgcagcttttgttcctcgccgcggatgatccggacaaagacatccagatgtacatcaatagtccgggaggatcggtgtcggcaggccttgcgatatatgataccatgcagcacatcaagcccgacgtgagcaccatgtgcgtcggcatggcggcgagcatggcggccgttctcttggcagcgggtgcaaagggcaagcggtacgcgcttccgaattccgaggtgatgatccaccaaccgctcgggggcgcgcggggtcaggcttcggatattgaaatccatgctaaacacatcctgaagacgagggaacgccttaaccgcattttggcagaacgaacgggacaaccgctcgagcgggtcgcgcaggatacggaccgcgacaatttcatgtcggcggaggaagcgaaggcgtacggattgattgacgaagtcatttaccgctga

SEQ ID NO: 3006 - DNA, 579 bp, Artificial
  Alicyclobacillus acidocaldarius mutated SEQ ID NO 2994
atgagtctcatcccgtacgtaatcgagcagacgtcgcgaggagagcgaagctatgacatttactcgcgcctgctgaaggatcggatcatcttcttgggtacgcccatcgacgacgatgtcgcgaacgcggtcgtggcgcagcttttgttcctcgccgcggatgatccggacaaagacatccagatgtacatcaatagtccgggaggatcggtgtcggcaggccttgcgatatatgataccatgcagcacatcaagcccgacgtgagcaccatgtgcgtcggcatggcggcgagcatggcggccgttctcttggcagcgggtgcacgtggcaagcggtacgcgcttccgaattccgaggtgatgatccaccaaccgctcgggggcgcgcggggtcaggcttcggatattgaaatccatgctcggcacatcctgaagacgagggaacgccttaaccgcattttggcagaacgaacgggacaaccgctcgagcgggtcgcgcaggatacggaccgcgacaatttcatgtcggcggaggaagcgaaggcgtacggattgattgacgaagtcatttaccgctga

SEQ ID NO: 3007 - DNA, 579 bp, Artificial
  Alicyclobacillus acidocaldarius mutated SEQ ID NO 2994
atgagtctcatcccgtacgtaatcgagcagacgtcgcgaggagagcgaagctatgacatttactcgcgcctgctgaaggatcggatcatcttcttgggtacgcccatcgacgacgatgtcgcgaacgcggtcgtggcgcagcttttgttcctcgccgcggatgatccggacaaagacatccagatgtacatcaatagtccgggaggatcggtgtcggcaggccttgcgatatatgataccatgcagcacatcaagcccgacgtgagcaccatgtgcgtcggcatggcggcgagcatggcggccgttctcttggcagcgggtgcaaagggcaagcggtacgcgcttccgaattccgaggtgatgatccaccaaccgctcgggggcgcgcggggtcaggcttcggatattgaaatccatgctcggcacatcctgaagacgagggaacgccttaaccgcattttggcagaacgaacgggacaaccgctcgagcgggtcgcgcaggatacggaccgcgacaatttcatgtcggcggatgaagcgaaggcgtacggattgattgacgaagtcatttaccgctga

SEQ ID NO: 3008 - DNA, 579 bp, Artificial
  Alicyclobacillus acidocaldarius mutated SEQ ID NO 2994
atgagtctcatcccgtacgtaatcgagcagacgtcgcgaggagagcgaagctatgacatttactcgcgcctgctgaaggatcggatcatcttcttgggtacgcccatcgacgacgatgtcgcgaacgcggtcgtggcgcagcttttgttcctcgccgcggatgatccggacaaagacatccagatgtacatcaatagtccgggaggatcggtgtcggcaggccttgcgatatatgataccatgcagcacatcaagcccgacgtgagcaccatgtgcgtcggcatggcggcgagcatggcggccgttctcttggcagcgggtgcaaagggcaagcggtacgcgcttccgaattccgaggtgatgatccaccaaccgctcgggggcgcgcggggtcaggcttcggatattgaaatccatgctcggcacatcctgaagacgagggaacgccttaaccgcattttggcagaacgaacgggacaaccgctcgagcgggtcgcgcaggatacggaccgcgacaatttcatgtcggcggaggaagcgaaggcgtacggattgattgacgaagtcatttacaaatga

SEQ ID NO: 3009 - DNA, 579 bp, Artificial
  Alicyclobacillus acidocaldarius mutated SEQ ID NO 2994
atgagtctcatcccgtacgtaatcgagcagacgtcgcgaggagagcgaagctatgacatttactcgcgcctgctgaaggatcggatcatcttcttgggtacgcccatcgacgacgatgtcgcgaacgcggtcgtggcgcagcttttgttcctcgccgcggatgatccggacaaagacatccagatgtacatcaatagtccgggaggatcggtgtcggcaggccttgcgatatatgataccatgcagcacatcaagcccgacgtgagcaccatgtgcgtcggcatggcggcgagcatggcggccgttctcttggcagcgggtgcaaagggcaagcggtacgcgcttccgaattccgaggtgatgatccaccaaccgctcgggggcgcgcggggtcaggcttcggatattgaaatccatgctcggcacatcctgaagacgagggaaaaacttaaccgcattttggcagaacgaacgggacaaccgctcgagcgggtcgcgcaggatacggaccgcgacaatttcatgtcggcggaggaagcgaaggcgtacggattgattgacgaagtcatttaccgctga

SEQ ID NO: 3010 - protein, 485 aa, Alicyclobacillus acidocaldarius; identical to SEQ ID NO: 2075

SEQ ID NO: 3011 - DNA, 1458 bp, Alicyclobacillus acidocaldarius; identical to SEQ ID NO: 2076

SEQ ID NO: 3012 - protein, 412 aa, Geobacillus kaustophilus; identical to SEQ ID NO: 2077

SEQ ID NO: 3013 - protein, 336 aa, Bacillus cereus; identical to SEQ ID NO: 2078

SEQ ID NO: 3014 - protein, 336 aa, Bacillus cereus; identical to SEQ ID NO: 2079

SEQ ID NO: 3015 - protein, 335 aa, Paenibacillus  JDR-2; identical to SEQ ID NO: 2080

SEQ ID NO: 3016 - protein, 305 aa, Bacillus cereus; identical to SEQ ID NO: 2081

SEQ ID NO: 3017 - protein, 485 aa, Artificial
  Alicyclobacillus acidocaldarius mutated SEQ ID NO 3010
MTERHLALYVRVSTEEQAASGHSLREQEEQLVEYARSHGFPRYELYCDDGYSGKSLNRPAMERLRADIRAGCVLGVVTTRIDRLTRSVADFARLVDEMNLHGVFYRSTRQNFEISTAMGRLVAQMLSVIAEFEREMIAERVHENLLAMAQRGELATKPPFGYRLVNGRLTPDPREARWVREGARLLLTGASPRDVAMEFNALGVRTKTGRLWTDRTVRTLFSNPALAGVSVWNRRKTQGSRRTEREPTEWVCVEGAHEAILSREEFEALRGMLERRRALSPRSQGSKRPLAGIARCGFCGSAMYAGWQVSKRGHDRQKRPIYRCGRYVTGGGCTPNQVDASALEMLVVEELLRRVRPELEPVVSAYRAHAASNELRTVQRKRRVALARLSRLAEAYASGVVSEEAFSREQVRLLRVLEACREAEAQAAALSTTDGWDAWVRELCARLAGDPHLERALFLTVVREVRVFRPKRSREVDVDLVLRLE

SEQ ID NO: 3018 - protein, 485 aa, Artificial
  Alicyclobacillus acidocaldarius mutated SEQ ID NO 3010
MTERHLALYVRVSTEEQAASGHSLREQEEQLVEYARSHGFPRYELYCDDGYSGKSLNRPAMERLRADIRAGCVLGVVTTRIDRLTRSVADFARLVDEMNLHGVFYRSTRQNFEISTAMGRLVAQMLSVIAEFEREMIAERVHENLLAMAQRGELATKPPFGYRLVNGRLTPDPREARWVREGARLLLTGASPRDVAMEFNALGVRTKTGRLWTDRTVRTLFSNPALAGVSVWNRRKTQGSRRTEREPTEWVCVEGAHEAILSRDEFEALRGMLERRRALSPRSQGSKRPLAGIARCGFCGSAMYAGWQVSKRGHERQKRPIYRCGRYVTGGGCTPNQVDASALEMLVVEELLRRVRPELEPVVSAYRAHAASNELRTVQRKRRVALARLSRLAEAYASGVVSEEAFSREQVRLLRVLEACREAEAQAAALSTTDGWDAWVRELCARLAGDPHLERALFLTVVREVRVFRPKRSREVDVDLVLRLE

SEQ ID NO: 3019 - protein, 485 aa, Artificial
  Alicyclobacillus acidocaldarius mutated SEQ ID NO 3010
MTERHLALYVRVSTEEQAASGHSLREQEEQLVEYARSHGFPRYELYCDDGYSGKSLNRPAMERLRADIRAGCVLGVVTTRIDRLTRSVADFARLVDEMNLHGVFYRSTRQNFEISTAMGRLVAQMLSVIAEFEREMIAERVHENLIAMAQRGELATKPPFGYRLVNGRLTPDPREARWVREGARLLLTGASPRDVAMEFNALGVRTKTGRLWTDRTVRTLFSNPALAGVSVWNRRKTQGSRRTEREPTEWVCVEGAHEAILSREEFEALRGMLERRRALSPRSQGSKRPLAGIARCGFCGSAMYAGWQVSKRGHERQKRPIYRCGRYVTGGGCTPNQVDASALEMLVVEELLRRVRPELEPVVSAYRAHAASNELRTVQRKRRVALARLSRLAEAYASGVVSEEAFSREQVRLLRVLEACREAEAQAAALSTTDGWDAWVRELCARLAGDPHLERALFLTVVREVRVFRPKRSREVDVDLVLRLE

SEQ ID NO: 3020 - protein, 485 aa, Artificial
  Alicyclobacillus acidocaldarius mutated SEQ ID NO 3010
MTERHLALYVRVSTEEQAASGHSLREQEEQLVEYARSHGFPRYELYCDDGYSGKSLNRPAMERLRADIRAGCVLGVVTTRIDRLTRSVADFARLVDEMNLHGVFYRSTRQNFEISTAMGRLVAQMLSVIAEFEREMIAERVHENLLAMAQRGELATKPPFGYRLVNGRLTPDPREARWVREGARLLLTGASPRDVAMEFNALGVRTKTGRLWTDRTVRTLFSNPALAGVSVWNRRKTQGSRRTEREPTEWVCVEGAHEAILSREEFEALRGMLERRRALSPRSQGSKRPLAGIARCGFCGSAMYAGWQVSKRGHERQKRPIYRCGRYVTGGGCTPNQVDASALEMLVVEELLRRVRPELEPVVSAYRAHAASNELRTVQRKRRVALARLSRLADAYASGVVSEEAFSREQVRLLRVLEACREAEAQAAALSTTDGWDAWVRELCARLAGDPHLERALFLTVVREVRVFRPKRSREVDVDLVLRLE

SEQ ID NO: 3021 - protein, 485 aa, Artificial
  Alicyclobacillus acidocaldarius mutated SEQ ID NO 3010
MTERHLALYVRVSTEEQAASGHSLREQEEQLVEYARSHGFPRYELYCDDGYSGKSLNRPAMERLRADIRAGCVLGVVTTRIDRLTRSVADFARLVDEMNLHGVFYRSTRQNFEISTAMGRLVAQMLSVIAEFEREMIAERVHENLLAMAQRGELATKPPFGYRLVNGRLTPDPREARWVREGARLLLTGASPRDVAMEFNALGVRTKTGRLWTDRTVRTLFSNPALAGVSVWNRRKTQGSRRTEREPTEWVCVEGAHEAILSREEFEALRGMLERRRALSPRSQGSKRPLAGIARCGFCGSAMYAGWQVSKRGHERQKRPIYRCGRYVTGGGCTPNQVDASALEMLVVEELLRRVRPELEPVVSAYKAHAASNELRTVQRKRRVALARLSRLAEAYASGVVSEEAFSREQVRLLRVLEACREAEAQAAALSTTDGWDAWVRELCARLAGDPHLERALFLTVVREVRVFRPKRSREVDVDLVLRLE

SEQ ID NO: 3022 - DNA, 1458 bp, Artificial
  Alicyclobacillus acidocaldarius mutated SEQ ID NO 3011
gtgaccgagcggcacctggcgctctacgtgcgggtttcgacggaggagcaggccgcgtcgggccacagcctgagggaacaagaggagcagctcgtcgaatatgcccggtcgcacggatttcctcggtacgaactgtattgcgacgacgggtactcggggaagtcgctcaaccgtccggcgatggagcgcctgcgcgccgacatccgggcgggatgcgtgctcggcgtggtgacgacgcgcatcgatcggctgacgcggagcgtcgcggacttcgcgcgccttgtcgacgagatgaacttgcatggcgttttttatcgctccacgaggcagaatttcgagatctcgacggcgatggggcgattggtggcgcagatgttgtccgtgatcgccgagtttgaacgcgagatgatcgcggagcgcgtgcacgaaaacctcctcgcgatggcgcagcgcggcgagcttgccacgaagccgccgttcggttatcggctggtcaacggtcgcttgacgccggatccgcgtgaggcccgatgggtgcgtgagggggcgcgccttctgttaaccggcgcgagcccgagggacgtcgccatggaattcaacgccctcggcgtgcggacgaagacggggcggctttggacggatcgcaccgtccgcacgctcttttccaacccggcgttggccggtgtctccgtttggaaccggcgcaagacgcagggcagtcggcgaaccgagcgcgaacccaccgagtgggtgtgcgtcgagggagcgcacgaggccattttgagccgcgaggaattcgaagccctgcgaggcatgctcgagcgacgccgcgcgctgtcgccgcgatcgcagggctcgaaacgcccgctcgccggcattgcgcgatgcggcttctgcggaagcgcgatgtacgcgggctggcaggtatcaaagcggggccatgatcgccaaaaacggcccatctatcgctgtgggcgatacgtcaccggtgggggctgcacgcccaatcaggtggacgccagcgcgctggagatgctggtggtggaagagcttcttcgccgcgttcggccggagctcgaaccggtggtgtcggcctatcgggcgcatgcggcgtcgaacgagttgcgcacggtgcagcggaagcgccgcgtcgccctggcgcgattgagccggctcgcggaagcctacgcgtcgggcgtggtgtccgaggaggcgttttcccgcgagcaggttcgtcttctgcgcgtgcttgaggcgtgtcgggaggcggaggcgcaagcggccgccctgtcgaccaccgacgggtgggacgcatgggtgagagagctgtgcgctcgattggctggcgatccgcatctggagcgcgccttgttcctgaccgtcgtgcgggaagtgcgggtgtttcgccccaagcggtctcgcgaggtggatgtcgacctcgtcctgcgcctcgagtga

SEQ ID NO: 3023 - DNA, 1458 bp, Artificial
  Alicyclobacillus acidocaldarius mutated SEQ ID NO 3011
gtgaccgagcggcacctggcgctctacgtgcgggtttcgacggaggagcaggccgcgtcgggccacagcctgagggaacaagaggagcagctcgtcgaatatgcccggtcgcacggatttcctcggtacgaactgtattgcgacgacgggtactcggggaagtcgctcaaccgtccggcgatggagcgcctgcgcgccgacatccgggcgggatgcgtgctcggcgtggtgacgacgcgcatcgatcggctgacgcggagcgtcgcggacttcgcgcgccttgtcgacgagatgaacttgcatggcgttttttatcgctccacgaggcagaatttcgagatctcgacggcgatggggcgattggtggcgcagatgttgtccgtgatcgccgagtttgaacgcgagatgatcgcggagcgcgtgcacgaaaacctcctcgcgatggcgcagcgcggcgagcttgccacgaagccgccgttcggttatcggctggtcaacggtcgcttgacgccggatccgcgtgaggcccgatgggtgcgtgagggggcgcgccttctgttaaccggcgcgagcccgagggacgtcgccatggaattcaacgccctcggcgtgcggacgaagacggggcggctttggacggatcgcaccgtccgcacgctcttttccaacccggcgttggccggtgtctccgtttggaaccggcgcaagacgcagggcagtcggcgaaccgagcgcgaacccaccgagtgggtgtgcgtcgagggagcgcacgaggccattttgagccgcgatgaattcgaagccctgcgaggcatgctcgagcgacgccgcgcgctgtcgccgcgatcgcagggctcgaaacgcccgctcgccggcattgcgcgatgcggcttctgcggaagcgcgatgtacgcgggctggcaggtatcaaagcggggccatgagcgccaaaaacggcccatctatcgctgtgggcgatacgtcaccggtgggggctgcacgcccaatcaggtggacgccagcgcgctggagatgctggtggtggaagagcttcttcgccgcgttcggccggagctcgaaccggtggtgtcggcctatcgggcgcatgcggcgtcgaacgagttgcgcacggtgcagcggaagcgccgcgtcgccctggcgcgattgagccggctcgcggaagcctacgcgtcgggcgtggtgtccgaggaggcgttttcccgcgagcaggttcgtcttctgcgcgtgcttgaggcgtgtcgggaggcggaggcgcaagcggccgccctgtcgaccaccgacgggtgggacgcatgggtgagagagctgtgcgctcgattggctggcgatccgcatctggagcgcgccttgttcctgaccgtcgtgcgggaagtgcgggtgtttcgccccaagcggtctcgcgaggtggatgtcgacctcgtcctgcgcctcgagtga

SEQ ID NO: 3024 - DNA, 1458 bp, Artificial
  Alicyclobacillus acidocaldarius mutated SEQ ID NO 3011
gtgaccgagcggcacctggcgctctacgtgcgggtttcgacggaggagcaggccgcgtcgggccacagcctgagggaacaagaggagcagctcgtcgaatatgcccggtcgcacggatttcctcggtacgaactgtattgcgacgacgggtactcggggaagtcgctcaaccgtccggcgatggagcgcctgcgcgccgacatccgggcgggatgcgtgctcggcgtggtgacgacgcgcatcgatcggctgacgcggagcgtcgcggacttcgcgcgccttgtcgacgagatgaacttgcatggcgttttttatcgctccacgaggcagaatttcgagatctcgacggcgatggggcgattggtggcgcagatgttgtccgtgatcgccgagtttgaacgcgagatgatcgcggagcgcgtgcacgaaaacctcattgcgatggcgcagcgcggcgagcttgccacgaagccgccgttcggttatcggctggtcaacggtcgcttgacgccggatccgcgtgaggcccgatgggtgcgtgagggggcgcgccttctgttaaccggcgcgagcccgagggacgtcgccatggaattcaacgccctcggcgtgcggacgaagacggggcggctttggacggatcgcaccgtccgcacgctcttttccaacccggcgttggccggtgtctccgtttggaaccggcgcaagacgcagggcagtcggcgaaccgagcgcgaacccaccgagtgggtgtgcgtcgagggagcgcacgaggccattttgagccgcgaggaattcgaagccctgcgaggcatgctcgagcgacgccgcgcgctgtcgccgcgatcgcagggctcgaaacgcccgctcgccggcattgcgcgatgcggcttctgcggaagcgcgatgtacgcgggctggcaggtatcaaagcggggccatgagcgccaaaaacggcccatctatcgctgtgggcgatacgtcaccggtgggggctgcacgcccaatcaggtggacgccagcgcgctggagatgctggtggtggaagagcttcttcgccgcgttcggccggagctcgaaccggtggtgtcggcctatcgggcgcatgcggcgtcgaacgagttgcgcacggtgcagcggaagcgccgcgtcgccctggcgcgattgagccggctcgcggaagcctacgcgtcgggcgtggtgtccgaggaggcgttttcccgcgagcaggttcgtcttctgcgcgtgcttgaggcgtgtcgggaggcggaggcgcaagcggccgccctgtcgaccaccgacgggtgggacgcatgggtgagagagctgtgcgctcgattggctggcgatccgcatctggagcgcgccttgttcctgaccgtcgtgcgggaagtgcgggtgtttcgccccaagcggtctcgcgaggtggatgtcgacctcgtcctgcgcctcgagtga

SEQ ID NO: 3025 - DNA, 1458 bp, Artificial
  Alicyclobacillus acidocaldarius mutated SEQ ID NO 3011
gtgaccgagcggcacctggcgctctacgtgcgggtttcgacggaggagcaggccgcgtcgggccacagcctgagggaacaagaggagcagctcgtcgaatatgcccggtcgcacggatttcctcggtacgaactgtattgcgacgacgggtactcggggaagtcgctcaaccgtccggcgatggagcgcctgcgcgccgacatccgggcgggatgcgtgctcggcgtggtgacgacgcgcatcgatcggctgacgcggagcgtcgcggacttcgcgcgccttgtcgacgagatgaacttgcatggcgttttttatcgctccacgaggcagaatttcgagatctcgacggcgatggggcgattggtggcgcagatgttgtccgtgatcgccgagtttgaacgcgagatgatcgcggagcgcgtgcacgaaaacctcctcgcgatggcgcagcgcggcgagcttgccacgaagccgccgttcggttatcggctggtcaacggtcgcttgacgccggatccgcgtgaggcccgatgggtgcgtgagggggcgcgccttctgttaaccggcgcgagcccgagggacgtcgccatggaattcaacgccctcggcgtgcggacgaagacggggcggctttggacggatcgcaccgtccgcacgctcttttccaacccggcgttggccggtgtctccgtttggaaccggcgcaagacgcagggcagtcggcgaaccgagcgcgaacccaccgagtgggtgtgcgtcgagggagcgcacgaggccattttgagccgcgaggaattcgaagccctgcgaggcatgctcgagcgacgccgcgcgctgtcgccgcgatcgcagggctcgaaacgcccgctcgccggcattgcgcgatgcggcttctgcggaagcgcgatgtacgcgggctggcaggtatcaaagcggggccatgagcgccaaaaacggcccatctatcgctgtgggcgatacgtcaccggtgggggctgcacgcccaatcaggtggacgccagcgcgctggagatgctggtggtggaagagcttcttcgccgcgttcggccggagctcgaaccggtggtgtcggcctatcgggcgcatgcggcgtcgaacgagttgcgcacggtgcagcggaagcgccgcgtcgccctggcgcgattgagccggctcgcggatgcctacgcgtcgggcgtggtgtccgaggaggcgttttcccgcgagcaggttcgtcttctgcgcgtgcttgaggcgtgtcgggaggcggaggcgcaagcggccgccctgtcgaccaccgacgggtgggacgcatgggtgagagagctgtgcgctcgattggctggcgatccgcatctggagcgcgccttgttcctgaccgtcgtgcgggaagtgcgggtgtttcgccccaagcggtctcgcgaggtggatgtcgacctcgtcctgcgcctcgagtga

SEQ ID NO: 3026 - DNA, 1458 bp, Artificial
  Alicyclobacillus acidocaldarius mutated SEQ ID NO 3011
gtgaccgagcggcacctggcgctctacgtgcgggtttcgacggaggagcaggccgcgtcgggccacagcctgagggaacaagaggagcagctcgtcgaatatgcccggtcgcacggatttcctcggtacgaactgtattgcgacgacgggtactcggggaagtcgctcaaccgtccggcgatggagcgcctgcgcgccgacatccgggcgggatgcgtgctcggcgtggtgacgacgcgcatcgatcggctgacgcggagcgtcgcggacttcgcgcgccttgtcgacgagatgaacttgcatggcgttttttatcgctccacgaggcagaatttcgagatctcgacggcgatggggcgattggtggcgcagatgttgtccgtgatcgccgagtttgaacgcgagatgatcgcggagcgcgtgcacgaaaacctcctcgcgatggcgcagcgcggcgagcttgccacgaagccgccgttcggttatcggctggtcaacggtcgcttgacgccggatccgcgtgaggcccgatgggtgcgtgagggggcgcgccttctgttaaccggcgcgagcccgagggacgtcgccatggaattcaacgccctcggcgtgcggacgaagacggggcggctttggacggatcgcaccgtccgcacgctcttttccaacccggcgttggccggtgtctccgtttggaaccggcgcaagacgcagggcagtcggcgaaccgagcgcgaacccaccgagtgggtgtgcgtcgagggagcgcacgaggccattttgagccgcgaggaattcgaagccctgcgaggcatgctcgagcgacgccgcgcgctgtcgccgcgatcgcagggctcgaaacgcccgctcgccggcattgcgcgatgcggcttctgcggaagcgcgatgtacgcgggctggcaggtatcaaagcggggccatgagcgccaaaaacggcccatctatcgctgtgggcgatacgtcaccggtgggggctgcacgcccaatcaggtggacgccagcgcgctggagatgctggtggtggaagagcttcttcgccgcgttcggccggagctcgaaccggtggtgtcggcctataaagcgcatgcggcgtcgaacgagttgcgcacggtgcagcggaagcgccgcgtcgccctggcgcgattgagccggctcgcggaagcctacgcgtcgggcgtggtgtccgaggaggcgttttcccgcgagcaggttcgtcttctgcgcgtgcttgaggcgtgtcgggaggcggaggcgcaagcggccgccctgtcgaccaccgacgggtgggacgcatgggtgagagagctgtgcgctcgattggctggcgatccgcatctggagcgcgccttgttcctgaccgtcgtgcgggaagtgcgggtgtttcgccccaagcggtctcgcgaggtggatgtcgacctcgtcctgcgcctcgagtga

SEQ ID NO: 3027 - protein, 277 aa, Alicyclobacillus acidocaldarius
MEVQFMTVLRSYLQWPGGKSHIVTALRAFLPPGRRLIEPFVGAGSVFLNANYPEYLLGDANGDLILTHQMLQAHGEAFIEACRDLFVPENNTPDRYYELRDEFNSTADPWRKAILFVYLNRHGFHGLCRYTRNGDFNVSFGYRKTVYFPEEEMRYFAEKAKQATFVCADFRDLLERVEPGDVVYCDPPYVPLSRTSNFTEYAPTRFSWRDHTQLAGYAQALTERGVTVVISNHRRPAVESLYRGAEIHVVEAPRNIVNRYRQATHVIEELIAVFRAL

SEQ ID NO: 3028 - DNA, 834 bp, Alicyclobacillus acidocaldarius
gtggaggtgcagttcatgaccgtccttcgctcctacctgcaatggcccggcggcaaatcccacatcgtcaccgcccttcgcgcgttcctgccgcccggccgtaggctgatcgagcctttcgtcggcgcgggttcggtgttcctgaacgccaattatcccgaatacctgctcggcgacgccaacggcgacctgatcctcacacaccagatgctccaagcgcacggcgaagcgttcattgaagcctgccgtgatctgttcgtgcccgagaacaacacgcctgatcgctactacgaactccgggatgagttcaacagcacagcggatccatggcgcaaggccatcctgttcgtctacctcaatcgccacggtttccatggcctatgtcggtacactcggaacggagactttaatgtgtcgttcggctaccgaaaaacggtgtacttcccggaagaggaaatgcggtacttcgccgagaaggcgaagcaggcgacgttcgtgtgcgcggactttcgggatctgttggagagagtcgagccaggagatgtggtgtactgtgatccgccttacgtgccgttgtcgcgaacgtcgaacttcacggagtacgcgccgacgcgcttttcgtggcgagaccatacccagttggcgggttatgcccaggcgctgactgaacgtggggttaccgtcgtgatctcgaatcaccgcagacccgcagtcgaatctttgtatcggggtgcggaaatccatgtcgtcgaggcgccgcgaaatatcgtaaatcggtatcgacaggcaacgcatgtcatcgaagagttgatcgcggtctttcgagcattgtga

SEQ ID NO: 3029 - protein, 270 aa, Moritella  PE36
MQKTRAFLKWAGGKYSLVDHLREKLPAGKRLVEPFVGAGSVFLNTDYDEYLLNDINPDLINMYKILQHKPEQFIADAQRFFTPEFNDKERYYKIREKFNKTSNPYQRSLMFLYMNRHGFNGLCRYNKSGGFNVPFGSYKKPYFPLKELRFFAEKSKKATFICESYSDVYKRLGSDDVVYCDPPYAPLSRTASFTSYSASGFSLDDQALLAKVSRETSQERNIPILISNHDIPLTRELYHGSTFEVVQVKRTISRNAGKRNKVDELLALYR

SEQ ID NO: 3030 - protein, 267 aa, Photobacterium profundum
RAFLKWAGGKYSLVEEIQRHLPPARKLVEPFVGAGSVFLNTDFEQYLLADINPDLINLYNILKDDPEKYVEDVRKLFTPEFNQKEEYLKIREEFNKTQDPYVRSLYFLYMNRHGFNGLCRYNKKGGFNVPFGSYKKPYFPEKEMYFFAEKAKRATFVCEGYQQTFSRARKGCVVYCDPPYAPLSTTANFTSYAGNGFSLDDQADLADVAEKAATEREIPVLISNHDTKLTRRLYHGADLSVVKVRRTISRNGSGRNKVDELLALFKS

SEQ ID NO: 3031 - protein, 267 aa, Photobacterium profundum
RAFLKWAGGKYSLVEEIQRHLPPARKLVEPFVGAGSVFLNTDFEQYLLADINPDLINLYNILKDDPEKYIEDVRKLFTPEFNQKEEYLKIREEFNKTQDPYVRSLYFLYMNRHGFNGLCRYNKKGGFNVPFGSYKKPYFPEKEMYFFAEKAKRATFVCEGYQQTFSRARKGCVVYCDPPYAPLSSTANFTSYTGNGFSLDDQADLADVAEKAATEREIPVLISNHDTKLTRRLYHGADLSVVKVRRTISRNGSGRNKVDELLALFKS

SEQ ID NO: 3032 - protein, 265 aa, Vibrio angustum
RAFLKWAGGKYSLVEDIKRHLPPARKLVEPFVGAGSVFLNTDYDHYLLADINPDLINLYNILKHEPERYIEDARKLFTPEYNNKEAYLKIREEFNASDDPYLRSLYFLYMNRHGFNGLCRYNKKGGFNVPFGSYKKPYFPEAEMYYFSEKAKRATFVCEGYLQTFSRARKGCVVYCDPPYAPLSSTANFTSYSGNGFSLDDQATLADVAEKAAAERDIAVLISNHDTALTRRLYTGADLSVVKAKRTISRNGSGRNKVDELLALF

SEQ ID NO: 3033 - protein, 265 aa, Photobacterium  SKA34
RAFLKWAGGKYSLVEDIKRHLPPARKLVEPFVGAGSVFLNTDYDHYLLADINPDLINLYNILKHEPERYVEDARKLFTPEYNNKEAYLKIREEFNASDDPYLRSLYFLYMNRHGFNGLCRYNKKGGFNVPFGSYKKPYFPEAEMYYFSEKAKRATFVCEGYLQTFSRARKGCVVYCDPPYAPLSSTANFTSYSGNGFSLDDQATLADVAEKAAAERDIAVLISNHDTALTRRLYTGADLSVVKVKRTISRNGSGRNKVDELLALF

SEQ ID NO: 3034 - protein, 277 aa, Artificial
  Alicyclobacillus acidocaldarius mutated SEQ ID NO 3027
MEVQFMTVLRSYLQWPGGKSHIVTALRAFLPPGRRLIEPFVGAGSVFLNANYPEYLLGDANGDLILTHQMLQAHGEAFIEACRDLFVPENNTPDKYYELRDEFNSTADPWRKAILFVYLNRHGFHGLCRYTRNGDFNVSFGYRKTVYFPEEEMRYFAEKAKQATFVCADFRDLLERVEPGDVVYCDPPYVPLSRTSNFTEYAPTRFSWRDHTQLAGYAQALTERGVTVVISNHRRPAVESLYRGAEIHVVEAPRNIVNRYRQATHVIEELIAVFRAL

SEQ ID NO: 3035 - protein, 277 aa, Artificial
  Alicyclobacillus acidocaldarius mutated SEQ ID NO 3027
MEVQFMTVLRSYLQWPGGKSHIVTALRAFLPPGRRLIEPFVGAGSVFLNANYPEYLLGDANGDLILTHQMLQAHGEAFIEACRELFVPENNTPDRYYELRDEFNSTADPWRKAILFVYLNRHGFHGLCRYTRNGDFNVSFGYRKTVYFPEEEMRYFAEKAKQATFVCADFRDLLERVEPGDVVYCDPPYVPLSRTSNFTEYAPTRFSWRDHTQLAGYAQALTERGVTVVISNHRRPAVESLYRGAEIHVVEAPRNIVNRYRQATHVIEELIAVFRAL

SEQ ID NO: 3036 - protein, 277 aa, Artificial
  Alicyclobacillus acidocaldarius mutated SEQ ID NO 3027
MEVQFMTVLRSYLQWPGGKSHIVTALRAFLPPGRRLIEPFVGAGSVFLNANYPEYLLGDANGDLILTHQMLQAHGEAFIEACRDLFVPENNTPDRYYELRDEFNSTADPWRKAILFVYLNRHGFHGLCRYTRNGDFNVSFGYRKTVYFPEEEMRYFAEKAKQATFVCADFRDILERVEPGDVVYCDPPYVPLSRTSNFTEYAPTRFSWRDHTQLAGYAQALTERGVTVVISNHRRPAVESLYRGAEIHVVEAPRNIVNRYRQATHVIEELIAVFRAL

SEQ ID NO: 3037 - protein, 277 aa, Artificial
  Alicyclobacillus acidocaldarius mutated SEQ ID NO 3027
MEVQFMTVLRSYLQWPGGKSHIVTALRAFLPPGRRLIEPFVGAGSVFLNANYPEYLLGDANGDLILTHQMLQAHGEAFIEACRDLFVPENNTPDRYYELRDEFNSTADPWRKAILFVYLNRHGFHGLCRYTRNGDFNVSFGYRKTVYFPEEEMRYFAEKAKQATFVCADFRDLLERVEPGDVVYCDPPYVPLSRTSNFTEYAPTRFSWRDHTQLAGYAQALTERGVTVVISNHRRPAVESLYRGADIHVVEAPRNIVNRYRQATHVIEELIAVFRAL

SEQ ID NO: 3038 - protein, 277 aa, Artificial
  Alicyclobacillus acidocaldarius mutated SEQ ID NO 3027
MEVQFMTVLRSYLQWPGGKSHIVTALRAFLPPGRRLIEPFVGAGSVFLNANYPEYLLGDANGDLILTHQMLQAHGEAFIEACRDLFVPENNTPDRYYELRDEFNSTADPWRKAILFVYLNRHGFHGLCRYTRNGDFNVSFGYKKTVYFPEEEMRYFAEKAKQATFVCADFRDLLERVEPGDVVYCDPPYVPLSRTSNFTEYAPTRFSWRDHTQLAGYAQALTERGVTVVISNHRRPAVESLYRGAEIHVVEAPRNIVNRYRQATHVIEELIAVFRAL

SEQ ID NO: 3039 - DNA, 834 bp, Artificial
  Alicyclobacillus acidocaldarius mutated SEQ ID NO 3028
gtggaggtgcagttcatgaccgtccttcgctcctacctgcaatggcccggcggcaaatcccacatcgtcaccgcccttcgcgcgttcctgccgcccggccgtaggctgatcgagcctttcgtcggcgcgggttcggtgttcctgaacgccaattatcccgaatacctgctcggcgacgccaacggcgacctgatcctcacacaccagatgctccaagcgcacggcgaagcgttcattgaagcctgccgtgatctgttcgtgcccgagaacaacacgcctgataaatactacgaactccgggatgagttcaacagcacagcggatccatggcgcaaggccatcctgttcgtctacctcaatcgccacggtttccatggcctatgtcggtacactcggaacggagactttaatgtgtcgttcggctaccgaaaaacggtgtacttcccggaagaggaaatgcggtacttcgccgagaaggcgaagcaggcgacgttcgtgtgcgcggactttcgggatctgttggagagagtcgagccaggagatgtggtgtactgtgatccgccttacgtgccgttgtcgcgaacgtcgaacttcacggagtacgcgccgacgcgcttttcgtggcgagaccatacccagttggcgggttatgcccaggcgctgactgaacgtggggttaccgtcgtgatctcgaatcaccgcagacccgcagtcgaatctttgtatcggggtgcggaaatccatgtcgtcgaggcgccgcgaaatatcgtaaatcggtatcgacaggcaacgcatgtcatcgaagagttgatcgcggtctttcgagcattgtga

SEQ ID NO: 3040 - DNA, 834 bp, Artificial
  Alicyclobacillus acidocaldarius mutated SEQ ID NO 3028
gtggaggtgcagttcatgaccgtccttcgctcctacctgcaatggcccggcggcaaatcccacatcgtcaccgcccttcgcgcgttcctgccgcccggccgtaggctgatcgagcctttcgtcggcgcgggttcggtgttcctgaacgccaattatcccgaatacctgctcggcgacgccaacggcgacctgatcctcacacaccagatgctccaagcgcacggcgaagcgttcattgaagcctgccgtgaactgttcgtgcccgagaacaacacgcctgatcgctactacgaactccgggatgagttcaacagcacagcggatccatggcgcaaggccatcctgttcgtctacctcaatcgccacggtttccatggcctatgtcggtacactcggaacggagactttaatgtgtcgttcggctaccgaaaaacggtgtacttcccggaagaggaaatgcggtacttcgccgagaaggcgaagcaggcgacgttcgtgtgcgcggactttcgggatctgttggagagagtcgagccaggagatgtggtgtactgtgatccgccttacgtgccgttgtcgcgaacgtcgaacttcacggagtacgcgccgacgcgcttttcgtggcgagaccatacccagttggcgggttatgcccaggcgctgactgaacgtggggttaccgtcgtgatctcgaatcaccgcagacccgcagtcgaatctttgtatcggggtgcggaaatccatgtcgtcgaggcgccgcgaaatatcgtaaatcggtatcgacaggcaacgcatgtcatcgaagagttgatcgcggtctttcgagcattgtga

SEQ ID NO: 3041 - DNA, 834 bp, Artificial
  Alicyclobacillus acidocaldarius mutated SEQ ID NO 3028
gtggaggtgcagttcatgaccgtccttcgctcctacctgcaatggcccggcggcaaatcccacatcgtcaccgcccttcgcgcgttcctgccgcccggccgtaggctgatcgagcctttcgtcggcgcgggttcggtgttcctgaacgccaattatcccgaatacctgctcggcgacgccaacggcgacctgatcctcacacaccagatgctccaagcgcacggcgaagcgttcattgaagcctgccgtgatctgttcgtgcccgagaacaacacgcctgatcgctactacgaactccgggatgagttcaacagcacagcggatccatggcgcaaggccatcctgttcgtctacctcaatcgccacggtttccatggcctatgtcggtacactcggaacggagactttaatgtgtcgttcggctaccgaaaaacggtgtacttcccggaagaggaaatgcggtacttcgccgagaaggcgaagcaggcgacgttcgtgtgcgcggactttcgggatattttggagagagtcgagccaggagatgtggtgtactgtgatccgccttacgtgccgttgtcgcgaacgtcgaacttcacggagtacgcgccgacgcgcttttcgtggcgagaccatacccagttggcgggttatgcccaggcgctgactgaacgtggggttaccgtcgtgatctcgaatcaccgcagacccgcagtcgaatctttgtatcggggtgcggaaatccatgtcgtcgaggcgccgcgaaatatcgtaaatcggtatcgacaggcaacgcatgtcatcgaagagttgatcgcggtctttcgagcattgtga

SEQ ID NO: 3042 - DNA, 834 bp, Artificial
  Alicyclobacillus acidocaldarius mutated SEQ ID NO 3028
gtggaggtgcagttcatgaccgtccttcgctcctacctgcaatggcccggcggcaaatcccacatcgtcaccgcccttcgcgcgttcctgccgcccggccgtaggctgatcgagcctttcgtcggcgcgggttcggtgttcctgaacgccaattatcccgaatacctgctcggcgacgccaacggcgacctgatcctcacacaccagatgctccaagcgcacggcgaagcgttcattgaagcctgccgtgatctgttcgtgcccgagaacaacacgcctgatcgctactacgaactccgggatgagttcaacagcacagcggatccatggcgcaaggccatcctgttcgtctacctcaatcgccacggtttccatggcctatgtcggtacactcggaacggagactttaatgtgtcgttcggctaccgaaaaacggtgtacttcccggaagaggaaatgcggtacttcgccgagaaggcgaagcaggcgacgttcgtgtgcgcggactttcgggatctgttggagagagtcgagccaggagatgtggtgtactgtgatccgccttacgtgccgttgtcgcgaacgtcgaacttcacggagtacgcgccgacgcgcttttcgtggcgagaccatacccagttggcgggttatgcccaggcgctgactgaacgtggggttaccgtcgtgatctcgaatcaccgcagacccgcagtcgaatctttgtatcggggtgcggatatccatgtcgtcgaggcgccgcgaaatatcgtaaatcggtatcgacaggcaacgcatgtcatcgaagagttgatcgcggtctttcgagcattgtga

SEQ ID NO: 3043 - DNA, 834 bp, Artificial
  Alicyclobacillus acidocaldarius mutated SEQ ID NO 3028
gtggaggtgcagttcatgaccgtccttcgctcctacctgcaatggcccggcggcaaatcccacatcgtcaccgcccttcgcgcgttcctgccgcccggccgtaggctgatcgagcctttcgtcggcgcgggttcggtgttcctgaacgccaattatcccgaatacctgctcggcgacgccaacggcgacctgatcctcacacaccagatgctccaagcgcacggcgaagcgttcattgaagcctgccgtgatctgttcgtgcccgagaacaacacgcctgatcgctactacgaactccgggatgagttcaacagcacagcggatccatggcgcaaggccatcctgttcgtctacctcaatcgccacggtttccatggcctatgtcggtacactcggaacggagactttaatgtgtcgttcggctacaaaaaaacggtgtacttcccggaagaggaaatgcggtacttcgccgagaaggcgaagcaggcgacgttcgtgtgcgcggactttcgggatctgttggagagagtcgagccaggagatgtggtgtactgtgatccgccttacgtgccgttgtcgcgaacgtcgaacttcacggagtacgcgccgacgcgcttttcgtggcgagaccatacccagttggcgggttatgcccaggcgctgactgaacgtggggttaccgtcgtgatctcgaatcaccgcagacccgcagtcgaatctttgtatcggggtgcggaaatccatgtcgtcgaggcgccgcgaaatatcgtaaatcggtatcgacaggcaacgcatgtcatcgaagagttgatcgcggtctttcgagcattgtga

SEQ ID NO: 3044 - protein, 496 aa, Alicyclobacillus acidocaldarius
MTSLSQGRRAIGLRYPGHDTLECASQLQALSRAVKQAYGGEASAARMTSRDNIGEAHVTAERRDEEVTLMRQNRVLVLDTHRRPLMPCHPARARQLLKAGRASVFRRYPFTIILHDRNGGDVQPMQLKLAPGSKTTGVALVADFQRGKTVVWAAEIQHRGDQIRQALLRRRMLRRGRRYRKTRYRKPRFDNRRRLEGWLPPSLMSRVHNIETWVARLRRWAPITHLSMQLVSFDTQKLQYPEISGEEYQQGTLYGYEVREYLLEKWGRKCAYCGAENVPLEIDHVIPRSRGGSDRVSNLVLACHRCNQAKANRPVEEFLAHDQERLHRIQAQLKLSLRDAAAMNATRWAVFRRLKDTGLPVEAGSGGRTKYNRFSQGYPKAKWIDAACVGESGQCVRLDTQMQVLTIVAKGHGKRQRCITDKYGFPRSHAPSSRSYMGFRTGDLVQAHVPRGKYAGTHVGRIVIRHRPSFQLNGFNVHPKYLKVLQRGDGYGYAME

SEQ ID NO: 3045 - DNA, 1491 bp, Alicyclobacillus acidocaldarius
ttgaccagcctcagccagggccgtagggccatcgggctacgttatcccggtcatgacaccctggagtgcgcgagccagctccaggccctgtcgcgggcggttaaacaggcatacgggggcgaagccagtgccgctcgcatgacaagccgggataacattggcgaggctcacgtgaccgccgaaaggcgagacgaggaggtaactctgatgcggcaaaaccgcgtactggttctggacacgcatcgacgaccgcttatgccgtgccatccggcgcgcgcgaggcaactgctgaaagctggccgggcgtcggtgtttcggcggtatccgttcacgatcatcttgcatgaccgtaacggtggtgacgttcaacccatgcaactcaaacttgcacctggttcaaagaccacaggcgtggcgcttgttgcagactttcaacgcgggaagacggttgtgtgggctgctgagatccagcatcgcggcgatcagatccgacaggcgctgttgagaaggcgaatgttgcgtcgaggtcgccgatatcgaaagacccgttatcgcaagccgcgctttgacaatcgtcgacggctcgaaggttggctcccgccgagcctaatgagccgggtgcacaacatcgagacgtgggtcgctcgcctgcggcgttgggcaccgatcacacatctctcgatgcaattggtgagtttcgacacgcagaagctccagtacccggagatcagcggcgaggagtatcagcaaggcacactttacgggtacgaagttcgggagtacctgctggagaagtggggccgaaagtgcgcgtactgcggtgccgagaatgtaccgctagagatcgaccacgtgattccgcgttctcgcggtggatctgatcgcgtatcgaatctggtgcttgcctgccaccgatgcaatcaagcaaaggctaatcgaccggtggaggagttcctggcgcatgaccaagaacgtctgcatcggattcaagcgcagttgaaactttcgcttcgtgacgccgcggcgatgaacgctacgcgatgggcggtgttccgtcgactgaaggacacaggattgcctgttgaagccggaagcggcggtcggacgaaatacaaccgattctcgcaaggctatccgaaggcgaagtggattgacgcggcttgtgtcggtgagtctgggcagtgcgtccgtctggacacacagatgcaagttctcacgattgtggcaaaggggcatgggaagcgacaacgctgcatcacagacaaatacggtttcccgagaagccacgcaccgtcttcgagatcgtacatgggtttccgcacaggcgatctggtacaggcgcatgtcccgcgagggaagtacgccgggacacatgttgggcgcattgtgatccggcatcggccaagttttcaactcaacggatttaatgtgcatcccaaatatttgaaggttttgcagcgaggcgacggatatgggtacgcgatggaatga

SEQ ID NO: 3046 - protein, 428 aa, Petrotoga mobilis
RVFVLDKNKQPLMPCHPARARELLKKGKAAVFRYHPFTIILKDREGGDTQPIQVKIDPGSKITGVTLVGDFKNGKKVIWGAEIHHRGQSIKKALDTRRGVRRSRRNRKIRYRIARFDNRKRSKGWLPPSLISRVENILTWIKRIRRFSPITGISLELVRFDTQKLQDPEINGIEYQRGTLYGYEIKEYLLEKWGRKCVYCGKENVPLEIEHIVPKSKGGSDRISNLTLACHECNQKKGNQSIEEFLTNNPERLKQIKSESKRPLKDTAALNATRWYIFNQLRGNSLTAGKEELPIEVGTGGRTKYNRETQNYPKKHWIDAACVGESGQNVQIEPDMQVLEIKAMGHGMRRMCFVDKYGFPKKYRPKERTYMGYKTGDIVLAVIPKGKNMGIHIGRIAIRHRPSFLLNGVGDVHPKYLTLLQKNDGYGY

SEQ ID NO: 3047 - protein, 422 aa, Acidithiobacillus caldus
RVLVLDKNRQPLMPCHPARARQLLRRGKAAVFRRFPFTIILKDRESGVTQPTVLKLDPGSNTTGLALVADFARRGKVLVWAAELRHRGAAIRKALADRRAHRRFRRFKLRYRPARFNNRTRPSGWLAPSLQHRVDTTMTWVQRLMRWTPVTSLSQELVRFDTQAMQNPEISGVEYQQGTLFGYEVREYLLEKWVRKCAYCDAENVPLTIDHIHPRSKGGSNRVSNLTLACFPCNQRKGNRDVAEFLDRDPKRLARIEAQRRAPLQDAAAVNSIRWALWRNLVATGLDVEVGTGGRTKRNRSQQQYPKEHWIDAACVGESGANVRLDPFHKPLAIQAMGHGERQRARLNRYGFPRGYKLRARSYLGFRTGDVVFCAKPKIEVFAGRVAIRFRPSFVVTGADRKVESHPKYLSMIQKGDGYAYA

SEQ ID NO: 3048 - protein, 422 aa, Cyanothece  CCY0110
VFVLSKDKRPLSPCHQARARKLLKQGKAAVYRKYPFTIILKEEVNPNKPKPCRIKLDPGAKVTGIALIQGDRVIFGAELEHRGFRIKDSLESRRQLRRGRRGRKTRYRKPRFLNRTRPKGWLPPSLQSRVENINTWVNRLRKLCPVDSISVELVRFDTQQLENPEISGVEYQQGTLFGYEVREYLLEKYNRTCQYCGAKEVPFEIEHIVPKSKGGSDRVSNLTLSCHKCNQKKGNRSVEEFLKGKPEVLKRVKANAKKPLRDAAAVNAARWAVFNRLKASGLEVEAGSGGLTKFNRTKHELPKTHWLDAACVGKSTPSKLRMLVQKPLKIKATGHGTRQMCRTNKYGFPTRYVPHKKDVKGFQTGDIVKAVVTKGKKTGIYVGRVAVRSTGSFNISTAKGVIQGINHKYCRQIHKKDGYSYA

SEQ ID NO: 3049 - protein, 425 aa, Nostoc PCC
KVFVIDNEKRSLNPIHPAQARQLLKRGKAAVFRRFPFTIVVKESYTDATVSPLRLKFDPGAKYTGIALVNDVNGEVVFAAELKHRGFAIRDALTSRRQLRRSRRSRKTRYRQPRFFNRTRPQGWLAPSLQSRVENIKTWVNRLRKVAPITAISQELVKFDTQLIRHPDIQGKEYQQGTLAGFETRQYFLEKWNRECAYCGIKDVPLQIEHIHPKSKGGSNSITNLTLSCEKCNLKKGTQDIKNFLKKDKSRLEKILALTKKSLADAAAVNTTRFALLEVLKSTGLPVEIGSGGLTKFNRTQQGLNKSHWLDACCVGASTPILKIKGIRLLLITANGHGTRQSCRTDKYGFPIRHCSRTKFHFGFQTGDIVKAVVTKGKKIGTYIGRIATRATGSFNISTVQGLIQGISHKYCKTIHKKDGYAYAI

SEQ ID NO: 3050 - protein, 425 aa, Anabaena variabilis
KVFVINKEKRPLNPIHPAQARQLLRSGKAAVFKRFPFTIIVKESNVNTNVSPLRLKLDPGAKTTGIAIINDANDEVVFAAELKHRGFAIRDAITSRRQLRRSRRNRKTRYRQPRFLNRTKPEGWLAPSLQSRVENIKTWVSKLRKVAPITAISQELVKFDMQLIRRPDIQGKEYQQGTLAGFETRQYLLEKWNRECAYCGIKDVPLQIEHIHPKSKGGSNSITNLTLSCEKCNLRKGNQDIRDYLEKDKPRLEKILALTKKPLADAAAVNATRFALLYALKSTGLPIETGSGGLTKFNRTQQALNKSHWLDACCVGASTPILKIKGIKPLLITANGHGTRQSCRTDKYGLPVRHCSRTKFHFGFQTGDIVKAVVTKGKKVGTYVGRIATRATGSFNISTAKGLIQGISHKYCKTIHKKDGYAYGI

SEQ ID NO: 3051 - protein, 496 aa, Artificial
  Alicyclobacillus acidocaldarius mutated SEQ ID NO 3044
MTSLSQGRRAIGLRYPGHDTLECASQLQALSRAVKQAYGGEASAARMTSRDNIGEAHVTAERRDEEVTLMRQNRVLVLDTHRRPLMPCHPARARQLLKAGRASVFRRYPFTIILHDRNGGDVQPMQLKLAPGSKTTGVALVADFQRGKTVVWAAEIQHRGDQIRQALLRRRMLRRGRRYRKTRYRKPRFDNRRRLEGWLPPSLMSRVHNIETWVARLRRWAPITHLSMQLVSFDTQKLQYPEISGEEYQQGTLYGYEVREYLLEKWGRKCAYCGAENVPLEIDHVIPRSRGGSDRVSNLVLACHRCNQAKANRPVEEFLAHDQERLHRIQAQLKLSLRDAAAMNATRWAVFRRLKDTGLPVEAGSGGRTKYNRFSQGYPKAKWIDAACVGESGQCVRLDTQMQVLTIVAKGHGKRQRCITDKYGFPRSHAPSSRSYMGFRTGDLVQAHVPRGKYAGTHIGRIVIRHRPSFQLNGFNVHPKYLKVLQRGDGYGYAME

SEQ ID NO: 3052 - protein, 496 aa, Artificial
  Alicyclobacillus acidocaldarius mutated SEQ ID NO 3044
MTSLSQGRRAIGIRYPGHDTLECASQLQALSRAVKQAYGGEASAARMTSRDNIGEAHVTAERRDEEVTLMRQNRVLVLDTHRRPLMPCHPARARQLLKAGRASVFRRYPFTIILHDRNGGDVQPMQLKLAPGSKTTGVALVADFQRGKTVVWAAEIQHRGDQIRQALLRRRMLRRGRRYRKTRYRKPRFDNRRRLEGWLPPSLMSRVHNIETWVARLRRWAPITHLSMQLVSFDTQKLQYPEISGEEYQQGTLYGYEVREYLLEKWGRKCAYCGAENVPLEIDHVIPRSRGGSDRVSNLVLACHRCNQAKANRPVEEFLAHDQERLHRIQAQLKLSLRDAAAMNATRWAVFRRLKDTGLPVEAGSGGRTKYNRFSQGYPKAKWIDAACVGESGQCVRLDTQMQVLTIVAKGHGKRQRCITDKYGFPRSHAPSSRSYMGFRTGDLVQAHVPRGKYAGTHVGRIVIRHRPSFQLNGFNVHPKYLKVLQRGDGYGYAME

SEQ ID NO: 3053 - protein, 496 aa, Artificial
  Alicyclobacillus acidocaldarius mutated SEQ ID NO 3044
MTSLSQGRRAIGLRYPGHDTLECASQLQALSRAVKQAYGGEASAARMTSRDNIGEAHVTAERRDEEVTIMRQNRVLVLDTHRRPLMPCHPARARQLLKAGRASVFRRYPFTIILHDRNGGDVQPMQLKLAPGSKTTGVALVADFQRGKTVVWAAEIQHRGDQIRQALLRRRMLRRGRRYRKTRYRKPRFDNRRRLEGWLPPSLMSRVHNIETWVARLRRWAPITHLSMQLVSFDTQKLQYPEISGEEYQQGTLYGYEVREYLLEKWGRKCAYCGAENVPLEIDHVIPRSRGGSDRVSNLVLACHRCNQAKANRPVEEFLAHDQERLHRIQAQLKLSLRDAAAMNATRWAVFRRLKDTGLPVEAGSGGRTKYNRFSQGYPKAKWIDAACVGESGQCVRLDTQMQVLTIVAKGHGKRQRCITDKYGFPRSHAPSSRSYMGFRTGDLVQAHVPRGKYAGTHVGRIVIRHRPSFQLNGFNVHPKYLKVLQRGDGYGYAME

SEQ ID NO: 3054 - protein, 496 aa, Artificial
  Alicyclobacillus acidocaldarius mutated SEQ ID NO 3044
MTSISQGRRAIGLRYPGHDTLECASQLQALSRAVKQAYGGEASAARMTSRDNIGEAHVTAERRDEEVTLMRQNRVLVLDTHRRPLMPCHPARARQLLKAGRASVFRRYPFTIILHDRNGGDVQPMQLKLAPGSKTTGVALVADFQRGKTVVWAAEIQHRGDQIRQALLRRRMLRRGRRYRKTRYRKPRFDNRRRLEGWLPPSLMSRVHNIETWVARLRRWAPITHLSMQLVSFDTQKLQYPEISGEEYQQGTLYGYEVREYLLEKWGRKCAYCGAENVPLEIDHVIPRSRGGSDRVSNLVLACHRCNQAKANRPVEEFLAHDQERLHRIQAQLKLSLRDAAAMNATRWAVFRRLKDTGLPVEAGSGGRTKYNRFSQGYPKAKWIDAACVGESGQCVRLDTQMQVLTIVAKGHGKRQRCITDKYGFPRSHAPSSRSYMGFRTGDLVQAHVPRGKYAGTHVGRIVIRHRPSFQLNGFNVHPKYLKVLQRGDGYGYAME

SEQ ID NO: 3055 - protein, 496 aa, Artificial
  Alicyclobacillus acidocaldarius mutated SEQ ID NO 3044
MTSLSQGRRAIGLRYPGHDTLECASQLQALSRAVKQAYGGEASAARMTSRDNIGEAHVTAERRDEEVTLMRQNRVLVLDTHRRPLMPCHPARARQLLKAGRASVFRRYPFTIILHDRNGGDVQPMQLKLAPGSKTTGVALVADFQRGKTVVWAAEIQHRGDQIRQALLRRRMLRRGRRYRKTRYRKPRFENRRRLEGWLPPSLMSRVHNIETWVARLRRWAPITHLSMQLVSFDTQKLQYPEISGEEYQQGTLYGYEVREYLLEKWGRKCAYCGAENVPLEIDHVIPRSRGGSDRVSNLVLACHRCNQAKANRPVEEFLAHDQERLHRIQAQLKLSLRDAAAMNATRWAVFRRLKDTGLPVEAGSGGRTKYNRFSQGYPKAKWIDAACVGESGQCVRLDTQMQVLTIVAKGHGKRQRCITDKYGFPRSHAPSSRSYMGFRTGDLVQAHVPRGKYAGTHVGRIVIRHRPSFQLNGFNVHPKYLKVLQRGDGYGYAME

SEQ ID NO: 3056 - DNA, 1491 bp, Artificial
  Alicyclobacillus acidocaldarius mutated SEQ ID NO 3045
ttgaccagcctcagccagggccgtagggccatcgggctacgttatcccggtcatgacaccctggagtgcgcgagccagctccaggccctgtcgcgggcggttaaacaggcatacgggggcgaagccagtgccgctcgcatgacaagccgggataacattggcgaggctcacgtgaccgccgaaaggcgagacgaggaggtaactctgatgcggcaaaaccgcgtactggttctggacacgcatcgacgaccgcttatgccgtgccatccggcgcgcgcgaggcaactgctgaaagctggccgggcgtcggtgtttcggcggtatccgttcacgatcatcttgcatgaccgtaacggtggtgacgttcaacccatgcaactcaaacttgcacctggttcaaagaccacaggcgtggcgcttgttgcagactttcaacgcgggaagacggttgtgtgggctgctgagatccagcatcgcggcgatcagatccgacaggcgctgttgagaaggcgaatgttgcgtcgaggtcgccgatatcgaaagacccgttatcgcaagccgcgctttgacaatcgtcgacggctcgaaggttggctcccgccgagcctaatgagccgggtgcacaacatcgagacgtgggtcgctcgcctgcggcgttgggcaccgatcacacatctctcgatgcaattggtgagtttcgacacgcagaagctccagtacccggagatcagcggcgaggagtatcagcaaggcacactttacgggtacgaagttcgggagtacctgctggagaagtggggccgaaagtgcgcgtactgcggtgccgagaatgtaccgctagagatcgaccacgtgattccgcgttctcgcggtggatctgatcgcgtatcgaatctggtgcttgcctgccaccgatgcaatcaagcaaaggctaatcgaccggtggaggagttcctggcgcatgaccaagaacgtctgcatcggattcaagcgcagttgaaactttcgcttcgtgacgccgcggcgatgaacgctacgcgatgggcggtgttccgtcgactgaaggacacaggattgcctgttgaagccggaagcggcggtcggacgaaatacaaccgattctcgcaaggctatccgaaggcgaagtggattgacgcggcttgtgtcggtgagtctgggcagtgcgtccgtctggacacacagatgcaagttctcacgattgtggcaaaggggcatgggaagcgacaacgctgcatcacagacaaatacggtttcccgagaagccacgcaccgtcttcgagatcgtacatgggtttccgcacaggcgatctggtacaggcgcatgtcccgcgagggaagtacgccgggacacatattgggcgcattgtgatccggcatcggccaagttttcaactcaacggatttaatgtgcatcccaaatatttgaaggttttgcagcgaggcgacggatatgggtacgcgatggaatga

SEQ ID NO: 3057 - DNA, 1491 bp, Artificial
  Alicyclobacillus acidocaldarius mutated SEQ ID NO 3045
ttgaccagcctcagccagggccgtagggccatcgggattcgttatcccggtcatgacaccctggagtgcgcgagccagctccaggccctgtcgcgggcggttaaacaggcatacgggggcgaagccagtgccgctcgcatgacaagccgggataacattggcgaggctcacgtgaccgccgaaaggcgagacgaggaggtaactctgatgcggcaaaaccgcgtactggttctggacacgcatcgacgaccgcttatgccgtgccatccggcgcgcgcgaggcaactgctgaaagctggccgggcgtcggtgtttcggcggtatccgttcacgatcatcttgcatgaccgtaacggtggtgacgttcaacccatgcaactcaaacttgcacctggttcaaagaccacaggcgtggcgcttgttgcagactttcaacgcgggaagacggttgtgtgggctgctgagatccagcatcgcggcgatcagatccgacaggcgctgttgagaaggcgaatgttgcgtcgaggtcgccgatatcgaaagacccgttatcgcaagccgcgctttgacaatcgtcgacggctcgaaggttggctcccgccgagcctaatgagccgggtgcacaacatcgagacgtgggtcgctcgcctgcggcgttgggcaccgatcacacatctctcgatgcaattggtgagtttcgacacgcagaagctccagtacccggagatcagcggcgaggagtatcagcaaggcacactttacgggtacgaagttcgggagtacctgctggagaagtggggccgaaagtgcgcgtactgcggtgccgagaatgtaccgctagagatcgaccacgtgattccgcgttctcgcggtggatctgatcgcgtatcgaatctggtgcttgcctgccaccgatgcaatcaagcaaaggctaatcgaccggtggaggagttcctggcgcatgaccaagaacgtctgcatcggattcaagcgcagttgaaactttcgcttcgtgacgccgcggcgatgaacgctacgcgatgggcggtgttccgtcgactgaaggacacaggattgcctgttgaagccggaagcggcggtcggacgaaatacaaccgattctcgcaaggctatccgaaggcgaagtggattgacgcggcttgtgtcggtgagtctgggcagtgcgtccgtctggacacacagatgcaagttctcacgattgtggcaaaggggcatgggaagcgacaacgctgcatcacagacaaatacggtttcccgagaagccacgcaccgtcttcgagatcgtacatgggtttccgcacaggcgatctggtacaggcgcatgtcccgcgagggaagtacgccgggacacatgttgggcgcattgtgatccggcatcggccaagttttcaactcaacggatttaatgtgcatcccaaatatttgaaggttttgcagcgaggcgacggatatgggtacgcgatggaatga

SEQ ID NO: 3058 - DNA, 1491 bp, Artificial
  Alicyclobacillus acidocaldarius mutated SEQ ID NO 3045
ttgaccagcctcagccagggccgtagggccatcgggctacgttatcccggtcatgacaccctggagtgcgcgagccagctccaggccctgtcgcgggcggttaaacaggcatacgggggcgaagccagtgccgctcgcatgacaagccgggataacattggcgaggctcacgtgaccgccgaaaggcgagacgaggaggtaactattatgcggcaaaaccgcgtactggttctggacacgcatcgacgaccgcttatgccgtgccatccggcgcgcgcgaggcaactgctgaaagctggccgggcgtcggtgtttcggcggtatccgttcacgatcatcttgcatgaccgtaacggtggtgacgttcaacccatgcaactcaaacttgcacctggttcaaagaccacaggcgtggcgcttgttgcagactttcaacgcgggaagacggttgtgtgggctgctgagatccagcatcgcggcgatcagatccgacaggcgctgttgagaaggcgaatgttgcgtcgaggtcgccgatatcgaaagacccgttatcgcaagccgcgctttgacaatcgtcgacggctcgaaggttggctcccgccgagcctaatgagccgggtgcacaacatcgagacgtgggtcgctcgcctgcggcgttgggcaccgatcacacatctctcgatgcaattggtgagtttcgacacgcagaagctccagtacccggagatcagcggcgaggagtatcagcaaggcacactttacgggtacgaagttcgggagtacctgctggagaagtggggccgaaagtgcgcgtactgcggtgccgagaatgtaccgctagagatcgaccacgtgattccgcgttctcgcggtggatctgatcgcgtatcgaatctggtgcttgcctgccaccgatgcaatcaagcaaaggctaatcgaccggtggaggagttcctggcgcatgaccaagaacgtctgcatcggattcaagcgcagttgaaactttcgcttcgtgacgccgcggcgatgaacgctacgcgatgggcggtgttccgtcgactgaaggacacaggattgcctgttgaagccggaagcggcggtcggacgaaatacaaccgattctcgcaaggctatccgaaggcgaagtggattgacgcggcttgtgtcggtgagtctgggcagtgcgtccgtctggacacacagatgcaagttctcacgattgtggcaaaggggcatgggaagcgacaacgctgcatcacagacaaatacggtttcccgagaagccacgcaccgtcttcgagatcgtacatgggtttccgcacaggcgatctggtacaggcgcatgtcccgcgagggaagtacgccgggacacatgttgggcgcattgtgatccggcatcggccaagttttcaactcaacggatttaatgtgcatcccaaatatttgaaggttttgcagcgaggcgacggatatgggtacgcgatggaatga

SEQ ID NO: 3059 - DNA, 1491 bp, Artificial
  Alicyclobacillus acidocaldarius mutated SEQ ID NO 3045
ttgaccagcattagccagggccgtagggccatcgggctacgttatcccggtcatgacaccctggagtgcgcgagccagctccaggccctgtcgcgggcggttaaacaggcatacgggggcgaagccagtgccgctcgcatgacaagccgggataacattggcgaggctcacgtgaccgccgaaaggcgagacgaggaggtaactctgatgcggcaaaaccgcgtactggttctggacacgcatcgacgaccgcttatgccgtgccatccggcgcgcgcgaggcaactgctgaaagctggccgggcgtcggtgtttcggcggtatccgttcacgatcatcttgcatgaccgtaacggtggtgacgttcaacccatgcaactcaaacttgcacctggttcaaagaccacaggcgtggcgcttgttgcagactttcaacgcgggaagacggttgtgtgggctgctgagatccagcatcgcggcgatcagatccgacaggcgctgttgagaaggcgaatgttgcgtcgaggtcgccgatatcgaaagacccgttatcgcaagccgcgctttgacaatcgtcgacggctcgaaggttggctcccgccgagcctaatgagccgggtgcacaacatcgagacgtgggtcgctcgcctgcggcgttgggcaccgatcacacatctctcgatgcaattggtgagtttcgacacgcagaagctccagtacccggagatcagcggcgaggagtatcagcaaggcacactttacgggtacgaagttcgggagtacctgctggagaagtggggccgaaagtgcgcgtactgcggtgccgagaatgtaccgctagagatcgaccacgtgattccgcgttctcgcggtggatctgatcgcgtatcgaatctggtgcttgcctgccaccgatgcaatcaagcaaaggctaatcgaccggtggaggagttcctggcgcatgaccaagaacgtctgcatcggattcaagcgcagttgaaactttcgcttcgtgacgccgcggcgatgaacgctacgcgatgggcggtgttccgtcgactgaaggacacaggattgcctgttgaagccggaagcggcggtcggacgaaatacaaccgattctcgcaaggctatccgaaggcgaagtggattgacgcggcttgtgtcggtgagtctgggcagtgcgtccgtctggacacacagatgcaagttctcacgattgtggcaaaggggcatgggaagcgacaacgctgcatcacagacaaatacggtttcccgagaagccacgcaccgtcttcgagatcgtacatgggtttccgcacaggcgatctggtacaggcgcatgtcccgcgagggaagtacgccgggacacatgttgggcgcattgtgatccggcatcggccaagttttcaactcaacggatttaatgtgcatcccaaatatttgaaggttttgcagcgaggcgacggatatgggtacgcgatggaatga

SEQ ID NO: 3060 - DNA, 1491 bp, Artificial
  Alicyclobacillus acidocaldarius mutated SEQ ID NO 3045
ttgaccagcctcagccagggccgtagggccatcgggctacgttatcccggtcatgacaccctggagtgcgcgagccagctccaggccctgtcgcgggcggttaaacaggcatacgggggcgaagccagtgccgctcgcatgacaagccgggataacattggcgaggctcacgtgaccgccgaaaggcgagacgaggaggtaactctgatgcggcaaaaccgcgtactggttctggacacgcatcgacgaccgcttatgccgtgccatccggcgcgcgcgaggcaactgctgaaagctggccgggcgtcggtgtttcggcggtatccgttcacgatcatcttgcatgaccgtaacggtggtgacgttcaacccatgcaactcaaacttgcacctggttcaaagaccacaggcgtggcgcttgttgcagactttcaacgcgggaagacggttgtgtgggctgctgagatccagcatcgcggcgatcagatccgacaggcgctgttgagaaggcgaatgttgcgtcgaggtcgccgatatcgaaagacccgttatcgcaagccgcgctttgaaaatcgtcgacggctcgaaggttggctcccgccgagcctaatgagccgggtgcacaacatcgagacgtgggtcgctcgcctgcggcgttgggcaccgatcacacatctctcgatgcaattggtgagtttcgacacgcagaagctccagtacccggagatcagcggcgaggagtatcagcaaggcacactttacgggtacgaagttcgggagtacctgctggagaagtggggccgaaagtgcgcgtactgcggtgccgagaatgtaccgctagagatcgaccacgtgattccgcgttctcgcggtggatctgatcgcgtatcgaatctggtgcttgcctgccaccgatgcaatcaagcaaaggctaatcgaccggtggaggagttcctggcgcatgaccaagaacgtctgcatcggattcaagcgcagttgaaactttcgcttcgtgacgccgcggcgatgaacgctacgcgatgggcggtgttccgtcgactgaaggacacaggattgcctgttgaagccggaagcggcggtcggacgaaatacaaccgattctcgcaaggctatccgaaggcgaagtggattgacgcggcttgtgtcggtgagtctgggcagtgcgtccgtctggacacacagatgcaagttctcacgattgtggcaaaggggcatgggaagcgacaacgctgcatcacagacaaatacggtttcccgagaagccacgcaccgtcttcgagatcgtacatgggtttccgcacaggcgatctggtacaggcgcatgtcccgcgagggaagtacgccgggacacatgttgggcgcattgtgatccggcatcggccaagttttcaactcaacggatttaatgtgcatcccaaatatttgaaggttttgcagcgaggcgacggatatgggtacgcgatggaatga

SEQ ID NO: 3061 - protein, 153 aa, Alicyclobacillus acidocaldarius
MQQTWAVFANGTQVRVFWVDGEPLFDAMGVCEAVGLRNVEKALRRLDDDEQGSVILEGLDGREEIHVVRESGMLRLSLVGKDEHARALQRWATREVLPSVIRTGRYGEPDIEQEQLQLQKATLLFNTLAMFRDRLFDETVQNLANAMADVLRG

SEQ ID NO: 3062 - DNA, 462 bp, Alicyclobacillus acidocaldarius
atgcaacagacttgggcagtcttcgcaaacggtacccaagtgcgtgtcttctgggtcgacggcgaaccgctgtttgacgctatgggcgtgtgtgaggcggtgggtcttcgcaacgtcgagaaggcgcttcgacggttggatgacgatgagcagggcagtgtgattctcgaaggcctagacggacgtgaggagatccatgtggtacgcgagtcgggtatgctgcgcctgtcactcgtcggcaaggatgaacacgcgcgggctcttcaacgctgggcgacgcgcgaggtcctgccgagcgtgatccgcactggacggtacggcgaacccgacatcgaacaagagcaactgcaactgcaaaaggcgacgctcttgttcaatacgttggcgatgttccgagatcgacttttcgacgagactgtccagaacttggcgaacgcgatggctgatgttctacgggggtga

SEQ ID NO: 3063 - protein, 107 aa, Acinetobacter baumannii
FEQNSQIRIIMINSNPWFVAKDICDALGLSNHRDAISKLDKDEKGVALTDTLGGQQELSVINESGMYALVMRSRDAMKEGTPQHKFRKWVTSEVLPSIRKTGKYEAP

SEQ ID NO: 3064 - protein, 104 aa, Clostridium thermocellum
GKQVRTFIIDGEPWWVAKDVCDILELGDTHKAMERLDEDERNTIPVTDSLGRLQETYVVNEAGLYNLILGSRKQEAKEFKRWITHEVIPQIRKTGIYALEPKQL

SEQ ID NO: 3065 - protein, 113 aa, Bacteriophage Aaphi23
IRTLAINNEPWFIAKDVCDAIGIDNNRKALLALDEDEKGVTLSNTLGGKQEMNIISESGMYTLILRCRDAVKKGSVPHRFRKWVTAEVLPAIRKTGKYEAKTTVDDRTGLRNA

SEQ ID NO: 3066 - protein, 98 aa, Bacteroides caccae
NSTPIRVQVINNEPWFVAKDVCDVLGISKYRDAIARLDDDEGCPIEVDTLGGMQKMAAVNESGLYTLILQSRKPEAKPFRKWVTSEVLPSIRKKGYYG

SEQ ID NO: 3067 - protein, 113 aa, Escherichia coli
FESQADIRVIVINGEPWFIASDVCRAIGIANHRDAVRKLDDDEKGVASTDTPGGEQESIIISESGLYTLILRCRDAVTPGTIPYRFRKWVTGEVLPQIRRTGSYIKNSLPQEE

SEQ ID NO: 3068 - protein, 153 aa, Artificial
  Alicyclobacillus acidocaldarius mutated SEQ ID NO 3061
MQQTWAVFANGTQVRVFWVDGEPLFDAMGVCEAVGLRNVEKALRRLDDDEQGSVILEGLDGREEIHVVRESGMLRLSLVGKDEHARALQRWATREVLPSVIRTGRYGEPDIEQENLQLQKATLLFNTLAMFRDRLFDETVQNLANAMADVLRG

SEQ ID NO: 3069 - protein, 153 aa, Artificial
  Alicyclobacillus acidocaldarius mutated SEQ ID NO 3061
MQQTWAVFANGTQVRVFWVDGEPLFDAMGVCEAVGLRNVEKALRRLDDDEQGSVILEGLDGREEIHVVRESGMLRLSLVGKDEHARALQRWATREVLPSVIRTGRYGEPDIEQEQLQLNKATLLFNTLAMFRDRLFDETVQNLANAMADVLRG

SEQ ID NO: 3070 - protein, 153 aa, Artificial
  Alicyclobacillus acidocaldarius mutated SEQ ID NO 3061
MQQTWAVFANGTQVRVFWVDGEPLFDAMGVCEAVGLRNVEKALRRLDDDEQGSVILEGLDGREEIHVVRESGMLRLSLVGKDEHARALQRWATREVLPSVIRTGRYGEPDIEQEQLQLQKATLLFQTLAMFRDRLFDETVQNLANAMADVLRG

SEQ ID NO: 3071 - protein, 153 aa, Artificial
  Alicyclobacillus acidocaldarius mutated SEQ ID NO 3061
MQQTWAVFANGTQVRVFWVDGEPLFDAMGVCEAVGLRNVEKALRRLDDDEQGSVILEGLDGREEIHVVRESGMLRLSLVGKDEHARALQRWATREVLPSVIRTGRYGEPDIEQEQLQLQKATLLFNTIAMFRDRLFDETVQNLANAMADVLRG

SEQ ID NO: 3072 - protein, 153 aa, Artificial
  Alicyclobacillus acidocaldarius mutated SEQ ID NO 3061
MQQTWAVFANGTQVRVFWVDGEPLFDAMGVCEAVGLRNVEKALRRLDDDEQGSVILEGLDGREEIHVVRESGMLRLSLVGKDEHARALQRWATREVLPSVIRTGRYGEPDLEQEQLQLQKATLLFNTLAMFRDRLFDETVQNLANAMADVLRG

SEQ ID NO: 3073 - DNA, 462 bp, Artificial
  Alicyclobacillus acidocaldarius mutated SEQ ID NO 3062
atgcaacagacttgggcagtcttcgcaaacggtacccaagtgcgtgtcttctgggtcgacggcgaaccgctgtttgacgctatgggcgtgtgtgaggcggtgggtcttcgcaacgtcgagaaggcgcttcgacggttggatgacgatgagcagggcagtgtgattctcgaaggcctagacggacgtgaggagatccatgtggtacgcgagtcgggtatgctgcgcctgtcactcgtcggcaaggatgaacacgcgcgggctcttcaacgctgggcgacgcgcgaggtcctgccgagcgtgatccgcactggacggtacggcgaacccgacatcgaacaagagaatctgcaactgcaaaaggcgacgctcttgttcaatacgttggcgatgttccgagatcgacttttcgacgagactgtccagaacttggcgaacgcgatggctgatgttctacgggggtga

SEQ ID NO: 3074 - DNA, 462 bp, Artificial
  Alicyclobacillus acidocaldarius mutated SEQ ID NO 3062
atgcaacagacttgggcagtcttcgcaaacggtacccaagtgcgtgtcttctgggtcgacggcgaaccgctgtttgacgctatgggcgtgtgtgaggcggtgggtcttcgcaacgtcgagaaggcgcttcgacggttggatgacgatgagcagggcagtgtgattctcgaaggcctagacggacgtgaggagatccatgtggtacgcgagtcgggtatgctgcgcctgtcactcgtcggcaaggatgaacacgcgcgggctcttcaacgctgggcgacgcgcgaggtcctgccgagcgtgatccgcactggacggtacggcgaacccgacatcgaacaagagcaactgcaactgaataaggcgacgctcttgttcaatacgttggcgatgttccgagatcgacttttcgacgagactgtccagaacttggcgaacgcgatggctgatgttctacgggggtga

SEQ ID NO: 3075 - DNA, 462 bp, Artificial
  Alicyclobacillus acidocaldarius mutated SEQ ID NO 3062
atgcaacagacttgggcagtcttcgcaaacggtacccaagtgcgtgtcttctgggtcgacggcgaaccgctgtttgacgctatgggcgtgtgtgaggcggtgggtcttcgcaacgtcgagaaggcgcttcgacggttggatgacgatgagcagggcagtgtgattctcgaaggcctagacggacgtgaggagatccatgtggtacgcgagtcgggtatgctgcgcctgtcactcgtcggcaaggatgaacacgcgcgggctcttcaacgctgggcgacgcgcgaggtcctgccgagcgtgatccgcactggacggtacggcgaacccgacatcgaacaagagcaactgcaactgcaaaaggcgacgctcttgttccaaacgttggcgatgttccgagatcgacttttcgacgagactgtccagaacttggcgaacgcgatggctgatgttctacgggggtga

SEQ ID NO: 3076 - DNA, 462 bp, Artificial
  Alicyclobacillus acidocaldarius mutated SEQ ID NO 3062
atgcaacagacttgggcagtcttcgcaaacggtacccaagtgcgtgtcttctgggtcgacggcgaaccgctgtttgacgctatgggcgtgtgtgaggcggtgggtcttcgcaacgtcgagaaggcgcttcgacggttggatgacgatgagcagggcagtgtgattctcgaaggcctagacggacgtgaggagatccatgtggtacgcgagtcgggtatgctgcgcctgtcactcgtcggcaaggatgaacacgcgcgggctcttcaacgctgggcgacgcgcgaggtcctgccgagcgtgatccgcactggacggtacggcgaacccgacatcgaacaagagcaactgcaactgcaaaaggcgacgctcttgttcaatacgattgcgatgttccgagatcgacttttcgacgagactgtccagaacttggcgaacgcgatggctgatgttctacgggggtga

SEQ ID NO: 3077 - DNA, 462 bp, Artificial
  Alicyclobacillus acidocaldarius mutated SEQ ID NO 3062
atgcaacagacttgggcagtcttcgcaaacggtacccaagtgcgtgtcttctgggtcgacggcgaaccgctgtttgacgctatgggcgtgtgtgaggcggtgggtcttcgcaacgtcgagaaggcgcttcgacggttggatgacgatgagcagggcagtgtgattctcgaaggcctagacggacgtgaggagatccatgtggtacgcgagtcgggtatgctgcgcctgtcactcgtcggcaaggatgaacacgcgcgggctcttcaacgctgggcgacgcgcgaggtcctgccgagcgtgatccgcactggacggtacggcgaacccgacttagaacaagagcaactgcaactgcaaaaggcgacgctcttgttcaatacgttggcgatgttccgagatcgacttttcgacgagactgtccagaacttggcgaacgcgatggctgatgttctacgggggtga

SEQ ID NO: 3078 - protein, 167 aa, Alicyclobacillus acidocaldarius
MSCTTHSIGRRRSPMQQTWAVFANGTQVRVFWVDGEPLFDAMGVCEAVGLRNVEKALRRLDDDEQGSVILEGLDGREEIHVVRESGMLRLSLVGKDEHARALQRWATREVLPSVIRTGRYGEPDIEQEQLQLQKATLLFNTLAMFRDRLFDETVQNLANAMADVLRG

SEQ ID NO: 3079 - DNA, 504 bp, Alicyclobacillus acidocaldarius
ttgtcctgcaccacacactccatcgggaggaggcgatctcctatgcaacagacttgggcagtcttcgcaaacggtacccaagtgcgtgtcttctgggtcgacggcgaaccgctgtttgacgctatgggcgtgtgtgaggcggtgggtcttcgcaacgtcgagaaggcgcttcgacggttggatgacgatgagcagggcagtgtgattctcgaaggcctagacggacgtgaggagatccatgtggtacgcgagtcgggtatgctgcgcctgtcactcgtcggcaaggatgaacacgcgcgggctcttcaacgctgggcgacgcgcgaggtcctgccgagcgtgatccgcactggacggtacggcgaacccgacatcgaacaagagcaactgcaactgcaaaaggcgacgctcttgttcaatacgttggcgatgttccgagatcgacttttcgacgagactgtccagaacttggcgaacgcgatggctgatgttctacgggggtga

SEQ ID NO: 3080 - protein, 107 aa, Acinetobacter baumannii; identical to SEQ ID NO: 3063

SEQ ID NO: 3081 - protein, 104 aa, Clostridium thermocellum; identical to SEQ ID NO: 3064

SEQ ID NO: 3082 - protein, 131 aa, Paenibacillus larvae
GKETNHMNQLQVFNFTGKDVRVVVKDGHPWWVAKDVSELLGFRMASDFTRTLDDDEKDTQIVRTPGGNQEVTIINESGLYSAILKSRKPEAKQFKRWVTHEVLPAIRKTGMYATDELLDDPELLIQAVTKL

SEQ ID NO: 3083 - protein, 113 aa, Bacteriophage Aaphi23; identical to SEQ ID NO: 3065

SEQ ID NO: 3084 - protein, 98 aa, Bacteroides caccae; identical to SEQ ID NO: 3066

SEQ ID NO: 3085 - protein, 167 aa, Artificial
  Alicyclobacillus acidocaldarius mutated SEQ ID NO 3078
MSCTTHSIGRRRSPMQQTWAVFANGTQVRVFWVDGEPLFDAMGVCEAVGLRNVEKALRRLDDDEQGSVILEGLDGREEIHVVRESGMLRLSLVGKDEHARALQRWATREVLPSVIRTGRYGEPDIEQEQLQLQKATLLFNTLAMFRDRLFDDTVQNLANAMADVLRG

SEQ ID NO: 3086 - protein, 167 aa, Artificial
  Alicyclobacillus acidocaldarius mutated SEQ ID NO 3078
MSCTTHSIGRRRSPMQQTWAVFANGTQVRVFWVDGEPLFDAMGVCEAVGLKNVEKALRRLDDDEQGSVILEGLDGREEIHVVRESGMLRLSLVGKDEHARALQRWATREVLPSVIRTGRYGEPDIEQEQLQLQKATLLFNTLAMFRDRLFDETVQNLANAMADVLRG

SEQ ID NO: 3087 - protein, 167 aa, Artificial
  Alicyclobacillus acidocaldarius mutated SEQ ID NO 3078
MSCTTHSIGRRRSPMQQTWAVFANGTQVRVFWVDGEPLFDAMGVCEAVGLRNVEKALRRLDDDEQGSVILEGLDGREEIHVVRESGMLRLSLVGKDEHARALQRWATREVLPSVIRTGRYGEPDIEQEQLQLQRATLLFNTLAMFRDRLFDETVQNLANAMADVLRG

SEQ ID NO: 3088 - protein, 167 aa, Artificial
  Alicyclobacillus acidocaldarius mutated SEQ ID NO 3078
MSCTTHSIGRRRSPMQNTWAVFANGTQVRVFWVDGEPLFDAMGVCEAVGLRNVEKALRRLDDDEQGSVILEGLDGREEIHVVRESGMLRLSLVGKDEHARALQRWATREVLPSVIRTGRYGEPDIEQEQLQLQKATLLFNTLAMFRDRLFDETVQNLANAMADVLRG

SEQ ID NO: 3089 - protein, 167 aa, Artificial
  Alicyclobacillus acidocaldarius mutated SEQ ID NO 3078
MSCTTHSIGRRRSPMQQTWAVFANGTQVRVFWVDGEPLFDAMGVCEAVGLRNVEKALRRLDDDEQGSVILEGLDGREEIHIVRESGMLRLSLVGKDEHARALQRWATREVLPSVIRTGRYGEPDIEQEQLQLQKATLLFNTLAMFRDRLFDETVQNLANAMADVLRG

SEQ ID NO: 3090 - DNA, 504 bp, Artificial
  Alicyclobacillus acidocaldarius mutated SEQ ID NO 3079
ttgtcctgcaccacacactccatcgggaggaggcgatctcctatgcaacagacttgggcagtcttcgcaaacggtacccaagtgcgtgtcttctgggtcgacggcgaaccgctgtttgacgctatgggcgtgtgtgaggcggtgggtcttcgcaacgtcgagaaggcgcttcgacggttggatgacgatgagcagggcagtgtgattctcgaaggcctagacggacgtgaggagatccatgtggtacgcgagtcgggtatgctgcgcctgtcactcgtcggcaaggatgaacacgcgcgggctcttcaacgctgggcgacgcgcgaggtcctgccgagcgtgatccgcactggacggtacggcgaacccgacatcgaacaagagcaactgcaactgcaaaaggcgacgctcttgttcaatacgttggcgatgttccgagatcgacttttcgacgatactgtccagaacttggcgaacgcgatggctgatgttctacgggggtga

SEQ ID NO: 3091 - DNA, 504 bp, Artificial
  Alicyclobacillus acidocaldarius mutated SEQ ID NO 3079
ttgtcctgcaccacacactccatcgggaggaggcgatctcctatgcaacagacttgggcagtcttcgcaaacggtacccaagtgcgtgtcttctgggtcgacggcgaaccgctgtttgacgctatgggcgtgtgtgaggcggtgggtcttaaaaacgtcgagaaggcgcttcgacggttggatgacgatgagcagggcagtgtgattctcgaaggcctagacggacgtgaggagatccatgtggtacgcgagtcgggtatgctgcgcctgtcactcgtcggcaaggatgaacacgcgcgggctcttcaacgctgggcgacgcgcgaggtcctgccgagcgtgatccgcactggacggtacggcgaacccgacatcgaacaagagcaactgcaactgcaaaaggcgacgctcttgttcaatacgttggcgatgttccgagatcgacttttcgacgagactgtccagaacttggcgaacgcgatggctgatgttctacgggggtga

SEQ ID NO: 3092 - DNA, 504 bp, Artificial
  Alicyclobacillus acidocaldarius mutated SEQ ID NO 3079
ttgtcctgcaccacacactccatcgggaggaggcgatctcctatgcaacagacttgggcagtcttcgcaaacggtacccaagtgcgtgtcttctgggtcgacggcgaaccgctgtttgacgctatgggcgtgtgtgaggcggtgggtcttcgcaacgtcgagaaggcgcttcgacggttggatgacgatgagcagggcagtgtgattctcgaaggcctagacggacgtgaggagatccatgtggtacgcgagtcgggtatgctgcgcctgtcactcgtcggcaaggatgaacacgcgcgggctcttcaacgctgggcgacgcgcgaggtcctgccgagcgtgatccgcactggacggtacggcgaacccgacatcgaacaagagcaactgcaactgcaacgtgcgacgctcttgttcaatacgttggcgatgttccgagatcgacttttcgacgagactgtccagaacttggcgaacgcgatggctgatgttctacgggggtga

SEQ ID NO: 3093 - DNA, 504 bp, Artificial
  Alicyclobacillus acidocaldarius mutated SEQ ID NO 3079
ttgtcctgcaccacacactccatcgggaggaggcgatctcctatgcaaaatacttgggcagtcttcgcaaacggtacccaagtgcgtgtcttctgggtcgacggcgaaccgctgtttgacgctatgggcgtgtgtgaggcggtgggtcttcgcaacgtcgagaaggcgcttcgacggttggatgacgatgagcagggcagtgtgattctcgaaggcctagacggacgtgaggagatccatgtggtacgcgagtcgggtatgctgcgcctgtcactcgtcggcaaggatgaacacgcgcgggctcttcaacgctgggcgacgcgcgaggtcctgccgagcgtgatccgcactggacggtacggcgaacccgacatcgaacaagagcaactgcaactgcaaaaggcgacgctcttgttcaatacgttggcgatgttccgagatcgacttttcgacgagactgtccagaacttggcgaacgcgatggctgatgttctacgggggtga

SEQ ID NO: 3094 - DNA, 504 bp, Artificial
  Alicyclobacillus acidocaldarius mutated SEQ ID NO 3079
ttgtcctgcaccacacactccatcgggaggaggcgatctcctatgcaacagacttgggcagtcttcgcaaacggtacccaagtgcgtgtcttctgggtcgacggcgaaccgctgtttgacgctatgggcgtgtgtgaggcggtgggtcttcgcaacgtcgagaaggcgcttcgacggttggatgacgatgagcagggcagtgtgattctcgaaggcctagacggacgtgaggagatccatattgtacgcgagtcgggtatgctgcgcctgtcactcgtcggcaaggatgaacacgcgcgggctcttcaacgctgggcgacgcgcgaggtcctgccgagcgtgatccgcactggacggtacggcgaacccgacatcgaacaagagcaactgcaactgcaaaaggcgacgctcttgttcaatacgttggcgatgttccgagatcgacttttcgacgagactgtccagaacttggcgaacgcgatggctgatgttctacgggggtga

SEQ ID NO: 3095 - protein, 126 aa, Alicyclobacillus acidocaldarius
MVRANVQGPRQVHTEGRRIPMFTPFPGDRPEALGTLPHEALVFVHTPLCGTCQLARRMLEVVDAAHTNRLPLYDLDANLAPEAMQSWKIESVPALLYVKNGEIAHVQYRFGDVVDLADAIRQFLER

SEQ ID NO: 3096 - DNA, 381 bp, Alicyclobacillus acidocaldarius
atggtgcgggcgaatgtccagggcccccgccaagtccacaccgaagggagacggattcccatgttcacaccgttcccaggagacagacccgaggcgctcggcaccctgccccacgaggccctcgtcttcgtccacacgccgctctgcggcacgtgtcaactcgctcggcgcatgctggaggtcgtcgacgcggcccacaccaaccggcttccgctctacgatctcgacgccaacctcgcgcccgaggccatgcagtcgtggaagatcgagagtgtgccggcgctgttgtacgtgaaaaacggcgagatcgcccacgtccaataccggtttggcgacgtggtcgatctcgccgacgcgattcggcagtttctcgagcgttaa

SEQ ID NO: 3097 - protein, 98 aa, Geobacillus kaustophilus
DRNDVMRVVEVEPLLALYLYTPLCGTCQLARRMLTVVEQLFPALPFYETDINYIPEQAVAWKIESVPCLLLFRDGTVAGKWYAFHSVPYLYEVIQACL

SEQ ID NO: 3098 - protein, 102 aa, Geobacillus thermodenitrificans
PIERTEIQQTITEQPLMALYLYTPLCGTCQLAKRMLTVVEELFPALPFYETDVNYIPEQAVVWKIESVPCLLLFVDGTMVGKWYAFHSVPYLYEEIQARLPR

SEQ ID NO: 3099 - protein, 92 aa, Bacillus licheniformis
LKRLEHETCLLYVYTPFCGTCQLAGRMLEVVDEMMKDIPFYKNNLNYSPSFAKQQEIESVPCFILYKKGRVVKKEYAFHSVSYLYDTIKQNL

SEQ ID NO: 3100 - protein, 82 aa, Oceanobacillus iheyensis
VIYIYTPFCGTCSVARAMLENIERLHRQDIFYEMNAAVHPEYMHDNQIESVPCLLFVENGEIVERIYTFYSTANIYDYLIQY

SEQ ID NO: 3101 - protein, 77 aa, Bacillus selenitireducens
KGVLFLHTPLCGTCKMAGQFLQIAEQIPDIPEIFSMDLNMAPHIAKDWKIESVPCLVVIDDGNVTDRMYAFKSIPDI

SEQ ID NO: 3102 - protein, 126 aa, Artificial
  Alicyclobacillus acidocaldarius mutated SEQ ID NO 3095
MIRANVQGPRQVHTEGRRIPMFTPFPGDRPEALGTLPHEALVFVHTPLCGTCQLARRMLEVVDAAHTNRLPLYDLDANLAPEAMQSWKIESVPALLYVKNGEIAHVQYRFGDVVDLADAIRQFLER

SEQ ID NO: 3103 - protein, 126 aa, Artificial
  Alicyclobacillus acidocaldarius mutated SEQ ID NO 3095
MVRANVQGPRQVHTEGRRIPMFTPFPGDRPEAIGTLPHEALVFVHTPLCGTCQLARRMLEVVDAAHTNRLPLYDLDANLAPEAMQSWKIESVPALLYVKNGEIAHVQYRFGDVVDLADAIRQFLER

SEQ ID NO: 3104 - protein, 126 aa, Artificial
  Alicyclobacillus acidocaldarius mutated SEQ ID NO 3095
MVRANVQGPRQVHTEGRRIPMFTPFPGDRPEALGTLPHEALVFVHTPLCGTCQLARKMLEVVDAAHTNRLPLYDLDANLAPEAMQSWKIESVPALLYVKNGEIAHVQYRFGDVVDLADAIRQFLER

SEQ ID NO: 3105 - protein, 126 aa, Artificial
  Alicyclobacillus acidocaldarius mutated SEQ ID NO 3095
MVRANVQGPRQVHTEGRRIPMFTPFPGDRPEALGTLPHEALVFVHTPLCGTCQLARRMLEVVDAAHTNRLPLYDLDANLAPEAMQSWKIESVPALLYVKNGEIAHVQYRFGDVVDLADAIRQFLEK

SEQ ID NO: 3106 - protein, 126 aa, Artificial
  Alicyclobacillus acidocaldarius mutated SEQ ID NO 3095
MVRANVQGPKQVHTEGRRIPMFTPFPGDRPEALGTLPHEALVFVHTPLCGTCQLARRMLEVVDAAHTNRLPLYDLDANLAPEAMQSWKIESVPALLYVKNGEIAHVQYRFGDVVDLADAIRQFLER

SEQ ID NO: 3107 - DNA, 381 bp, Artificial
  Alicyclobacillus acidocaldarius mutated SEQ ID NO 3096
atgattcgggcgaatgtccagggcccccgccaagtccacaccgaagggagacggattcccatgttcacaccgttcccaggagacagacccgaggcgctcggcaccctgccccacgaggccctcgtcttcgtccacacgccgctctgcggcacgtgtcaactcgctcggcgcatgctggaggtcgtcgacgcggcccacaccaaccggcttccgctctacgatctcgacgccaacctcgcgcccgaggccatgcagtcgtggaagatcgagagtgtgccggcgctgttgtacgtgaaaaacggcgagatcgcccacgtccaataccggtttggcgacgtggtcgatctcgccgacgcgattcggcagtttctcgagcgttaa

SEQ ID NO: 3108 - DNA, 381 bp, Artificial
  Alicyclobacillus acidocaldarius mutated SEQ ID NO 3096
atggtgcgggcgaatgtccagggcccccgccaagtccacaccgaagggagacggattcccatgttcacaccgttcccaggagacagacccgaggcgattggcaccctgccccacgaggccctcgtcttcgtccacacgccgctctgcggcacgtgtcaactcgctcggcgcatgctggaggtcgtcgacgcggcccacaccaaccggcttccgctctacgatctcgacgccaacctcgcgcccgaggccatgcagtcgtggaagatcgagagtgtgccggcgctgttgtacgtgaaaaacggcgagatcgcccacgtccaataccggtttggcgacgtggtcgatctcgccgacgcgattcggcagtttctcgagcgttaa

SEQ ID NO: 3109 - DNA, 381 bp, Artificial
  Alicyclobacillus acidocaldarius mutated SEQ ID NO 3096
atggtgcgggcgaatgtccagggcccccgccaagtccacaccgaagggagacggattcccatgttcacaccgttcccaggagacagacccgaggcgctcggcaccctgccccacgaggccctcgtcttcgtccacacgccgctctgcggcacgtgtcaactcgctcggaaaatgctggaggtcgtcgacgcggcccacaccaaccggcttccgctctacgatctcgacgccaacctcgcgcccgaggccatgcagtcgtggaagatcgagagtgtgccggcgctgttgtacgtgaaaaacggcgagatcgcccacgtccaataccggtttggcgacgtggtcgatctcgccgacgcgattcggcagtttctcgagcgttaa

SEQ ID NO: 3110 - DNA, 381 bp, Artificial
  Alicyclobacillus acidocaldarius mutated SEQ ID NO 3096
atggtgcgggcgaatgtccagggcccccgccaagtccacaccgaagggagacggattcccatgttcacaccgttcccaggagacagacccgaggcgctcggcaccctgccccacgaggccctcgtcttcgtccacacgccgctctgcggcacgtgtcaactcgctcggcgcatgctggaggtcgtcgacgcggcccacaccaaccggcttccgctctacgatctcgacgccaacctcgcgcccgaggccatgcagtcgtggaagatcgagagtgtgccggcgctgttgtacgtgaaaaacggcgagatcgcccacgtccaataccggtttggcgacgtggtcgatctcgccgacgcgattcggcagtttctcgagaaataa

SEQ ID NO: 3111 - DNA, 381 bp, Artificial
  Alicyclobacillus acidocaldarius mutated SEQ ID NO 3096
atggtgcgggcgaatgtccagggccccaaacaagtccacaccgaagggagacggattcccatgttcacaccgttcccaggagacagacccgaggcgctcggcaccctgccccacgaggccctcgtcttcgtccacacgccgctctgcggcacgtgtcaactcgctcggcgcatgctggaggtcgtcgacgcggcccacaccaaccggcttccgctctacgatctcgacgccaacctcgcgcccgaggccatgcagtcgtggaagatcgagagtgtgccggcgctgttgtacgtgaaaaacggcgagatcgcccacgtccaataccggtttggcgacgtggtcgatctcgccgacgcgattcggcagtttctcgagcgttaa

SEQ ID NO: 3112 - protein, 93 aa, Alicyclobacillus acidocaldarius
MATRGYPAIFDPYEDGSFVVLFPDFPGCVTQGCNLDDAVAMAEEALTLQLYGIERDGEDLPEPSDPSHVTVPEEVQGQWFVMLIHPRPELFHP

SEQ ID NO: 3113 - DNA, 282 bp, Alicyclobacillus acidocaldarius
atggccacacgaggataccctgcgattttcgacccatacgaagatggatccttcgtcgtattgtttcccgactttcctgggtgcgtcacgcagggctgcaaccttgatgacgccgtagccatggcagaagaagcactcacacttcagctctatggaattgaacgcgacggagaggatctacctgaaccttcagatccctcgcacgtaacggtcccagaagaagtgcagggacaatggtttgtcatgctcatccatccacgccctgagttattccatccgtga

SEQ ID NO: 3114 - protein, 67 aa, Caldicellulosiruptor saccharolyticus
FPAVFEPGENGGYCVTFPDLPGCITEGETLEEALYMAKEALELHLYGLEEDNEEIPEPTPPEKLDIP

SEQ ID NO: 3115 - protein, 66 aa, Caldicellulosiruptor saccharolyticus
FPAIFEPAEKEGYVVTFPDLPGCITEGKNLEEALYMAKEALELHIFGLEEDGEEIPEPTPPEKLNV

SEQ ID NO: 3116 - protein, 64 aa, Clostridium kluyveri
YPALFEAYEDGGYTVSFPDLPGCITEGDSLTEALTMAKEALELFLWNMEDDNEEIPEPTPPEKI

SEQ ID NO: 3117 - protein, 81 aa, Pelotomaculum thermopropionicum
FPAIFEVGEIKGYCVTFPDLPGCITEGNTLEEALQMAREALELHLYGMEEDEDEIPSPTPPERVDVPEKGFVAIVEARMPL

SEQ ID NO: 3118 - protein, 70 aa, Pelotomaculum thermopropionicum
YPAIFDYAEDGISVEFPDLPGCYTCGDNDEEALRMAKEALALHLYGLEEDGFPIPEPSPASRIKVEPNQV

SEQ ID NO: 3119 - protein, 93 aa, Artificial
  Alicyclobacillus acidocaldarius mutated SEQ ID NO 3112
MATRGYPAIFDPYEDGSFVVLFPDFPGCVTQGCNLDDAVAMAEEALTLQLYGIERDGEDLPEPSDPSHVTVPEEVQGQWFVMLIHPRPEIFHP

SEQ ID NO: 3120 - protein, 93 aa, Artificial
  Alicyclobacillus acidocaldarius mutated SEQ ID NO 3112
MATRGYPAIFDPYEDGSFVVLFPDFPGCVTQGCNLDDAVAMAEEALTLQLYGIERDGEELPEPSDPSHVTVPEEVQGQWFVMLIHPRPELFHP

SEQ ID NO: 3121 - protein, 93 aa, Artificial
  Alicyclobacillus acidocaldarius mutated SEQ ID NO 3112
MATRGYPAIFDPYEDGSFVVLFPDFPGCVTQGCNLEDAVAMAEEALTLQLYGIERDGEDLPEPSDPSHVTVPEEVQGQWFVMLIHPRPELFHP

SEQ ID NO: 3122 - protein, 93 aa, Artificial
  Alicyclobacillus acidocaldarius mutated SEQ ID NO 3112
MATRGYPAIFDPYEDGSFVVLFPDFPGCVTQGCNLDDAVAMAEEALTLNLYGIERDGEDLPEPSDPSHVTVPEEVQGQWFVMLIHPRPELFHP

SEQ ID NO: 3123 - protein, 93 aa, Artificial
  Alicyclobacillus acidocaldarius mutated SEQ ID NO 3112
MATRGYPAIFDPYEEGSFVVLFPDFPGCVTQGCNLDDAVAMAEEALTLQLYGIERDGEDLPEPSDPSHVTVPEEVQGQWFVMLIHPRPELFHP

SEQ ID NO: 3124 - DNA, 282 bp, Artificial
  Alicyclobacillus acidocaldarius mutated SEQ ID NO 3113
atggccacacgaggataccctgcgattttcgacccatacgaagatggatccttcgtcgtattgtttcccgactttcctgggtgcgtcacgcagggctgcaaccttgatgacgccgtagccatggcagaagaagcactcacacttcagctctatggaattgaacgcgacggagaggatctacctgaaccttcagatccctcgcacgtaacggtcccagaagaagtgcagggacaatggtttgtcatgctcatccatccacgccctgagattttccatccgtga

SEQ ID NO: 3125 - DNA, 282 bp, Artificial
  Alicyclobacillus acidocaldarius mutated SEQ ID NO 3113
atggccacacgaggataccctgcgattttcgacccatacgaagatggatccttcgtcgtattgtttcccgactttcctgggtgcgtcacgcagggctgcaaccttgatgacgccgtagccatggcagaagaagcactcacacttcagctctatggaattgaacgcgacggagaggaactacctgaaccttcagatccctcgcacgtaacggtcccagaagaagtgcagggacaatggtttgtcatgctcatccatccacgccctgagttattccatccgtga

SEQ ID NO: 3126 - DNA, 282 bp, Artificial
  Alicyclobacillus acidocaldarius mutated SEQ ID NO 3113
atggccacacgaggataccctgcgattttcgacccatacgaagatggatccttcgtcgtattgtttcccgactttcctgggtgcgtcacgcagggctgcaaccttgaagacgccgtagccatggcagaagaagcactcacacttcagctctatggaattgaacgcgacggagaggatctacctgaaccttcagatccctcgcacgtaacggtcccagaagaagtgcagggacaatggtttgtcatgctcatccatccacgccctgagttattccatccgtga

SEQ ID NO: 3127 - DNA, 282 bp, Artificial
  Alicyclobacillus acidocaldarius mutated SEQ ID NO 3113
atggccacacgaggataccctgcgattttcgacccatacgaagatggatccttcgtcgtattgtttcccgactttcctgggtgcgtcacgcagggctgcaaccttgatgacgccgtagccatggcagaagaagcactcacacttaatctctatggaattgaacgcgacggagaggatctacctgaaccttcagatccctcgcacgtaacggtcccagaagaagtgcagggacaatggtttgtcatgctcatccatccacgccctgagttattccatccgtga

SEQ ID NO: 3128 - DNA, 282 bp, Artificial
  Alicyclobacillus acidocaldarius mutated SEQ ID NO 3113
atggccacacgaggataccctgcgattttcgacccatacgaagaaggatccttcgtcgtattgtttcccgactttcctgggtgcgtcacgcagggctgcaaccttgatgacgccgtagccatggcagaagaagcactcacacttcagctctatggaattgaacgcgacggagaggatctacctgaaccttcagatccctcgcacgtaacggtcccagaagaagtgcagggacaatggtttgtcatgctcatccatccacgccctgagttattccatccgtga

SEQ ID NO: 3129 - protein, 235 aa, Alicyclobacillus acidocaldarius
MERLARDDGHSARRLVRARGRVTCAITRSREPERGIDVAKLYFRFGQMNASKSIQLLTVAHSYEEQGKKVALFTPAIDDRYGRGVIASRVGIAKRAVVVEEDTDLFACVRAQMPDCVLVDEVQFLRAYHVRQLARVADDLDIPVIMYGLLKDYRNRLFEGSEAAILWADRIEEIKTICAHPGCDRKATMILKVKDGRPVYEGEQIEVGGNDLYKSVCRKHYFHPDVEGLMRATGP

SEQ ID NO: 3130 - DNA, 708 bp, Alicyclobacillus acidocaldarius
ttggagcgcctcgctcgagatgacgggcattccgcgcgacgcctggtacgcgctcgaggacgagtgacctgcgccatcacgcgctcccgggagccagaaagagggatagacgtggccaagctgtactttcgctttggacagatgaacgccagcaagtccatccaactgttgaccgtcgcgcacagctacgaggaacagggcaagaaggtggcgctgttcacgcctgccatcgacgaccggtacgggcgcggcgtcatcgcgtccagggtgggcatcgccaagcgggccgtcgtcgtggaggaggacaccgacctgttcgcgtgcgtgcgcgcgcagatgcccgactgcgtgctggtggacgaggtccagttcctccgcgcctatcacgtgcggcagttggcgcgcgtggcggacgatctcgacatcccggtgatcatgtacggcctcctgaaggactaccgcaaccgcctgttcgagggcagcgaggcggccatcctgtgggcggaccggatagaagagatcaagaccatctgcgcgcatcccggctgcgaccgcaaggcgacgatgatcctcaaggtgaaagacgggcgcccggtgtacgagggcgagcagattgaagtcggcggcaacgatctctacaaatccgtctgccgcaagcactactttcacccggacgtggagggcctgatgcgcgccacaggcccatga

SEQ ID NO: 3131 - protein, 190 aa, Streptococcus sanguinis
MAQLYYKYGTMNSGKTIEILKVAHNYEEQGKSVVIMTSAVDTRDGFGVVSSRIGMKRNAIAIEDQTDIFGYIQQLPEKPYCVLIDEAQFLKRHHVYDLARVVDELDVPVMAFGLKNDFRNELFEGSKHLLLLADKIEEIKTICQYCSRKATMVLRTDNGKPVYDGEQIKIGGHETYISVCRKHYFNPDIK

SEQ ID NO: 3132 - protein, 189 aa, Streptococcus pneumoniae
MAQLYYRYGTMNSGKTIEILKVAYNYEEQGKGVVIMTSALDTRDGVGYVSSRIGMKRPALAIEETTDIFGYIRGLPEKPYCVLVDEAQFLKRHHVYDLARVVDELDIPVMAFGLKNDFRNELFEGSKYLLLLADKIDEIKTICQYCKKKATMVLRTQDGLPVYDGEQIQIGGNETYISVCRKHYFAPEI

SEQ ID NO: 3133 - protein, 189 aa, Streptococcus gordonii
MAQLYYKYGTMNSGKTIEILKVAHNYEEQGKGVVIMTSAVDTRDGVGYVSSRIGMKRQAMAIEDDTDILGYIKNLPEKPYCILIDEAQFLKRHHVYDLARVVDELDVPVMAFGLKNDFRNELFEGSKHLLLLADKIEEIKTICQYCSRKATMVLRTDHGKPVYDGEQIQIGGNETYIPVCRKHYFKPDI

SEQ ID NO: 3134 - protein, 189 aa, Streptococcus pneumoniae
MAQLYYRYGTMNSGKTIEILKVAYNYEEQGKGVVIMTSALDTRDGVGYVSSRIGMKRPALAIEETTDIFGYIRDLPEKPCCVLVDEAQFLKRHHVYDLARVVDELDIPVMAFGLKNDFRNELFEGSKYLLLLADKIDEIKTICQYCKKKATMVLRTQDGLPVYDGEQIQIGGNETYISVCRKHYFAPEI

SEQ ID NO: 3135 - protein, 189 aa, Streptococcus pneumoniae
MAQLYYRYGTMNSGKTIEILKVAYNYEEQGKGVVIMTSALDTRDGVGYVSSRIGMKRPALAIEETTDIFGYIRDLPEKPYCVLVDEAQFLKRHHVYDLARVVDELDIPVMAFGLKNDFRNELFEGSKYLLLLADKIDEIKTICQYCKKKATMVLRTQDGLPVYDGEQIQIGGNETYISVCRKHYFAPEI

SEQ ID NO: 3136 - protein, 235 aa, Artificial
  Alicyclobacillus acidocaldarius mutated SEQ ID NO 3129
MERLARDDGHSARRLVRARGRVTCAITRSREPERGLDVAKLYFRFGQMNASKSIQLLTVAHSYEEQGKKVALFTPAIDDRYGRGVIASRVGIAKRAVVVEEDTDLFACVRAQMPDCVLVDEVQFLRAYHVRQLARVADDLDIPVIMYGLLKDYRNRLFEGSEAAILWADRIEEIKTICAHPGCDRKATMILKVKDGRPVYEGEQIEVGGNDLYKSVCRKHYFHPDVEGLMRATGP

SEQ ID NO: 3137 - protein, 235 aa, Artificial
  Alicyclobacillus acidocaldarius mutated SEQ ID NO 3129
MERLARDDGHSARRLVKARGRVTCAITRSREPERGIDVAKLYFRFGQMNASKSIQLLTVAHSYEEQGKKVALFTPAIDDRYGRGVIASRVGIAKRAVVVEEDTDLFACVRAQMPDCVLVDEVQFLRAYHVRQLARVADDLDIPVIMYGLLKDYRNRLFEGSEAAILWADRIEEIKTICAHPGCDRKATMILKVKDGRPVYEGEQIEVGGNDLYKSVCRKHYFHPDVEGLMRATGP

SEQ ID NO: 3138 - protein, 235 aa, Artificial
  Alicyclobacillus acidocaldarius mutated SEQ ID NO 3129
MERLARDDGHSARRIVRARGRVTCAITRSREPERGIDVAKLYFRFGQMNASKSIQLLTVAHSYEEQGKKVALFTPAIDDRYGRGVIASRVGIAKRAVVVEEDTDLFACVRAQMPDCVLVDEVQFLRAYHVRQLARVADDLDIPVIMYGLLKDYRNRLFEGSEAAILWADRIEEIKTICAHPGCDRKATMILKVKDGRPVYEGEQIEVGGNDLYKSVCRKHYFHPDVEGLMRATGP

SEQ ID NO: 3139 - protein, 235 aa, Artificial
  Alicyclobacillus acidocaldarius mutated SEQ ID NO 3129
MERLARDDGHSARRLVRARGRVTCAITRSREPERGIDVAKLYFRFGQMNASKSIQLLTVAHSYEEQGKKVALFTPAIDDRYGRGVIASRVGIAKRAVVVEEDTDLFACVRAQMPDCVLVDEVQFLRAYHVRQLARVADDLDIPVIMYGLLKDYRNRLFEGSEAAILWADRIEEIKTICAHPGCDRKATMILKVKDGRPVYEGEQIEVGGNDLYKSVCRKHYFHPDVEGIMRATGP

SEQ ID NO: 3140 - protein, 235 aa, Artificial
  Alicyclobacillus acidocaldarius mutated SEQ ID NO 3129
MERLARDDGHSARRLVRARGRVTCAITRSREPEKGIDVAKLYFRFGQMNASKSIQLLTVAHSYEEQGKKVALFTPAIDDRYGRGVIASRVGIAKRAVVVEEDTDLFACVRAQMPDCVLVDEVQFLRAYHVRQLARVADDLDIPVIMYGLLKDYRNRLFEGSEAAILWADRIEEIKTICAHPGCDRKATMILKVKDGRPVYEGEQIEVGGNDLYKSVCRKHYFHPDVEGLMRATGP

SEQ ID NO: 3141 - DNA, 708 bp, Artificial
  Alicyclobacillus acidocaldarius mutated SEQ ID NO 3130
ttggagcgcctcgctcgagatgacgggcattccgcgcgacgcctggtacgcgctcgaggacgagtgacctgcgccatcacgcgctcccgggagccagaaagagggttagacgtggccaagctgtactttcgctttggacagatgaacgccagcaagtccatccaactgttgaccgtcgcgcacagctacgaggaacagggcaagaaggtggcgctgttcacgcctgccatcgacgaccggtacgggcgcggcgtcatcgcgtccagggtgggcatcgccaagcgggccgtcgtcgtggaggaggacaccgacctgttcgcgtgcgtgcgcgcgcagatgcccgactgcgtgctggtggacgaggtccagttcctccgcgcctatcacgtgcggcagttggcgcgcgtggcggacgatctcgacatcccggtgatcatgtacggcctcctgaaggactaccgcaaccgcctgttcgagggcagcgaggcggccatcctgtgggcggaccggatagaagagatcaagaccatctgcgcgcatcccggctgcgaccgcaaggcgacgatgatcctcaaggtgaaagacgggcgcccggtgtacgagggcgagcagattgaagtcggcggcaacgatctctacaaatccgtctgccgcaagcactactttcacccggacgtggagggcctgatgcgcgccacaggcccatga

SEQ ID NO: 3142 - DNA, 708 bp, Artificial
  Alicyclobacillus acidocaldarius mutated SEQ ID NO 3130
ttggagcgcctcgctcgagatgacgggcattccgcgcgacgcctggtaaaagctcgaggacgagtgacctgcgccatcacgcgctcccgggagccagaaagagggatagacgtggccaagctgtactttcgctttggacagatgaacgccagcaagtccatccaactgttgaccgtcgcgcacagctacgaggaacagggcaagaaggtggcgctgttcacgcctgccatcgacgaccggtacgggcgcggcgtcatcgcgtccagggtgggcatcgccaagcgggccgtcgtcgtggaggaggacaccgacctgttcgcgtgcgtgcgcgcgcagatgcccgactgcgtgctggtggacgaggtccagttcctccgcgcctatcacgtgcggcagttggcgcgcgtggcggacgatctcgacatcccggtgatcatgtacggcctcctgaaggactaccgcaaccgcctgttcgagggcagcgaggcggccatcctgtgggcggaccggatagaagagatcaagaccatctgcgcgcatcccggctgcgaccgcaaggcgacgatgatcctcaaggtgaaagacgggcgcccggtgtacgagggcgagcagattgaagtcggcggcaacgatctctacaaatccgtctgccgcaagcactactttcacccggacgtggagggcctgatgcgcgccacaggcccatga

SEQ ID NO: 3143 - DNA, 708 bp, Artificial
  Alicyclobacillus acidocaldarius mutated SEQ ID NO 3130
ttggagcgcctcgctcgagatgacgggcattccgcgcgacgcattgtacgcgctcgaggacgagtgacctgcgccatcacgcgctcccgggagccagaaagagggatagacgtggccaagctgtactttcgctttggacagatgaacgccagcaagtccatccaactgttgaccgtcgcgcacagctacgaggaacagggcaagaaggtggcgctgttcacgcctgccatcgacgaccggtacgggcgcggcgtcatcgcgtccagggtgggcatcgccaagcgggccgtcgtcgtggaggaggacaccgacctgttcgcgtgcgtgcgcgcgcagatgcccgactgcgtgctggtggacgaggtccagttcctccgcgcctatcacgtgcggcagttggcgcgcgtggcggacgatctcgacatcccggtgatcatgtacggcctcctgaaggactaccgcaaccgcctgttcgagggcagcgaggcggccatcctgtgggcggaccggatagaagagatcaagaccatctgcgcgcatcccggctgcgaccgcaaggcgacgatgatcctcaaggtgaaagacgggcgcccggtgtacgagggcgagcagattgaagtcggcggcaacgatctctacaaatccgtctgccgcaagcactactttcacccggacgtggagggcctgatgcgcgccacaggcccatga

SEQ ID NO: 3144 - DNA, 708 bp, Artificial
  Alicyclobacillus acidocaldarius mutated SEQ ID NO 3130
ttggagcgcctcgctcgagatgacgggcattccgcgcgacgcctggtacgcgctcgaggacgagtgacctgcgccatcacgcgctcccgggagccagaaagagggatagacgtggccaagctgtactttcgctttggacagatgaacgccagcaagtccatccaactgttgaccgtcgcgcacagctacgaggaacagggcaagaaggtggcgctgttcacgcctgccatcgacgaccggtacgggcgcggcgtcatcgcgtccagggtgggcatcgccaagcgggccgtcgtcgtggaggaggacaccgacctgttcgcgtgcgtgcgcgcgcagatgcccgactgcgtgctggtggacgaggtccagttcctccgcgcctatcacgtgcggcagttggcgcgcgtggcggacgatctcgacatcccggtgatcatgtacggcctcctgaaggactaccgcaaccgcctgttcgagggcagcgaggcggccatcctgtgggcggaccggatagaagagatcaagaccatctgcgcgcatcccggctgcgaccgcaaggcgacgatgatcctcaaggtgaaagacgggcgcccggtgtacgagggcgagcagattgaagtcggcggcaacgatctctacaaatccgtctgccgcaagcactactttcacccggacgtggagggcattatgcgcgccacaggcccatga

SEQ ID NO: 3145 - DNA, 708 bp, Artificial
  Alicyclobacillus acidocaldarius mutated SEQ ID NO 3130
ttggagcgcctcgctcgagatgacgggcattccgcgcgacgcctggtacgcgctcgaggacgagtgacctgcgccatcacgcgctcccgggagccagaaaaagggatagacgtggccaagctgtactttcgctttggacagatgaacgccagcaagtccatccaactgttgaccgtcgcgcacagctacgaggaacagggcaagaaggtggcgctgttcacgcctgccatcgacgaccggtacgggcgcggcgtcatcgcgtccagggtgggcatcgccaagcgggccgtcgtcgtggaggaggacaccgacctgttcgcgtgcgtgcgcgcgcagatgcccgactgcgtgctggtggacgaggtccagttcctccgcgcctatcacgtgcggcagttggcgcgcgtggcggacgatctcgacatcccggtgatcatgtacggcctcctgaaggactaccgcaaccgcctgttcgagggcagcgaggcggccatcctgtgggcggaccggatagaagagatcaagaccatctgcgcgcatcccggctgcgaccgcaaggcgacgatgatcctcaaggtgaaagacgggcgcccggtgtacgagggcgagcagattgaagtcggcggcaacgatctctacaaatccgtctgccgcaagcactactttcacccggacgtggagggcctgatgcgcgccacaggcccatga

SEQ ID NO: 3146 - protein, 257 aa, Alicyclobacillus acidocaldarius
MIRELLMRDDTLFIAHRGASAECPENTLPAFVRAAELGADMIELDVRLTGDGGVVVLHDPTVDRTTNGSGLAADMRLADLRKLDAGSWFDARFRGTLIPTLDEVFATVPHMCLNIELKTSPVAHTRQLIRRVLGAIYRHNARDRVLISSFDHAALAEVRRFDRDIAIGVLFTGRLLEPIQLAERLGAQSLHPDIEHLDPLFVAEAKSHHLAVYAWTAKSELAVNRALACQVSGIILDDLRLRQIATKAVPSPTPPSA

SEQ ID NO: 3147 - DNA, 774 bp, Alicyclobacillus acidocaldarius
atgattcgagaactcctgatgcgcgacgacacgctctttatcgcccaccgcggcgcgtccgccgaatgcccggagaacacgctgcccgccttcgtgcgggcggcggaattgggcgcggacatgattgagctcgacgtccgcctgacgggcgacggcggcgtcgtggtcctgcacgatccgacggtcgaccggacgaccaacggcagcggcctggccgccgacatgcgcctcgccgatctgcgcaagctcgacgccggatcgtggtttgacgcgcgctttcgcggcacactcatccccacgctcgacgaggtgttcgcgaccgtgccgcacatgtgcctgaacatcgagctgaagacgagccccgtcgcgcacacccgccagctcatccgccgcgtccttggcgccatttaccgccacaacgcgcgcgatcgcgtcctcatctcctccttcgatcacgccgcgctggccgaggttcgccgcttcgaccgcgacatcgccatcggcgtgctcttcaccgggcgcctgctcgagcccatccagctcgcggagcgcctcggcgcgcagagcctccaccccgacatcgaacatctggatcccctgtttgtggccgaggccaaatcccaccacctcgcggtgtacgcgtggaccgcgaagagcgagctggccgtgaaccgggccttggcgtgccaggtgtccggcatcatcctggacgatctccggctgaggcaaatcgccaccaaggctgtcccctcgcccacgccgccctccgcgtga

SEQ ID NO: 3148 - protein, 229 aa, Thermoanaerobacter tengcongensis
TLVIAHRGDSKNVPENTIAAFKRAMELGADGIELDVQLTKDGHLVVIHDETVDRTTNGEGFVKDFTLEEIKKLDAGIKFGEKFAGERIPTLYEVFELIGDKDFLVNIEIKSGIVLYPGIEEKLIKAIKEYNFEERVIISSFNHYSLRDVKKMAPHLKIGLLYQCGLVEPWHMALRMEAYSLHPFYFNIIPELVEGCKKNGVKLFPWTVDRKEDMERMIKAGVDGIITDD

SEQ ID NO: 3149 - protein, 228 aa, Thermoanaerobacter pseudethanolicus
LVIAHRGDSRNAPENTLASFKSALEMGADGIELDVQLTKDGQLVVIHDERVDRTTDGIGFVKDFTLKELKRLDAGIKFDKKFAGERIPSLYEVFELIGHKNFIVNIEIKSGIVLYPGIEEKLIKAIEDYDFEDRVVISSFNHYSLRDVKRMAPELKIGLLYQCGLVEPWHMAIRMKAYSLHPFYFNIIPELVEGCKKNNIKLFPWTVDRKEDMEMMIKAGVDAIITDD

SEQ ID NO: 3150 - protein, 224 aa, Symbiobacterium thermophilum
IGHRGAAGTHPENTMVSFRRAFELGVDGIEFDVHRTADGHLVVIHDPAVDRTTDGSGLVMAMTLEQIRALDAGSWKDPRFAGERVPTLQELVRATPPGVRLYLELKAGSVHYPGIEQELVDLLKAEGVLDRTQVSSFDHRALVKLKEICPELPLGMLTSSNLVDPVGMAKAIGCEAIHPAWPWVTPEYVEAAHAAGLKVNCWTVNDPLALALMQNAGVDGIMTD

SEQ ID NO: 3151 - protein, 226 aa, Clostridium botulinum
TKILAHRGASAYAPENTMAAFKKAIEMNADGIELDVHLSKDGYIVIIHDERVDRTTDGKGEVKDFSLYELKKLDAGSWFSDEYKDEKIPTLEELLKLIKNTELYLNIEIKAGYRVYPNIEEKVIAMIEKYKMLDRVIISSFDHYSLVRVKEINSNIKTGMLYEAALYEPWEYARSIKVEALHPNYITLTKEFIDKAYINSFEVNSYTINDETNMKSLIKNKVTSII

SEQ ID NO: 3152 - protein, 226 aa, Clostridium botulinum
TKILAHRGASAYAPENTMAAFKKAIEMNADGIELDVHLSKDGYIVIIHDERVDRTTDGKGEVKDFSLDELKKLDAGSWFSYEYKDEKIPTLEELLKLIKNTEIYLNIEIKAGYRLYPNIEEKVIAMIEKYKMLDRVIISSFDHYSLVRVKEINSNIKTGMLYEAALYEPWEYARSIKVEALHPNYITLTKEFIDKAYINSFEVNPYTINDETNMESLIENKITSII

SEQ ID NO: 3153 - protein, 257 aa, Artificial
  Alicyclobacillus acidocaldarius mutated SEQ ID NO 732
MIRELLMRDDTLFIAHRGASAECPENTLPAFVRAAELGADMIELDVRLTGDGGVVVLHDPTVDRTTNGSGLAADMRLADLRKLDAGSWFDARFRGTLIPTLDEVFATVPHMCLNIELKTSPVAHTRNLIRRVLGAIYRHNARDRVLISSFDHAALAEVRRFDRDIAIGVLFTGRLLEPIQLAERLGAQSLHPDIEHLDPLFVAEAKSHHLAVYAWTAKSELAVNRALACQVSGIILDDLRLRQIATKAVPSPTPPSA

SEQ ID NO: 3154 - protein, 257 aa, Artificial
  Alicyclobacillus acidocaldarius mutated SEQ ID NO 732
MIRELLMRDDTLFIAHRGASAECPENTLPAFVRAAELGADMIELDVRLTGDGGVVVLHDPTVDRTTNGSGLAADMRLADLRKLDAGSWFDARFRGTLIPTLDEVFATVPHMCLNIELKTSPVAHTRQLIRRVLGAIYRHNARDRVLISSFDHAALAEVRRFDRDIAIGVLFTGRLLEPIQLAERLGAQSLHPDIEHLDPLFVADAKSHHLAVYAWTAKSELAVNRALACQVSGIILDDLRLRQIATKAVPSPTPPSA

SEQ ID NO: 3155 - protein, 257 aa, Artificial
  Alicyclobacillus acidocaldarius mutated SEQ ID NO 732
MIRELLMRDDTLFIAHRGASAECPENTLPAFVRAAELGADMIELDVRLTGDGGVVVLHDPTVDRTTNGSGLAADMRLADLRKLDAGSWFDARFRGTLIPTLDEVFATVPHMCLNIELKTSPVAHTRQLIRRVLGAIYRHNARDRVLISSFDHAALAEVRRFDRDIAIGVLFTGRLLEPIQLAERLGAQSLHPDIEHLDPLFVAEAKSHHLAVYAWTAKSELAVNKALACQVSGIILDDLRLRQIATKAVPSPTPPSA

SEQ ID NO: 3156 - protein, 257 aa, Artificial
  Alicyclobacillus acidocaldarius mutated SEQ ID NO 732
MIRELLMRDDTLFIAHRGASAECPENTLPAFVRAAELGADMIELDVRLTGDGGVVVLHDPTVDRTTNGSGLAADMRLADLRKLDAGSWFDARFRGTLIPTLDEVFATVPHMCLNIELKTSPVAHTRQLIRRVLGAIYRHNARDRVLISSFDHAALAEVRRFDRDIAIGVLFTGRLLEPIQLAERLGAQSLHPDIEHLDPLFVAEAKSHHLAVYAWTAKSELAVNRAIACQVSGIILDDLRLRQIATKAVPSPTPPSA

SEQ ID NO: 3157 - protein, 257 aa, Artificial
  Alicyclobacillus acidocaldarius mutated SEQ ID NO 732
MIRELLMRDDTLFIAHRGASAECPENTLPAFVRAAELGADMIELDVRLTGDGGVVVLHDPTVDRTTNGSGLAADMRLADLRKLDAGSWFDARFRGTLIPTLDEVFATVPHMCLQIELKTSPVAHTRQLIRRVLGAIYRHNARDRVLISSFDHAALAEVRRFDRDIAIGVLFTGRLLEPIQLAERLGAQSLHPDIEHLDPLFVAEAKSHHLAVYAWTAKSELAVNRALACQVSGIILDDLRLRQIATKAVPSPTPPSA

SEQ ID NO: 3158 - DNA, 774 bp, Artificial
  Alicyclobacillus acidocaldarius mutated SEQ ID NO 3147
atgattcgagaactcctgatgcgcgacgacacgctctttatcgcccaccgcggcgcgtccgccgaatgcccggagaacacgctgcccgccttcgtgcgggcggcggaattgggcgcggacatgattgagctcgacgtccgcctgacgggcgacggcggcgtcgtggtcctgcacgatccgacggtcgaccggacgaccaacggcagcggcctggccgccgacatgcgcctcgccgatctgcgcaagctcgacgccggatcgtggtttgacgcgcgctttcgcggcacactcatccccacgctcgacgaggtgttcgcgaccgtgccgcacatgtgcctgaacatcgagctgaagacgagccccgtcgcgcacacccgcaatctcatccgccgcgtccttggcgccatttaccgccacaacgcgcgcgatcgcgtcctcatctcctccttcgatcacgccgcgctggccgaggttcgccgcttcgaccgcgacatcgccatcggcgtgctcttcaccgggcgcctgctcgagcccatccagctcgcggagcgcctcggcgcgcagagcctccaccccgacatcgaacatctggatcccctgtttgtggccgaggccaaatcccaccacctcgcggtgtacgcgtggaccgcgaagagcgagctggccgtgaaccgggccttggcgtgccaggtgtccggcatcatcctggacgatctccggctgaggcaaatcgccaccaaggctgtcccctcgcccacgccgccctccgcgtga

SEQ ID NO: 3159 - DNA, 774 bp, Artificial
  Alicyclobacillus acidocaldarius mutated SEQ ID NO 3147
atgattcgagaactcctgatgcgcgacgacacgctctttatcgcccaccgcggcgcgtccgccgaatgcccggagaacacgctgcccgccttcgtgcgggcggcggaattgggcgcggacatgattgagctcgacgtccgcctgacgggcgacggcggcgtcgtggtcctgcacgatccgacggtcgaccggacgaccaacggcagcggcctggccgccgacatgcgcctcgccgatctgcgcaagctcgacgccggatcgtggtttgacgcgcgctttcgcggcacactcatccccacgctcgacgaggtgttcgcgaccgtgccgcacatgtgcctgaacatcgagctgaagacgagccccgtcgcgcacacccgccagctcatccgccgcgtccttggcgccatttaccgccacaacgcgcgcgatcgcgtcctcatctcctccttcgatcacgccgcgctggccgaggttcgccgcttcgaccgcgacatcgccatcggcgtgctcttcaccgggcgcctgctcgagcccatccagctcgcggagcgcctcggcgcgcagagcctccaccccgacatcgaacatctggatcccctgtttgtggccgatgccaaatcccaccacctcgcggtgtacgcgtggaccgcgaagagcgagctggccgtgaaccgggccttggcgtgccaggtgtccggcatcatcctggacgatctccggctgaggcaaatcgccaccaaggctgtcccctcgcccacgccgccctccgcgtga

SEQ ID NO: 3160 - DNA, 774 bp, Artificial
  Alicyclobacillus acidocaldarius mutated SEQ ID NO 3147
atgattcgagaactcctgatgcgcgacgacacgctctttatcgcccaccgcggcgcgtccgccgaatgcccggagaacacgctgcccgccttcgtgcgggcggcggaattgggcgcggacatgattgagctcgacgtccgcctgacgggcgacggcggcgtcgtggtcctgcacgatccgacggtcgaccggacgaccaacggcagcggcctggccgccgacatgcgcctcgccgatctgcgcaagctcgacgccggatcgtggtttgacgcgcgctttcgcggcacactcatccccacgctcgacgaggtgttcgcgaccgtgccgcacatgtgcctgaacatcgagctgaagacgagccccgtcgcgcacacccgccagctcatccgccgcgtccttggcgccatttaccgccacaacgcgcgcgatcgcgtcctcatctcctccttcgatcacgccgcgctggccgaggttcgccgcttcgaccgcgacatcgccatcggcgtgctcttcaccgggcgcctgctcgagcccatccagctcgcggagcgcctcggcgcgcagagcctccaccccgacatcgaacatctggatcccctgtttgtggccgaggccaaatcccaccacctcgcggtgtacgcgtggaccgcgaagagcgagctggccgtgaacaaagccttggcgtgccaggtgtccggcatcatcctggacgatctccggctgaggcaaatcgccaccaaggctgtcccctcgcccacgccgccctccgcgtga

SEQ ID NO: 3161 - DNA, 774 bp, Artificial
  Alicyclobacillus acidocaldarius mutated SEQ ID NO 3147
atgattcgagaactcctgatgcgcgacgacacgctctttatcgcccaccgcggcgcgtccgccgaatgcccggagaacacgctgcccgccttcgtgcgggcggcggaattgggcgcggacatgattgagctcgacgtccgcctgacgggcgacggcggcgtcgtggtcctgcacgatccgacggtcgaccggacgaccaacggcagcggcctggccgccgacatgcgcctcgccgatctgcgcaagctcgacgccggatcgtggtttgacgcgcgctttcgcggcacactcatccccacgctcgacgaggtgttcgcgaccgtgccgcacatgtgcctgaacatcgagctgaagacgagccccgtcgcgcacacccgccagctcatccgccgcgtccttggcgccatttaccgccacaacgcgcgcgatcgcgtcctcatctcctccttcgatcacgccgcgctggccgaggttcgccgcttcgaccgcgacatcgccatcggcgtgctcttcaccgggcgcctgctcgagcccatccagctcgcggagcgcctcggcgcgcagagcctccaccccgacatcgaacatctggatcccctgtttgtggccgaggccaaatcccaccacctcgcggtgtacgcgtggaccgcgaagagcgagctggccgtgaaccgggccattgcgtgccaggtgtccggcatcatcctggacgatctccggctgaggcaaatcgccaccaaggctgtcccctcgcccacgccgccctccgcgtga

SEQ ID NO: 3162 - DNA, 774 bp, Artificial
  Alicyclobacillus acidocaldarius mutated SEQ ID NO 3147
atgattcgagaactcctgatgcgcgacgacacgctctttatcgcccaccgcggcgcgtccgccgaatgcccggagaacacgctgcccgccttcgtgcgggcggcggaattgggcgcggacatgattgagctcgacgtccgcctgacgggcgacggcggcgtcgtggtcctgcacgatccgacggtcgaccggacgaccaacggcagcggcctggccgccgacatgcgcctcgccgatctgcgcaagctcgacgccggatcgtggtttgacgcgcgctttcgcggcacactcatccccacgctcgacgaggtgttcgcgaccgtgccgcacatgtgcctgcaaatcgagctgaagacgagccccgtcgcgcacacccgccagctcatccgccgcgtccttggcgccatttaccgccacaacgcgcgcgatcgcgtcctcatctcctccttcgatcacgccgcgctggccgaggttcgccgcttcgaccgcgacatcgccatcggcgtgctcttcaccgggcgcctgctcgagcccatccagctcgcggagcgcctcggcgcgcagagcctccaccccgacatcgaacatctggatcccctgtttgtggccgaggccaaatcccaccacctcgcggtgtacgcgtggaccgcgaagagcgagctggccgtgaaccgggccttggcgtgccaggtgtccggcatcatcctggacgatctccggctgaggcaaatcgccaccaaggctgtcccctcgcccacgccgccctccgcgtga

SEQ ID NO: 3163 - protein, 330 aa, Alicyclobacillus acidocaldarius
MVGVEFDVLEATPMALTEMPRVFQTTSEKRLNHSILPMRLYHKAKKLGTWDPRDIDFTKDKEDWQGMNEAERRVILRLCSLFVAGEEAVTLDLLPLIMAVAREGRLEEEMYLTTFLFEEAKHTEVFRRFLDEVAGETSDLSVFHKDHYRKIFYEYLPQAMGRLVHDPSPEAQAEASVTYNMVVEGVLAETGYYAFYTALQKENKLPGLIQAIRLLQRDESRHIGYGTYLLSRLISENAHIWDVVNRRINLLLPHAIGVVQDLNAELDTEEAQKLAEELGITDVPFGLNPDEFVAYAQKQFATRLGVLQRARGKSVDEIYYYTEETVGVEQ

SEQ ID NO: 3164 - DNA, 993 bp, Alicyclobacillus acidocaldarius
atggtaggggtagaattcgatgtactggaggcgacacccatggcattgacggaaatgcctcgcgtatttcagacgaccagcgagaagcgcttgaaccacagcattctgcccatgcggttgtatcacaaggcgaagaagctcggcacgtgggatccgcgggacatcgatttcacaaaggacaaggaagactggcaggggatgaacgaagccgagcgccgcgtcattctccgcctgtgctcgttgtttgtcgctggcgaggaagcggttacactcgaccttctgcccctcatcatggccgtggcgcgcgagggccgcttggaggaggagatgtacctcacgacgttcctcttcgaagaagcgaaacacacagaggtgtttcggcgcttcctcgacgaggtggctggcgaaacgtccgatttgtccgtctttcataaggaccattaccgcaaaatcttctatgagtacctgccgcaggccatgggccgtctcgtgcacgatccatctcccgaggcgcaggccgaagcgtccgtgacctacaacatggtggtggagggcgtgctcgcggagaccggatactacgcgttctacaccgcgctgcagaaggaaaacaagctccccgggctgatccaggccatccgccttctccagcgcgacgagtcccggcacatcggctacggcacctacctgttgtctcggctcatcagcgagaacgctcacatctgggacgtcgtcaatcggcggatcaacctgcttttgccgcacgctatcggggtggtgcaggatctgaacgccgagctcgacacagaggaagcgcaaaagctcgccgaggaactcggcatcaccgacgttccattcgggttgaatccagacgaattcgtggcttacgcgcagaagcagtttgccactcgcctcggcgttctgcagcgcgcccgcggcaagtccgtggacgagatctattactacaccgaggagaccgtcggcgtggagcagtga

SEQ ID NO: 3165 - protein, 280 aa, Roseiflexus castenholzii
VFVTTSRGLRRDSVPMRLFEKAKRLGVWNPSDIDFSQDMRDWQTLTDDERDLVLRLTSLFQAGEEAVTLDLLPLVATIAAEGRIEEELFLTSFLWEEAKHTDFFNRFLTEVAGVTGDLSHYHTANYRALIHEALPAAMERLRDDPSPEAQAIASLTYNMIVEGVLAETGYHAYFTMLERRNLMPGTRKGIGLLKQDESRHIAYGVYLLSRLINAEPRLWDVVVERMNELVVYAMGVIDDAFACYEVVPFGLSHDDFMQFAMGQFERRLDRIERARNQTVE

SEQ ID NO: 3166 - protein, 279 aa, Roseiflexus  RS-1
TTSRGLRRDTVPMRLFEKAKRLGVWNPSDIDFSQDVRDWQTLTADERDLVLRLTSLFQAGEEAVTLDLLPLVATIAAEGRIEEELFLTSFLWEEAKHTDFFNRFLTEVTGVTGDLSHYHTSNYRALIHEALPAAMGRLRDDPSPEAQAIASLTYNMIVEGVLAETGYHAYFTMLERRDLMPGTRKGIGLLKQDESRHIAYGVYLLSRLINAEPRLWDVIVERMNELVVYAMGVIDDAFACYEVVPFGLSHDDFMHFAMGQFQRRLDRIERARDQTLESI

SEQ ID NO: 3167 - protein, 279 aa, Chloroflexus aggregans
TTSRGLRRNSPPMRLFEKAKQFGIWNPSLLDFSRDIDDWNRLSDEERDLLLRLTALFQAGEEAVTLDLLPLIKAIAHDGRLEEELFLTTFLFEEAKHTDFFARFISEVARVDPDLSRYHTPSYRALIYDALPRAMQRLEHDPSPFNLAEASLTYNMIVEGVLAETGYHGYFTILDTHNLMPGVREGIRLLKQDESRHIAYGIYLLSRLIAADRQIWDHIVERMNELVIHALGVIDEIFTSYDTMPFGLQIETFSTFALNQFQRRLNRLELACQQSLAEI

SEQ ID NO: 3168 - protein, 279 aa, Chloroflexus aurantiacus
TTSRGLNRNSPPMRLFEKAKRFGIWNPSLIDLSRDIRDWEQLRDEERDLLLRLTALFQAGEEAVTLDLLPLIRTIAREGRLEEELYLTTFLFEEAKHTDFFARFISEVARVDPDLSRYHTASYRALIYEALPAALHRLDHDPSPLNLAEASLTYNMIVEGVLAETGYHAYFTILDSQDIMPGTREGIRLLKQDESRHIAYGVYLLSRLIATDPQVWDHIVERMNELVLYAMGVIDEIFACYDPMPFNLQIETFSTFALNQFQRRLNRLELASRQSMNEI

SEQ ID NO: 3169 - protein, 275 aa, Saccharopolyspora erythraea
LNWDSLPLRLFGKGNAKFWDPADIDFTRDAEDWQGLTEEERRSVAMLCSQFIAGEEAVTQDLQPFMAAMAAEGRFGDEMYLTQFCFEEAKHTQVFRLWMDAVGLTGDLHSHVAENPGYRAIFYEELPRSLNALHDDPSPANQVRASVTYNHVVEGTLALTGYFAWQKICRSRGILPGMQEVVRRIGDDERRHMAWGTFTCRRHVAADESNWDVVQEQMQHLLPLAVTQIQWRPEDAPEETPFRLDIDELAAYASDRAGRRLGAISAARGVPVEQI

SEQ ID NO: 3170 - protein, 330 aa, Artificial
  Alicyclobacillus acidocaldarius mutated SEQ ID NO 3163
MVGVEFDVLEATPMALTEMPRVFQTTSEKRLNHSILPMRLYHKAKKLGTWDPRDIDFTKDKEDWQGMNEAERRVILRLCSLFVAGEEAVTLDLLPLIMAVAREGRLEEEMYLTTFLFEEAKHTEVFRRFLDEVAGETSDLSVFHKDHYRKIFYEYLPQAMGRLVHDPSPEAQAEASVTYNMVVEGVLAETGYYAFYTALQKENKLPGLIQAIRLLQRDESRHIGYGTYLLSRLISENAHIWDVVNRRINLLLPHAIGVVQDLNAELDTEEAQKLAEELGITDVPFGLNPDEFVAYAQKQFATRLGVLQRAKGKSVDEIYYYTEETVGVEQ

SEQ ID NO: 3171 - protein, 330 aa, Artificial
  Alicyclobacillus acidocaldarius mutated SEQ ID NO 3163
MVGVEFDVLEATPMALTEMPRVFQTTSEKRLNHSILPMRLYHKAKKLGTWDPRDIDFTKDKEDWQGMNEAERRVILRLCSLFIAGEEAVTLDLLPLIMAVAREGRLEEEMYLTTFLFEEAKHTEVFRRFLDEVAGETSDLSVFHKDHYRKIFYEYLPQAMGRLVHDPSPEAQAEASVTYNMVVEGVLAETGYYAFYTALQKENKLPGLIQAIRLLQRDESRHIGYGTYLLSRLISENAHIWDVVNRRINLLLPHAIGVVQDLNAELDTEEAQKLAEELGITDVPFGLNPDEFVAYAQKQFATRLGVLQRARGKSVDEIYYYTEETVGVEQ

SEQ ID NO: 3172 - protein, 330 aa, Artificial
  Alicyclobacillus acidocaldarius mutated SEQ ID NO 3163
MVGVEFDVLEATPMALTEMPRVFQTTSEKRLNHSILPMRLYHKAKKLGTWDPRDIDFTKDKEDWQGMNEAERRVILRLCSLFVAGEEAVTLDLLPLIMAVAREGRLEEEMYLTTFLFEEAKHTEVFRRFLDEVAGETSDLSVFHKDHYRKIFYEYLPQAMGRLVHDPSPEAQAEASVTYNMVVEGVLAETGYYAFYTALQKENKLPGLIQAIRLLQRDESRHIGYGTYLLSRLISENAHIWDVVNRRINLLLPHAIGVVQDLNAELDTEEAQRLAEELGITDVPFGLNPDEFVAYAQKQFATRLGVLQRARGKSVDEIYYYTEETVGVEQ

SEQ ID NO: 3173 - protein, 330 aa, Artificial
  Alicyclobacillus acidocaldarius mutated SEQ ID NO 3163
MVGVEFDVLEATPMALTEMPRVFQTTSEKRLNHSILPMRLYHKAKKLGTWDPRDIDFTKDKEDWQGMNEAERRVILRLCSLFVAGEEAVTLDLLPLIMAVAREGRLEEEMYLTTFLFEEAKHTEVFRRFLDEVAGETSDLSIFHKDHYRKIFYEYLPQAMGRLVHDPSPEAQAEASVTYNMVVEGVLAETGYYAFYTALQKENKLPGLIQAIRLLQRDESRHIGYGTYLLSRLISENAHIWDVVNRRINLLLPHAIGVVQDLNAELDTEEAQKLAEELGITDVPFGLNPDEFVAYAQKQFATRLGVLQRARGKSVDEIYYYTEETVGVEQ

SEQ ID NO: 3174 - protein, 330 aa, Artificial
  Alicyclobacillus acidocaldarius mutated SEQ ID NO 3163
MVGVEFDVLEATPMALTEMPRVFQTTSEKRLNHSILPMRLYHKAKKLGTWDPRDIDFTKDKEDWQGMNEAERRVILRLCSLFVAGEEAVTLDLLPLIMAVAREGRLEEEMYLTTFLFEEAKHTEVFRRFLDEVAGETSDLSVFHKDHYRKIFYEYLPQAMGRLVHDPSPEAQAEASVTYNMVVEGVLAETGYYAFYTAIQKENKLPGLIQAIRLLQRDESRHIGYGTYLLSRLISENAHIWDVVNRRINLLLPHAIGVVQDLNAELDTEEAQKLAEELGITDVPFGLNPDEFVAYAQKQFATRLGVLQRARGKSVDEIYYYTEETVGVEQ

SEQ ID NO: 3175 - DNA, 993 bp, Artificial
  Alicyclobacillus acidocaldarius mutated SEQ ID NO 3164
atggtaggggtagaattcgatgtactggaggcgacacccatggcattgacggaaatgcctcgcgtatttcagacgaccagcgagaagcgcttgaaccacagcattctgcccatgcggttgtatcacaaggcgaagaagctcggcacgtgggatccgcgggacatcgatttcacaaaggacaaggaagactggcaggggatgaacgaagccgagcgccgcgtcattctccgcctgtgctcgttgtttgtcgctggcgaggaagcggttacactcgaccttctgcccctcatcatggccgtggcgcgcgagggccgcttggaggaggagatgtacctcacgacgttcctcttcgaagaagcgaaacacacagaggtgtttcggcgcttcctcgacgaggtggctggcgaaacgtccgatttgtccgtctttcataaggaccattaccgcaaaatcttctatgagtacctgccgcaggccatgggccgtctcgtgcacgatccatctcccgaggcgcaggccgaagcgtccgtgacctacaacatggtggtggagggcgtgctcgcggagaccggatactacgcgttctacaccgcgctgcagaaggaaaacaagctccccgggctgatccaggccatccgccttctccagcgcgacgagtcccggcacatcggctacggcacctacctgttgtctcggctcatcagcgagaacgctcacatctgggacgtcgtcaatcggcggatcaacctgcttttgccgcacgctatcggggtggtgcaggatctgaacgccgagctcgacacagaggaagcgcaaaagctcgccgaggaactcggcatcaccgacgttccattcgggttgaatccagacgaattcgtggcttacgcgcagaagcagtttgccactcgcctcggcgttctgcagcgcgccaaaggcaagtccgtggacgagatctattactacaccgaggagaccgtcggcgtggagcagtga

SEQ ID NO: 3176 - DNA, 993 bp, Artificial
  Alicyclobacillus acidocaldarius mutated SEQ ID NO 3164
atggtaggggtagaattcgatgtactggaggcgacacccatggcattgacggaaatgcctcgcgtatttcagacgaccagcgagaagcgcttgaaccacagcattctgcccatgcggttgtatcacaaggcgaagaagctcggcacgtgggatccgcgggacatcgatttcacaaaggacaaggaagactggcaggggatgaacgaagccgagcgccgcgtcattctccgcctgtgctcgttgtttattgctggcgaggaagcggttacactcgaccttctgcccctcatcatggccgtggcgcgcgagggccgcttggaggaggagatgtacctcacgacgttcctcttcgaagaagcgaaacacacagaggtgtttcggcgcttcctcgacgaggtggctggcgaaacgtccgatttgtccgtctttcataaggaccattaccgcaaaatcttctatgagtacctgccgcaggccatgggccgtctcgtgcacgatccatctcccgaggcgcaggccgaagcgtccgtgacctacaacatggtggtggagggcgtgctcgcggagaccggatactacgcgttctacaccgcgctgcagaaggaaaacaagctccccgggctgatccaggccatccgccttctccagcgcgacgagtcccggcacatcggctacggcacctacctgttgtctcggctcatcagcgagaacgctcacatctgggacgtcgtcaatcggcggatcaacctgcttttgccgcacgctatcggggtggtgcaggatctgaacgccgagctcgacacagaggaagcgcaaaagctcgccgaggaactcggcatcaccgacgttccattcgggttgaatccagacgaattcgtggcttacgcgcagaagcagtttgccactcgcctcggcgttctgcagcgcgcccgcggcaagtccgtggacgagatctattactacaccgaggagaccgtcggcgtggagcagtga

SEQ ID NO: 3177 - DNA, 993 bp, Artificial
  Alicyclobacillus acidocaldarius mutated SEQ ID NO 3164
atggtaggggtagaattcgatgtactggaggcgacacccatggcattgacggaaatgcctcgcgtatttcagacgaccagcgagaagcgcttgaaccacagcattctgcccatgcggttgtatcacaaggcgaagaagctcggcacgtgggatccgcgggacatcgatttcacaaaggacaaggaagactggcaggggatgaacgaagccgagcgccgcgtcattctccgcctgtgctcgttgtttgtcgctggcgaggaagcggttacactcgaccttctgcccctcatcatggccgtggcgcgcgagggccgcttggaggaggagatgtacctcacgacgttcctcttcgaagaagcgaaacacacagaggtgtttcggcgcttcctcgacgaggtggctggcgaaacgtccgatttgtccgtctttcataaggaccattaccgcaaaatcttctatgagtacctgccgcaggccatgggccgtctcgtgcacgatccatctcccgaggcgcaggccgaagcgtccgtgacctacaacatggtggtggagggcgtgctcgcggagaccggatactacgcgttctacaccgcgctgcagaaggaaaacaagctccccgggctgatccaggccatccgccttctccagcgcgacgagtcccggcacatcggctacggcacctacctgttgtctcggctcatcagcgagaacgctcacatctgggacgtcgtcaatcggcggatcaacctgcttttgccgcacgctatcggggtggtgcaggatctgaacgccgagctcgacacagaggaagcgcaacgtctcgccgaggaactcggcatcaccgacgttccattcgggttgaatccagacgaattcgtggcttacgcgcagaagcagtttgccactcgcctcggcgttctgcagcgcgcccgcggcaagtccgtggacgagatctattactacaccgaggagaccgtcggcgtggagcagtga

SEQ ID NO: 3178 - DNA, 993 bp, Artificial
  Alicyclobacillus acidocaldarius mutated SEQ ID NO 3164
atggtaggggtagaattcgatgtactggaggcgacacccatggcattgacggaaatgcctcgcgtatttcagacgaccagcgagaagcgcttgaaccacagcattctgcccatgcggttgtatcacaaggcgaagaagctcggcacgtgggatccgcgggacatcgatttcacaaaggacaaggaagactggcaggggatgaacgaagccgagcgccgcgtcattctccgcctgtgctcgttgtttgtcgctggcgaggaagcggttacactcgaccttctgcccctcatcatggccgtggcgcgcgagggccgcttggaggaggagatgtacctcacgacgttcctcttcgaagaagcgaaacacacagaggtgtttcggcgcttcctcgacgaggtggctggcgaaacgtccgatttgtccatttttcataaggaccattaccgcaaaatcttctatgagtacctgccgcaggccatgggccgtctcgtgcacgatccatctcccgaggcgcaggccgaagcgtccgtgacctacaacatggtggtggagggcgtgctcgcggagaccggatactacgcgttctacaccgcgctgcagaaggaaaacaagctccccgggctgatccaggccatccgccttctccagcgcgacgagtcccggcacatcggctacggcacctacctgttgtctcggctcatcagcgagaacgctcacatctgggacgtcgtcaatcggcggatcaacctgcttttgccgcacgctatcggggtggtgcaggatctgaacgccgagctcgacacagaggaagcgcaaaagctcgccgaggaactcggcatcaccgacgttccattcgggttgaatccagacgaattcgtggcttacgcgcagaagcagtttgccactcgcctcggcgttctgcagcgcgcccgcggcaagtccgtggacgagatctattactacaccgaggagaccgtcggcgtggagcagtga

SEQ ID NO: 3179 - DNA, 993 bp, Artificial
  Alicyclobacillus acidocaldarius mutated SEQ ID NO 3164
atggtaggggtagaattcgatgtactggaggcgacacccatggcattgacggaaatgcctcgcgtatttcagacgaccagcgagaagcgcttgaaccacagcattctgcccatgcggttgtatcacaaggcgaagaagctcggcacgtgggatccgcgggacatcgatttcacaaaggacaaggaagactggcaggggatgaacgaagccgagcgccgcgtcattctccgcctgtgctcgttgtttgtcgctggcgaggaagcggttacactcgaccttctgcccctcatcatggccgtggcgcgcgagggccgcttggaggaggagatgtacctcacgacgttcctcttcgaagaagcgaaacacacagaggtgtttcggcgcttcctcgacgaggtggctggcgaaacgtccgatttgtccgtctttcataaggaccattaccgcaaaatcttctatgagtacctgccgcaggccatgggccgtctcgtgcacgatccatctcccgaggcgcaggccgaagcgtccgtgacctacaacatggtggtggagggcgtgctcgcggagaccggatactacgcgttctacaccgcgattcagaaggaaaacaagctccccgggctgatccaggccatccgccttctccagcgcgacgagtcccggcacatcggctacggcacctacctgttgtctcggctcatcagcgagaacgctcacatctgggacgtcgtcaatcggcggatcaacctgcttttgccgcacgctatcggggtggtgcaggatctgaacgccgagctcgacacagaggaagcgcaaaagctcgccgaggaactcggcatcaccgacgttccattcgggttgaatccagacgaattcgtggcttacgcgcagaagcagtttgccactcgcctcggcgttctgcagcgcgcccgcggcaagtccgtggacgagatctattactacaccgaggagaccgtcggcgtggagcagtga

SEQ ID NO: 3180 - protein, 213 aa, Alicyclobacillus acidocaldarius
MGSTPPERTIFISDIHGHLRPFARLLERLGYRPDRDQLVLVGDYISGGPDSLGVLRLVRNLCSEGAVALRGNHEEAVVNWMRRGMKPLGPVRDSLYRAIAADASLAAFLSTLPYAWEGERWVAVHAGIDPDKPHWRQTAKRDLLTIRERFYARPHRVGKLVVFGHTPCVVLHGTHDVWYGSDKVGIDGGARHGGQVNALVDAGGALTSTAEPV

SEQ ID NO: 3181 - DNA, 642 bp, Alicyclobacillus acidocaldarius
gtgggttcaacgccacctgaacgaaccatcttcatcagcgacattcacgggcatctgcgcccgttcgcgcgcctgttggagaggctcggatatcggccggatcgtgatcaactggtcctcgtcggcgactacatctcgggcggcccggacagcctgggggtcctgcggctggtgcgaaatctttgctccgaaggggccgtggcgctccgcggcaatcacgaggaggcggtggtgaactggatgcgccgcgggatgaagccgcttggtccggtgcgagactcgctgtatcgagccatcgcggcggacgcgtcgctcgccgcctttctctccaccctgccgtacgcctgggaaggggagcggtgggtggccgttcacgccgggatcgatcccgacaagccccattggcgacagaccgcgaagcgagatctgctgacgatccgcgagcggttttatgcgcgcccgcatcgcgtgggcaagctggtggtgttcgggcacacgccgtgcgtggtgctgcatgggacgcatgacgtgtggtatggttcggataaagtcggaattgacggaggtgcgcgtcacggcggacaggtgaacgcgctcgtcgacgcgggcggcgcgttgaccagcacggctgagcccgtgtga

SEQ ID NO: 3182 - protein, 234 aa, Paenibacillus  JDR-2
ERTLVISDIHGCYDAFNRLLERVNYEPVKDQLILLGDFVSKGPDSKLVVEQSASLVREHGAIAVQGNHDERFVDIVRNKTKEAREKFFRHGGRQTVYSYLKGSDMTGSEEDLLNRLRETVLERYPYHADFLEQLPYYYEDKHFIYVHAGLNPKYPNWKEQPKRDFLYIKDSFHKSDTVVNKVVVFGHTKTVDLHGRADVWYGKGKIGIDGGCASGLQLNALEIIGEEVRSFSVP

SEQ ID NO: 3183 - protein, 214 aa, Enterococcus faecalis
ISDIHGQADLFDALLTDYDPVEHQLVLIGDLNDRGSDSKACFLKGKELVEQHGAVYLRGNHEEYFLQFLQNPEDWFAGYVRNGGKETIESLLHPGATAEYSPTEMALMIRSRYPELIDFLTKRPLYFEWQHYLFVHAGVDLTMEDWRQTAPKDFLWIREPFHQGKNNTGKTIVFGHTITPMLHGDMQTTDLWQSDGKIGIDGGAIFGGSVHGVI

SEQ ID NO: 3184 - protein, 210 aa, Lactococcus lactis
VSDIHGEYKKFKEILKYWDSNRQQLILLGDLCDRGLQSYECFYLAKYLCDNYGAILIKGNHEDLFLKFLNKTEDFKENYIKNGGLKTLESFGYSENNTFKDIVLDIKKNNDKLIEFLTYLPNFYEWNDYIFVHAGVNLKINNWKDTSIRDFMWIREDFHFTPNRLNKTIVFGHTETKILNKNNKYDIWIHDNKIGIDGGAVYGGYLYGVI

SEQ ID NO: 3185 - protein, 210 aa, Lactococcus lactis
VGDIHGEYKKFKEILKYWDSNRQQLILLGDLCDRGLQSYECFYLAKYLCDNYGAILIKGNHEDLFLKFLNKTEDFKENYIKNGGLKTLESFGYSENNTFKDIVLDIKKNNDKLIEFLTYLPNFYEWNDYIFVHAGVNLKINNWKDTSIRDFMWIREDFHFTPNRLNKTIVFGHTETKILNKNNKYDIWIHDNKIGIDGGAVYGGYLYGVI

SEQ ID NO: 3186 - protein, 214 aa, Enterococcus faecium
IGDVHGKHELFEKLIHYYDPKIHQLVLLGDLNDRGPRTKECFLLGKQLVEETGAIYLRGNHEEYFLQFLQSPEDWYAPYMRNGGKETFESLIHPGASEEYSPTEISMMIQSRYSELIKFLVQRPLYYEWENYLFVHAGVDLTKKDWRKTSLRDFIWIREPFHEGKNNTGKTIVFGHTITPMLHGDMQTTDLWIQDHKIGMDGGAVFGGSLHGVV

SEQ ID NO: 3187 - protein, 213 aa, Artificial
  Alicyclobacillus acidocaldarius mutated SEQ ID NO 3180
MGSTPPERTIFISDIHGHLRPFARLLERLGYRPDRDQLVLVGDYISGGPDSLGILRLVRNLCSEGAVALRGNHEEAVVNWMRRGMKPLGPVRDSLYRAIAADASLAAFLSTLPYAWEGERWVAVHAGIDPDKPHWRQTAKRDLLTIRERFYARPHRVGKLVVFGHTPCVVLHGTHDVWYGSDKVGIDGGARHGGQVNALVDAGGALTSTAEPV

SEQ ID NO: 3188 - protein, 213 aa, Artificial
  Alicyclobacillus acidocaldarius mutated SEQ ID NO 3180
MGSTPPERTIFISDIHGHLRPFARLLERLGYRPDRDQLVLVGDYISGGPDSLGVLRLIRNLCSEGAVALRGNHEEAVVNWMRRGMKPLGPVRDSLYRAIAADASLAAFLSTLPYAWEGERWVAVHAGIDPDKPHWRQTAKRDLLTIRERFYARPHRVGKLVVFGHTPCVVLHGTHDVWYGSDKVGIDGGARHGGQVNALVDAGGALTSTAEPV

SEQ ID NO: 3189 - protein, 213 aa, Artificial
  Alicyclobacillus acidocaldarius mutated SEQ ID NO 3180
MGSTPPERTIFISDIHGHLRPFARLLERLGYRPDRDQLVLVGDYISGGPDSLGVLRLVRNLCSEGAVALRGNHEEAVVNWMRRGMKPLGPVRDSLYRAIAADASLAAFLSTLPYAWEGERWVAVHAGIDPDKPHWRQTAKRDLLTIRERFYARPHRVGKLVVFGHTPCVVLHGTHDVWYGSDKVGIDGGARHGGQVNALVDAGGALTSTAEPI

SEQ ID NO: 3190 - protein, 213 aa, Artificial
  Alicyclobacillus acidocaldarius mutated SEQ ID NO 3180
MGSTPPERTIFISDIHGHLRPFARLLERLGYRPDRDQLVLVGDYISGGPDSLGVLRLVRNLCSEGAVALRGNHEEAVVNWMRRGMKPLGPVRDSLYRAIAADASLAAFLSTLPYAWEGERWVAVHAGIDPDKPHWRQTAKRDLLTIRERFYARPHRVGKLVVFGHTPCVVLHGTHDVWYGSDKVGIDGGARHGGNVNALVDAGGALTSTAEPV

SEQ ID NO: 3191 - protein, 213 aa, Artificial
  Alicyclobacillus acidocaldarius mutated SEQ ID NO 3180
MGSTPPERTIFISDIHGHLRPFARLLERLGYRPDRDQLVLVGDYISGGPDSLGVLRLVRNLCSEGAVALRGNHEEAVVNWMRRGMKPLGPVRDSIYRAIAADASLAAFLSTLPYAWEGERWVAVHAGIDPDKPHWRQTAKRDLLTIRERFYARPHRVGKLVVFGHTPCVVLHGTHDVWYGSDKVGIDGGARHGGQVNALVDAGGALTSTAEPV

SEQ ID NO: 3192 - DNA, 642 bp, Artificial
  Alicyclobacillus acidocaldarius mutated SEQ ID NO 3181
gtgggttcaacgccacctgaacgaaccatcttcatcagcgacattcacgggcatctgcgcccgttcgcgcgcctgttggagaggctcggatatcggccggatcgtgatcaactggtcctcgtcggcgactacatctcgggcggcccggacagcctggggattctgcggctggtgcgaaatctttgctccgaaggggccgtggcgctccgcggcaatcacgaggaggcggtggtgaactggatgcgccgcgggatgaagccgcttggtccggtgcgagactcgctgtatcgagccatcgcggcggacgcgtcgctcgccgcctttctctccaccctgccgtacgcctgggaaggggagcggtgggtggccgttcacgccgggatcgatcccgacaagccccattggcgacagaccgcgaagcgagatctgctgacgatccgcgagcggttttatgcgcgcccgcatcgcgtgggcaagctggtggtgttcgggcacacgccgtgcgtggtgctgcatgggacgcatgacgtgtggtatggttcggataaagtcggaattgacggaggtgcgcgtcacggcggacaggtgaacgcgctcgtcgacgcgggcggcgcgttgaccagcacggctgagcccgtgtga

SEQ ID NO: 3193 - DNA, 642 bp, Artificial
  Alicyclobacillus acidocaldarius mutated SEQ ID NO 3181
gtgggttcaacgccacctgaacgaaccatcttcatcagcgacattcacgggcatctgcgcccgttcgcgcgcctgttggagaggctcggatatcggccggatcgtgatcaactggtcctcgtcggcgactacatctcgggcggcccggacagcctgggggtcctgcggctgattcgaaatctttgctccgaaggggccgtggcgctccgcggcaatcacgaggaggcggtggtgaactggatgcgccgcgggatgaagccgcttggtccggtgcgagactcgctgtatcgagccatcgcggcggacgcgtcgctcgccgcctttctctccaccctgccgtacgcctgggaaggggagcggtgggtggccgttcacgccgggatcgatcccgacaagccccattggcgacagaccgcgaagcgagatctgctgacgatccgcgagcggttttatgcgcgcccgcatcgcgtgggcaagctggtggtgttcgggcacacgccgtgcgtggtgctgcatgggacgcatgacgtgtggtatggttcggataaagtcggaattgacggaggtgcgcgtcacggcggacaggtgaacgcgctcgtcgacgcgggcggcgcgttgaccagcacggctgagcccgtgtga

SEQ ID NO: 3194 - DNA, 642 bp, Artificial
  Alicyclobacillus acidocaldarius mutated SEQ ID NO 3181
gtgggttcaacgccacctgaacgaaccatcttcatcagcgacattcacgggcatctgcgcccgttcgcgcgcctgttggagaggctcggatatcggccggatcgtgatcaactggtcctcgtcggcgactacatctcgggcggcccggacagcctgggggtcctgcggctggtgcgaaatctttgctccgaaggggccgtggcgctccgcggcaatcacgaggaggcggtggtgaactggatgcgccgcgggatgaagccgcttggtccggtgcgagactcgctgtatcgagccatcgcggcggacgcgtcgctcgccgcctttctctccaccctgccgtacgcctgggaaggggagcggtgggtggccgttcacgccgggatcgatcccgacaagccccattggcgacagaccgcgaagcgagatctgctgacgatccgcgagcggttttatgcgcgcccgcatcgcgtgggcaagctggtggtgttcgggcacacgccgtgcgtggtgctgcatgggacgcatgacgtgtggtatggttcggataaagtcggaattgacggaggtgcgcgtcacggcggacaggtgaacgcgctcgtcgacgcgggcggcgcgttgaccagcacggctgagcccatttga

SEQ ID NO: 3195 - DNA, 642 bp, Artificial
  Alicyclobacillus acidocaldarius mutated SEQ ID NO 3181
gtgggttcaacgccacctgaacgaaccatcttcatcagcgacattcacgggcatctgcgcccgttcgcgcgcctgttggagaggctcggatatcggccggatcgtgatcaactggtcctcgtcggcgactacatctcgggcggcccggacagcctgggggtcctgcggctggtgcgaaatctttgctccgaaggggccgtggcgctccgcggcaatcacgaggaggcggtggtgaactggatgcgccgcgggatgaagccgcttggtccggtgcgagactcgctgtatcgagccatcgcggcggacgcgtcgctcgccgcctttctctccaccctgccgtacgcctgggaaggggagcggtgggtggccgttcacgccgggatcgatcccgacaagccccattggcgacagaccgcgaagcgagatctgctgacgatccgcgagcggttttatgcgcgcccgcatcgcgtgggcaagctggtggtgttcgggcacacgccgtgcgtggtgctgcatgggacgcatgacgtgtggtatggttcggataaagtcggaattgacggaggtgcgcgtcacggcggaaatgtgaacgcgctcgtcgacgcgggcggcgcgttgaccagcacggctgagcccgtgtga

SEQ ID NO: 3196 - DNA, 642 bp, Artificial
  Alicyclobacillus acidocaldarius mutated SEQ ID NO 3181
gtgggttcaacgccacctgaacgaaccatcttcatcagcgacattcacgggcatctgcgcccgttcgcgcgcctgttggagaggctcggatatcggccggatcgtgatcaactggtcctcgtcggcgactacatctcgggcggcccggacagcctgggggtcctgcggctggtgcgaaatctttgctccgaaggggccgtggcgctccgcggcaatcacgaggaggcggtggtgaactggatgcgccgcgggatgaagccgcttggtccggtgcgagactcgatttatcgagccatcgcggcggacgcgtcgctcgccgcctttctctccaccctgccgtacgcctgggaaggggagcggtgggtggccgttcacgccgggatcgatcccgacaagccccattggcgacagaccgcgaagcgagatctgctgacgatccgcgagcggttttatgcgcgcccgcatcgcgtgggcaagctggtggtgttcgggcacacgccgtgcgtggtgctgcatgggacgcatgacgtgtggtatggttcggataaagtcggaattgacggaggtgcgcgtcacggcggacaggtgaacgcgctcgtcgacgcgggcggcgcgttgaccagcacggctgagcccgtgtga

SEQ ID NO: 3197 - protein, 314 aa, Alicyclobacillus acidocaldarius
MAIDADLKLVTGNANPALAQEIADYIGVPLADCQVGRFSDGEVRIRLGESVRGANVFIIQPTSQPVNEHLMELLILMDAVKRASARTINVVIPYYGYARQDRKARARDPITAKLVANLLQTAGASRVISMDLHAGQIQGFFDIPVDHLIGMPILADYFLDKQIENPVVVSPDMGGVTRARAFAERLGAPLAIIDKRRPDANVAQVMNIIGDIEGKTAILIDDMIDTAGTITAGAAELLKRGARGVYACCIHPVLSGQGVERLQNSAIEEVVVTNTIALPEHKRIDKIKVLSVAELIAEAIIRVHTQRSVSQLFD

SEQ ID NO: 3198 - DNA, 945 bp, Alicyclobacillus acidocaldarius
gtggccattgacgccgacttgaagctcgtcacgggaaatgccaatccggcattggcgcaggaaattgccgactacatcggagtcccgctggcggactgccaagtcgggcggttttcggacggcgaggtccgcatccgcctgggcgagagcgtgcgaggcgcaaacgtgttcatcattcaacccacgagccagccggtcaacgagcacctcatggagctcctcatcctgatggacgcggtcaagcgcgcctcggcgcgcaccatcaacgtcgtgattccgtactatggatatgcgcgtcaggatcgcaaagcccgcgcgcgtgatcccatcacggcgaagctcgtcgccaatctgctgcagacggcgggcgcgagccgcgtcatttcgatggacctgcacgccggccagatccagggcttcttcgacatcccggtcgatcacctgatcgggatgcccatcctggcggattacttcctggacaagcaaattgagaaccccgtggtggtgtcgccggacatgggcggtgtcacgagggcgcgcgcgttcgcggagcggctcggcgcgccactcgccatcatcgacaagcggcggccggacgccaacgtggcgcaggtcatgaacattatcggcgatatcgagggcaagacggccatcctgattgacgacatgattgacacggcggggaccatcaccgcgggcgcggcggagcttttgaagcggggcgcgcgtggggtgtacgcgtgctgcattcacccggtgctctcgggacagggcgtggagcgcctgcagaactccgccatcgaagaggtggtcgtcacgaacaccatcgcgctgcccgaacacaagcggatcgacaaaatcaaggtgctgtcggtggcggaactcatcgcggaggccattatccgcgtgcacacgcagcgctccgtgagtcagctgttcgactga

SEQ ID NO: 3199 - protein, 308 aa, Carboxydothermus hydrogenoformans
DLKIFSGNANPDLAREIASFLGVEVGDARVSRFSDGEIQVKINESVRGADVFIIQPTCTPVNENLMELLILIDAIRRASARRITAVLPYFGYARQDRKTRARDPITAKLVSNLITVSGARRVIAMDLHAGQIQGFFDIPVDHLVGVPILAKYFNEKGLENKVVVSPDLGGVTRARDLAERIGAPIAIIDKRRPEPNVAEIMNIIGEIEGKTVIMIDDIIDTAGTITQGAQALMERGAKEVYVCCTHPILSGPAVDRLANAPIKEVVVTNTIPLPPEKKLPKIKVLSVAPLMGEAIRRIHEDLSVSELF

SEQ ID NO: 3200 - protein, 308 aa, Geobacillus kaustophilus
LKLFALNSNMKLAKEIAEVMGIELGKCSVSRFSDGEIQINIEESIRGDDVFVIQSTSVPVNEHLMELLIMIDALKRASARTINIVMPYYGYARQDRKARSREPITAKLVANLLETAGASRVITLDLHAPQIQGFFDIPIDHLMGVPILADYFKSKQLEDIVVVSPDHGGVTRARKLADRLKAPIAIIDKRRPKPNVAEVMNIVGQVAGKTAILIDDIIDTAGTITLAANALAENGAKEVYACCTHPVLSGPAIERIQNSRIKELVVTNSIALPEEKKIDKIVELSVAPLIAEAISRVYEMKSVSVLFD

SEQ ID NO: 3201 - protein, 310 aa, Bacillus subtilis
DKNLKIFSLNSNPELAKEIADIVGVQLGKCSVTRFSDGEVQINIEESIRGCDCYIIQSTSDPVNEHIMELLIMVDALKRASAKTINIVIPYYGYARQDRKARSREPITAKLFANLLETAGATRVIALDLHAPQIQGFFDIPIDHLMGVPILGEYFEGKNLEDIVIVSPDHGGVTRARKLADRLKAPIAIIDKRRPRPNVAEVMNIVGNIEGKTAILIDDIIDTAGTITLAANALVENGAKEVYACCTHPVLSGPAVERINNSTIKELVVTNSIKLPEEKKIERFKQLSVGPLLAEAIIRVHEQQSVSYLF

SEQ ID NO: 3202 - protein, 308 aa, Geobacillus thermodenitrificans
LKLFALNSNMKLAKQIAETMGIELGKCSVSRFSDGEIQINIEESIRGDDVFVIQSTSVPVNEHLMELLIMIDALKRASARTINIVMPYYGYARQDRKARSREPITAKLVANLLETAGASRVITLDLHAPQIQGFFDIPIDHLMGVPILADYFKSKQLDDVVIVSPDHGGVTRARKLADRLKAPLAIIDKRRPRPNAVEVMNIIGQVKGKTAILIDDIIDTAGTITLGANALVENGAKEVYACCTHPVLSGPAIERIQNSKIKELVVTNSIALPEEKKIDKIVELSVAPLIAEAITRVYEMQSVSVLFD

SEQ ID NO: 3203 - protein, 308 aa, Bacillus caldolyticus
LKLFALNSNMKLAKEIAEVMGIELGKCSVSRFSDGEIQINIEESIRGDDVFVIQSTSVPVNEHLMELLIMIDALKRASARTINIVMPYYGYARQDRKARSRNPITAKLVANLLETAGASRVITLDLHAPQIQGFFDIPIDHLMGVPILADYFKSKQLEDIVVVSPDHGGVTRARKLADRLKAPIAIIDKRRPKPNVAEVMNIVGQVAGKTAILIDDIIDTAGTITLAANALAESGAKEVYACCTHPVLSGPAIERIQSSKIKELVVTNSIALPEEKKIDKIVKLSVRPLIAEAITRVYEMKSVSVLFD

SEQ ID NO: 3204 - protein, 314 aa, Artificial
  Alicyclobacillus acidocaldarius mutated SEQ ID NO 3197
MAIDADLKLVTGNANPALAQEIADYIGVPLADCQVGRFSDGEVRIRLGESVRGANVFIIQPTSQPVNEHLMELLILMDAVKRASARTINVVIPYYGYARQDRKARARDPITAKLVANLLQTAGASRVISMDLHAGQIQGFFDIPVDHLIGMPILADYFLDKQIENPVVVSPDMGGVTRARAFAERLGAPLAIIDKRRPDANVAQVMNIIGDIEGKTAILIDDMIDTAGTITAGAAELLKRGARGVYACCIHPVLSGQGVERLQNSAIEEVVVTNTIALPEHKRIDKIKVLSVAELIAEAIIRVHTNRSVSQLFD

SEQ ID NO: 3205 - protein, 314 aa, Artificial
  Alicyclobacillus acidocaldarius mutated SEQ ID NO 3197
MAIDADLKLVTGNANPALAQEIADYIGVPLADCQVGRFSDGEVRIRLGESVRGANVFIIQPTSQPVNEHLMELLILMDAVKRASARTINVVIPYYGYARQDRKARARDPITAKLVANLLQTAGASRVISMDLHAGQIQGFFDIPVDHLIGMPILADYFIDKQIENPVVVSPDMGGVTRARAFAERLGAPLAIIDKRRPDANVAQVMNIIGDIEGKTAILIDDMIDTAGTITAGAAELLKRGARGVYACCIHPVLSGQGVERLQNSAIEEVVVTNTIALPEHKRIDKIKVLSVAELIAEAIIRVHTQRSVSQLFD

SEQ ID NO: 3206 - protein, 314 aa, Artificial
  Alicyclobacillus acidocaldarius mutated SEQ ID NO 3197
MAIDADLKLVTGNANPALAQEIADYIGVPLADCQVGRFSDGEVRIRLGESVRGANVFIIQPTSQPVNEHLMELLILMDAVKRASARTINVVIPYYGYARQDRKARARDPITAKLVANLLNTAGASRVISMDLHAGQIQGFFDIPVDHLIGMPILADYFLDKQIENPVVVSPDMGGVTRARAFAERLGAPLAIIDKRRPDANVAQVMNIIGDIEGKTAILIDDMIDTAGTITAGAAELLKRGARGVYACCIHPVLSGQGVERLQNSAIEEVVVTNTIALPEHKRIDKIKVLSVAELIAEAIIRVHTQRSVSQLFD

SEQ ID NO: 3207 - protein, 314 aa, Artificial
  Alicyclobacillus acidocaldarius mutated SEQ ID NO 3197
MAIDADLKLVTGNANPALAQEIADYIGVPLADCQVGRFSDGEVRIRLGESVRGANVFIIQPTSQPVNEHLMELLILMDAVKRASARTINVVIPYYGYARQDRKARARDPITAKLVANLLQTAGASRVISMDLHAGQIQGFFDIPVDHLIGMPILADYFLDKQIENPVVVSPDMGGVTRARAFAERLGAPLAIIDKRRPDANVAQVMNIIGDIEGKTAILIDDMIDTAGTITAGAAELIKRGARGVYACCIHPVLSGQGVERLQNSAIEEVVVTNTIALPEHKRIDKIKVLSVAELIAEAIIRVHTQRSVSQLFD

SEQ ID NO: 3208 - protein, 314 aa, Artificial
  Alicyclobacillus acidocaldarius mutated SEQ ID NO 3197
MAIDADLKLVTGNANPALAQEIADYIGVPLADCQVGRFSDGEVRIRLGESVRGANVFIIQPTSQPVNEHLMELLILMDAVKRASARTINVVIPYYGYARQDRKARARDPITAKLVANLLQTAGASRVISMDLHAGQIQGFFDIPVDHLIGMPILADYFLDKQIENPVVVSPDMGGVTRARAFAERLGAPLAIIDKRRPDANVAQVMNIIGDIEGKTAILIDDMIDTAGTITAGAAELLKRGARGVYACCIHPVLSGQGVERLQNSAIEEVVVTNTIALPEHKRIDKIKVLSVAELIAEAILRVHTQRSVSQLFD

SEQ ID NO: 3209 - DNA, 945 bp, Artificial
  Alicyclobacillus acidocaldarius mutated SEQ ID NO 3198
gtggccattgacgccgacttgaagctcgtcacgggaaatgccaatccggcattggcgcaggaaattgccgactacatcggagtcccgctggcggactgccaagtcgggcggttttcggacggcgaggtccgcatccgcctgggcgagagcgtgcgaggcgcaaacgtgttcatcattcaacccacgagccagccggtcaacgagcacctcatggagctcctcatcctgatggacgcggtcaagcgcgcctcggcgcgcaccatcaacgtcgtgattccgtactatggatatgcgcgtcaggatcgcaaagcccgcgcgcgtgatcccatcacggcgaagctcgtcgccaatctgctgcagacggcgggcgcgagccgcgtcatttcgatggacctgcacgccggccagatccagggcttcttcgacatcccggtcgatcacctgatcgggatgcccatcctggcggattacttcctggacaagcaaattgagaaccccgtggtggtgtcgccggacatgggcggtgtcacgagggcgcgcgcgttcgcggagcggctcggcgcgccactcgccatcatcgacaagcggcggccggacgccaacgtggcgcaggtcatgaacattatcggcgatatcgagggcaagacggccatcctgattgacgacatgattgacacggcggggaccatcaccgcgggcgcggcggagcttttgaagcggggcgcgcgtggggtgtacgcgtgctgcattcacccggtgctctcgggacagggcgtggagcgcctgcagaactccgccatcgaagaggtggtcgtcacgaacaccatcgcgctgcccgaacacaagcggatcgacaaaatcaaggtgctgtcggtggcggaactcatcgcggaggccattatccgcgtgcacacgaatcgctccgtgagtcagctgttcgactga

SEQ ID NO: 3210 - DNA, 945 bp, Artificial
  Alicyclobacillus acidocaldarius mutated SEQ ID NO 3198
gtggccattgacgccgacttgaagctcgtcacgggaaatgccaatccggcattggcgcaggaaattgccgactacatcggagtcccgctggcggactgccaagtcgggcggttttcggacggcgaggtccgcatccgcctgggcgagagcgtgcgaggcgcaaacgtgttcatcattcaacccacgagccagccggtcaacgagcacctcatggagctcctcatcctgatggacgcggtcaagcgcgcctcggcgcgcaccatcaacgtcgtgattccgtactatggatatgcgcgtcaggatcgcaaagcccgcgcgcgtgatcccatcacggcgaagctcgtcgccaatctgctgcagacggcgggcgcgagccgcgtcatttcgatggacctgcacgccggccagatccagggcttcttcgacatcccggtcgatcacctgatcgggatgcccatcctggcggattacttcattgacaagcaaattgagaaccccgtggtggtgtcgccggacatgggcggtgtcacgagggcgcgcgcgttcgcggagcggctcggcgcgccactcgccatcatcgacaagcggcggccggacgccaacgtggcgcaggtcatgaacattatcggcgatatcgagggcaagacggccatcctgattgacgacatgattgacacggcggggaccatcaccgcgggcgcggcggagcttttgaagcggggcgcgcgtggggtgtacgcgtgctgcattcacccggtgctctcgggacagggcgtggagcgcctgcagaactccgccatcgaagaggtggtcgtcacgaacaccatcgcgctgcccgaacacaagcggatcgacaaaatcaaggtgctgtcggtggcggaactcatcgcggaggccattatccgcgtgcacacgcagcgctccgtgagtcagctgttcgactga

SEQ ID NO: 3211 - DNA, 945 bp, Artificial
  Alicyclobacillus acidocaldarius mutated SEQ ID NO 3198
gtggccattgacgccgacttgaagctcgtcacgggaaatgccaatccggcattggcgcaggaaattgccgactacatcggagtcccgctggcggactgccaagtcgggcggttttcggacggcgaggtccgcatccgcctgggcgagagcgtgcgaggcgcaaacgtgttcatcattcaacccacgagccagccggtcaacgagcacctcatggagctcctcatcctgatggacgcggtcaagcgcgcctcggcgcgcaccatcaacgtcgtgattccgtactatggatatgcgcgtcaggatcgcaaagcccgcgcgcgtgatcccatcacggcgaagctcgtcgccaatctgctgaatacggcgggcgcgagccgcgtcatttcgatggacctgcacgccggccagatccagggcttcttcgacatcccggtcgatcacctgatcgggatgcccatcctggcggattacttcctggacaagcaaattgagaaccccgtggtggtgtcgccggacatgggcggtgtcacgagggcgcgcgcgttcgcggagcggctcggcgcgccactcgccatcatcgacaagcggcggccggacgccaacgtggcgcaggtcatgaacattatcggcgatatcgagggcaagacggccatcctgattgacgacatgattgacacggcggggaccatcaccgcgggcgcggcggagcttttgaagcggggcgcgcgtggggtgtacgcgtgctgcattcacccggtgctctcgggacagggcgtggagcgcctgcagaactccgccatcgaagaggtggtcgtcacgaacaccatcgcgctgcccgaacacaagcggatcgacaaaatcaaggtgctgtcggtggcggaactcatcgcggaggccattatccgcgtgcacacgcagcgctccgtgagtcagctgttcgactga

SEQ ID NO: 3212 - DNA, 945 bp, Artificial
  Alicyclobacillus acidocaldarius mutated SEQ ID NO 3198
gtggccattgacgccgacttgaagctcgtcacgggaaatgccaatccggcattggcgcaggaaattgccgactacatcggagtcccgctggcggactgccaagtcgggcggttttcggacggcgaggtccgcatccgcctgggcgagagcgtgcgaggcgcaaacgtgttcatcattcaacccacgagccagccggtcaacgagcacctcatggagctcctcatcctgatggacgcggtcaagcgcgcctcggcgcgcaccatcaacgtcgtgattccgtactatggatatgcgcgtcaggatcgcaaagcccgcgcgcgtgatcccatcacggcgaagctcgtcgccaatctgctgcagacggcgggcgcgagccgcgtcatttcgatggacctgcacgccggccagatccagggcttcttcgacatcccggtcgatcacctgatcgggatgcccatcctggcggattacttcctggacaagcaaattgagaaccccgtggtggtgtcgccggacatgggcggtgtcacgagggcgcgcgcgttcgcggagcggctcggcgcgccactcgccatcatcgacaagcggcggccggacgccaacgtggcgcaggtcatgaacattatcggcgatatcgagggcaagacggccatcctgattgacgacatgattgacacggcggggaccatcaccgcgggcgcggcggagcttattaagcggggcgcgcgtggggtgtacgcgtgctgcattcacccggtgctctcgggacagggcgtggagcgcctgcagaactccgccatcgaagaggtggtcgtcacgaacaccatcgcgctgcccgaacacaagcggatcgacaaaatcaaggtgctgtcggtggcggaactcatcgcggaggccattatccgcgtgcacacgcagcgctccgtgagtcagctgttcgactga

SEQ ID NO: 3213 - DNA, 945 bp, Artificial
  Alicyclobacillus acidocaldarius mutated SEQ ID NO 3198
gtggccattgacgccgacttgaagctcgtcacgggaaatgccaatccggcattggcgcaggaaattgccgactacatcggagtcccgctggcggactgccaagtcgggcggttttcggacggcgaggtccgcatccgcctgggcgagagcgtgcgaggcgcaaacgtgttcatcattcaacccacgagccagccggtcaacgagcacctcatggagctcctcatcctgatggacgcggtcaagcgcgcctcggcgcgcaccatcaacgtcgtgattccgtactatggatatgcgcgtcaggatcgcaaagcccgcgcgcgtgatcccatcacggcgaagctcgtcgccaatctgctgcagacggcgggcgcgagccgcgtcatttcgatggacctgcacgccggccagatccagggcttcttcgacatcccggtcgatcacctgatcgggatgcccatcctggcggattacttcctggacaagcaaattgagaaccccgtggtggtgtcgccggacatgggcggtgtcacgagggcgcgcgcgttcgcggagcggctcggcgcgccactcgccatcatcgacaagcggcggccggacgccaacgtggcgcaggtcatgaacattatcggcgatatcgagggcaagacggccatcctgattgacgacatgattgacacggcggggaccatcaccgcgggcgcggcggagcttttgaagcggggcgcgcgtggggtgtacgcgtgctgcattcacccggtgctctcgggacagggcgtggagcgcctgcagaactccgccatcgaagaggtggtcgtcacgaacaccatcgcgctgcccgaacacaagcggatcgacaaaatcaaggtgctgtcggtggcggaactcatcgcggaggccattttacgcgtgcacacgcagcgctccgtgagtcagctgttcgactga

SEQ ID NO: 3214 - protein, 90 aa, Alicyclobacillus acidocaldarius
MNKMELINRVAEKTNLKKKDAESAVNAVFEIIEEALANGEKVQIIGFGTFETRSRAARSGRNPQTGEVIEIPASTVPAFKPGNKLKEVTR

SEQ ID NO: 3215 - DNA, 273 bp, Alicyclobacillus acidocaldarius
gtgaataagatggaactcatcaaccgtgtcgcggaaaagaccaacttgaagaagaaggacgcggagagtgcggtcaacgccgtgttcgagatcatcgaggaggccctcgccaacggcgagaaggtgcagatcatcggctttggcacgtttgagacgcgttctcgcgccgcgcgctcgggccgcaacccgcagacgggcgaggtcatcgagatcccggcttccacggtgcctgcgttcaaaccgggcaacaagctcaaggaagtcacgcgctga

SEQ ID NO: 3216 - protein, 90 aa, Bacillus selenitireducens
MNKTELINAVAESADLSKKDATSAVDAVFEVITDSLKKGDKVQLIGFGNFEVRERAARKGRNPQTGEEIEIPASNVPAFKPGKALKDAVK

SEQ ID NO: 3217 - protein, 89 aa, Lactobacillus salivarius; identical to SEQ ID NO: 1027

SEQ ID NO: 3218 - protein, 90 aa, Bacillus  SG-1
MNKTELINAVAEAAELSKKDATKAVDAVFESIQDALANGDKVQLIGFGNFEVRERAARKGRNPQTGEEIEISASKVPAFKPGKALKDAVK

SEQ ID NO: 3219 - protein, 87 aa, Oceanobacillus iheyensis
MNKTDLVNAVAEKSELSKKDATKAVDAVFESVMDSLKNGEKVQLIGFGNFEVRERSARKGRNPQTGEEIEIPASKVPAFKPGKALKD

SEQ ID NO: 3220 - protein, 87 aa, Carboxydothermus hydrogenoformans
MNKAELVSVIAEKAEMTKKDAEKALNAVLAAIEEALKKGEKVQLVGFGTFEVRERAARKGRNPQTGQEIEIPASKVPVFKPGKLLKE

SEQ ID NO: 3221 - protein, 90 aa, Artificial
  Alicyclobacillus acidocaldarius mutated SEQ ID NO 3214
MNKMELINRVAEKTNLKKKDAESAVNAVFEIIDEALANGEKVQIIGFGTFETRSRAARSGRNPQTGEVIEIPASTVPAFKPGNKLKEVTR

SEQ ID NO: 3222 - protein, 90 aa, Artificial
  Alicyclobacillus acidocaldarius mutated SEQ ID NO 3214
MNKMELINRVAEKTNLKKKDADSAVNAVFEIIEEALANGEKVQIIGFGTFETRSRAARSGRNPQTGEVIEIPASTVPAFKPGNKLKEVTR

SEQ ID NO: 3223 - protein, 90 aa, Artificial
  Alicyclobacillus acidocaldarius mutated SEQ ID NO 3214
MNKMELINRVAEKTNLKKKDAESAVNAVFEIIEEALANGEKVQIIGFGTFETRSRAARSGRNPQTGEIIEIPASTVPAFKPGNKLKEVTR

SEQ ID NO: 3224 - protein, 90 aa, Artificial
  Alicyclobacillus acidocaldarius mutated SEQ ID NO 3214
MNKMELINRVAEKTQLKKKDAESAVNAVFEIIEEALANGEKVQIIGFGTFETRSRAARSGRNPQTGEVIEIPASTVPAFKPGNKLKEVTR

SEQ ID NO: 3225 - protein, 90 aa, Artificial
  Alicyclobacillus acidocaldarius mutated SEQ ID NO 3214
MNKMELINRVAEKTNLKKKDAESAVNAVFEIIEEALANGEKVQIIGFGTFETRSRAARSGRNPQTGEVIEIPASTVPAFKPGNKLKEVTK

SEQ ID NO: 3226 - DNA, 273 bp, Artificial
  Alicyclobacillus acidocaldarius mutated SEQ ID NO 3215
gtgaataagatggaactcatcaaccgtgtcgcggaaaagaccaacttgaagaagaaggacgcggagagtgcggtcaacgccgtgttcgagatcatcgatgaggccctcgccaacggcgagaaggtgcagatcatcggctttggcacgtttgagacgcgttctcgcgccgcgcgctcgggccgcaacccgcagacgggcgaggtcatcgagatcccggcttccacggtgcctgcgttcaaaccgggcaacaagctcaaggaagtcacgcgctga

SEQ ID NO: 3227 - DNA, 273 bp, Artificial
  Alicyclobacillus acidocaldarius mutated SEQ ID NO 3215
gtgaataagatggaactcatcaaccgtgtcgcggaaaagaccaacttgaagaagaaggacgcggatagtgcggtcaacgccgtgttcgagatcatcgaggaggccctcgccaacggcgagaaggtgcagatcatcggctttggcacgtttgagacgcgttctcgcgccgcgcgctcgggccgcaacccgcagacgggcgaggtcatcgagatcccggcttccacggtgcctgcgttcaaaccgggcaacaagctcaaggaagtcacgcgctga

SEQ ID NO: 3228 - DNA, 273 bp, Artificial
  Alicyclobacillus acidocaldarius mutated SEQ ID NO 3215
gtgaataagatggaactcatcaaccgtgtcgcggaaaagaccaacttgaagaagaaggacgcggagagtgcggtcaacgccgtgttcgagatcatcgaggaggccctcgccaacggcgagaaggtgcagatcatcggctttggcacgtttgagacgcgttctcgcgccgcgcgctcgggccgcaacccgcagacgggcgagattatcgagatcccggcttccacggtgcctgcgttcaaaccgggcaacaagctcaaggaagtcacgcgctga

SEQ ID NO: 3229 - DNA, 273 bp, Artificial
  Alicyclobacillus acidocaldarius mutated SEQ ID NO 3215
gtgaataagatggaactcatcaaccgtgtcgcggaaaagacccaattgaagaagaaggacgcggagagtgcggtcaacgccgtgttcgagatcatcgaggaggccctcgccaacggcgagaaggtgcagatcatcggctttggcacgtttgagacgcgttctcgcgccgcgcgctcgggccgcaacccgcagacgggcgaggtcatcgagatcccggcttccacggtgcctgcgttcaaaccgggcaacaagctcaaggaagtcacgcgctga

SEQ ID NO: 3230 - DNA, 273 bp, Artificial
  Alicyclobacillus acidocaldarius mutated SEQ ID NO 3215
gtgaataagatggaactcatcaaccgtgtcgcggaaaagaccaacttgaagaagaaggacgcggagagtgcggtcaacgccgtgttcgagatcatcgaggaggccctcgccaacggcgagaaggtgcagatcatcggctttggcacgtttgagacgcgttctcgcgccgcgcgctcgggccgcaacccgcagacgggcgaggtcatcgagatcccggcttccacggtgcctgcgttcaaaccgggcaacaagctcaaggaagtcacgaaatga

SEQ ID NO: 3231 - protein, 602 aa, Alicyclobacillus acidocaldarius
MMNVPETFIDTLRQKVDIVEVISEYVPLRKSGRSYVGLCPFHNERTPSFSVSPERQVYHCFGCGAGGTVFRFLMDIEGISFAETVTLLAERCGIPLPDSLHAPAPRSPRLERYRQAHDLAAKAFNHILMNTDAGVQALHYLLSRGISRTTMATFQLGYAPPSGRAMMSFLQQKGFSAEELIACGLAVDLGGELVDRFRGRVIIPIADRRGQVVAFGARALDDDAKPKYLNSPEYELFHKGRMLFNVHRARKAIRRERRALLLEGYMDVLAVAQAGIECAVATLGTSLTEEQAQLLKADCDKVVIAYDGDEAGRKATVRAIEVLEQAGVTPVVLRLPDGMDPDEYIRAHGARAFERMLSESTWTAVQFLIEDMRARAEWVSPAGRTEFLRQVLRLLAERASPVEQEYQLRNLSQEFNLSVETLKEEMRGFAKPLRRRSPPREEVTPWVNSPRAAKGKDQVSLRILQAALFSQEAAEYLMEKGVTELAHPLHTALLSHVYSWRLEQPGQPPSAFIDRLEDEELVRLASSLLFDEPPEITVELVEDYLRALELFRLEQELKEKVRAWNEAEAAGDQEKSREIKLQVEWIQSQMATMKQPRALHAE

SEQ ID NO: 3232 - DNA, 1809 bp, Alicyclobacillus acidocaldarius
gtgatgaacgttccagagacgttcatagacacgctgcgccagaaggtcgacatcgtcgaagtcatcagtgaatacgtgcccctgcgcaaatcagggcgctcgtatgtcgggctttgcccattccacaatgagcgcacgccctcgttctccgtatcacccgaacgccaagtgtatcattgtttcggatgcggggctggtggcaccgtattccggtttctcatggacatcgagggcatctcgtttgcagagacggtgacgctgctcgccgagcgctgcggaatccctctgcccgattcgctccacgcgcccgctccgcgctcgccgaggctcgagcggtatcggcaggcgcacgatctggctgcaaaagcgttcaaccacattctaatgaatacagatgctggagtgcaagcccttcactatcttctttcgcgcggaatttcacgcacgaccatggcgaccttccaattgggctacgcgcccccgtccggccgggccatgatgtcgtttcttcaacagaagggcttttcggccgaggagctcatcgcctgtgggcttgcggtcgatctcggcggcgaattggtggatcggttccgcggccgcgtgatcattcccatcgcggatcggcgaggacaggtcgtcgccttcggcgcgcgggcgctcgatgacgatgccaagcccaagtacctgaattcgcctgagtatgaactgtttcacaagggcaggatgctcttcaatgttcatcgcgctcgaaaagcgattcgccgggagcggagggcgctgttgctcgaaggctacatggatgtcctggcggttgcgcaggcgggcatcgagtgcgcggttgcgacgctcggcaccagtctgacggaagaacaggcccagttgttaaaggccgactgcgacaaggtcgtgatcgcgtacgacggcgatgaggccgggcgcaaggcgacggtccgcgccatcgaggtcctcgagcaggcgggcgtcacgcctgtggtgctgcggctgccggacggcatggatccggacgaatacatccgggcgcacggcgcgcgggcgttcgaacgcatgctgtccgaatcgacgtggaccgcggttcagttcttgatcgaggacatgcgcgctcgagcggaatgggtgagccccgccggccgaaccgagttcttgcgccaggtgctgcggttgctcgcggagcgagcgagcccggtggagcaggaatatcagttgcgaaatttgtcacaggaatttaacctctctgtcgaaacgttgaaggaggagatgcgcggtttcgcgaaaccattaaggcgtcgttctcctccgagagaagaggtcacgccgtgggtgaactcgccgcgcgccgccaagggaaaggatcaggtgagccttcgcatcctccaagctgcgttgttcagccaggaggcggcagagtacctgatggaaaagggtgtcaccgagctcgcccatccgctgcacacggcgcttttgtcgcacgtgtattcctggcggctcgagcagccgggacaaccgccatcggcgttcatcgatcgcctcgaggatgaggagttggttcgcctggcttcttcgctcctgtttgatgaacctcccgagatcacggtggagctcgtggaggattacctgagggcgctcgagctcttcaggttggaacaggagctgaaggaaaaggtgcgcgcgtggaacgaggccgaggcggctggcgaccaagagaagagtagagagatcaagctgcaagtggagtggattcagagccagatggcaaccatgaagcagccccgcgcgctccacgccgaatga

SEQ ID NO: 3233 - protein, 592 aa, Bacillus anthracis
IPEEVVEQIRTSSDIVEVIGEYVQLRKQGRNYFGLCPFHGENSPSFSVSSDKQIFHCFGCGEGGNVFSFLMKMEGLAFTEAVQKLGERNGIAVAEYTSGQGQQEDISDDTVIMQQAHELLKKYYHHLLVNTEEGNEALSYLLKRGITKEMIEKFEIGYASPAWDAATKILQKRGLSLSSMEQAGLLIRSEKDGSHYDRFRGRVMFPIYTLQGKVIAFSGRALGDDTPKYLNSPETPIFHKSKLLYNFHQARPFIRKRGQVVLFEGYADVLAAVKSGVEEAVATMGTALTEEQAKLLRRNVETVVLCYDGDKAGREATMKAGQLLLQVGCQVKVTSLPDKLDPDEYVQQYGTTAFENLVKSSISFVGFKINYLRLGKNLQDESGKEEYVKSVLKELSLLQDAMQAESYLKSLSQEFSYSMETLLNQLHQYRKEQKVQQKQVKQVSKPSQIVQTKPKLTGFERAEREIIYHMLQSPEVAVRMESHIEDFHTEEHKGILYELYAYYEKGNEPSVGTFLSWLSDEKLKNIITDISTDEFINPEYTEEVLQSHLETLRRHQEKLEKMEIIFKIKQMEKTDPVEAAKYYVAYLQNQKA

SEQ ID NO: 3234 - protein, 592 aa, Bacillus cereus
IPEEVVEQIRTSSDIVEVIGEYVQLRKQGRNYFGLCPFHGENSPSFSVSSDKQIFHCFGCGEGGNVFSFLMKMEGLAFTEAVQKLGERNGIAVAEYTSGQGQQEDISDDTVIMQQAHELLKKYYHHLLVNTEEGNEALSYLLKRGITKEMIEKFEIGYASPAWDAATKILQKRGLSLSSMEQAGLLIRSEKDGSHYDRFRGRVMFPIYTLQGKVIAFSGRALGDDTPKYLNSPETPIFHKSKLLYNFHQARPFIRKRGQVVLFEGYADVLAAVKSGVEEAVATMGTALTEEQAKLLRRNVETVVLCYDGDKAGREATMKAGQLLLQVGCQVKVTSLPDKLDPDEYVQQYGTTAFENLVKSSISFVGFKINYLRLGKNLQDESGKEEYVKSVLKELSLLQDAMQAESYLKSLSQEFSYSMETLLNQLHQYRKEQKVQQKQVKQVSKPSQIVQTKPKLTGFERAEREIIYHMLQSPEVAVRMESHIEDFHTEEHKGILYELYAYYEKGNEPSVGTFLSWLSDEKLKNIITDISTDEFINPEYTEEVLQGHLETLRRHQEKLEKMEIIFKIKQMEKTDPVEAAKYYVAYLQNQKA

SEQ ID NO: 3235 - protein, 592 aa, Bacillus cereus
IPEEVVEQIRTSSDIVEVIGEYVQLRKQGRNYFGLCPFHGENSPSFSVSSDKQIFHCFGCGEGGNVFSFLMKMEGLAFTEAVQKLGERNGIAVAEYTSGQGQQEDISDDTVIMQQAHELLKKYYHHLLVNTEEGNEALSYLLNRGITKEMIEKFEIGYASPAWDAATKILQKRGLSLSSMEQAGLLIRSEKDGSHYDRFRGRVMFPIYTLQGKVIAFSGRALGDDTPKYLNSPETPIFHKSKLLYNFHQARPFIRKRGQVVLFEGYADVLAAVKSGVEEAVATMGTALTEEQAKLLRRNVETVVLCYDGDKAGREATMKAGQLLLKVGCQVKVTSLPDKLDPDEYVQQYGTTAFENLVKSSVSFVGFKINYLRLGKNLQDESGKEEYVKSVLKELSLLQDAMQAESYLKSLSQEFSYSMETLLNQLHQYRKEQKVQQKQIKQVAKPSQVVQTKPKLTGFERAEREIIYHMLQSAEVAVRMESHIEDFHTEEHKGILYELYAYYEKGNEPSVGTFLSWLSDEKLKNIITDISTDEFINPEYTEEVLQGHLETLRRHQEKLEKMEIIFKVKQMEKTDPVEAAKYYVAYLQNQKA

SEQ ID NO: 3236 - protein, 592 aa, Bacillus cereus
IPEEVVEQIRTSSDIVEVIGEYVQLRKQGRNYFGLCPFHGENSPSFSVSSDKQIFHCFGCGEGGNVFSFLMKMEGLAFTEAVQKLGERNGIAVAEYTSGQGQQEDISDDTVIMQQAHELLKKYYHHLLVNTEEGNEALSYLLNRGITKEMIEKFEIGYASPAWDAATKILQKRGLSLSTMEQAGLLIRSEKDGSHYDRFRGRVMFPIYTLQGKVIAFSGRALGDDTPKYLNSPETPIFHKSKLLYNFHQARPFIRKRGQVVLFEGYADVLAAVKSGVEEAVATMGTALTEEQAKLLRRNVETVVLCYDGDKAGREATMKAGQLLLKVGCQVKVTSLPDKLDPDEYVQQYGTTAFENLVKSSVSFVGFKINYLRLGKNLQDESGKEEYVKSVLKELSLLQDAMQAESYLKSLSQEFSYSMETLLNQLHQYRKEQKVQQKQIKQVAKPSQVVQTKPKLTGFERAEREIIYHMLQSAEVAVRMESHIEDFHTEEHKGILYELYAYYEKGNEPSVGTFLSWLSDEKLKNIITDISTDEFINPEYTEEVLQGHLETLRRHQEKLEKMEIIFKVKQMEKTDPVEAAKYYVAYLQNQKA

SEQ ID NO: 3237 - protein, 592 aa, Bacillus cereus
IPEEVVEQIRTSSDIVEVIGEYVQLRKQGRNYFGLCPFHGENSPSFSVSSDKQIFHCFGCGEGGNVFSFLMKMEGLAFTEAVQKLGERNGIAVAEYTSGQGQQEDISDDTVIMQQAHELLKKYYHHLLVNTEEGNEALSYLLKRGITKEMIEKFEIGYASPAWDAATKILQKRGLSLSSMEQAGLLIRSEKDGSHYDRFRGRVMFPIYTLQGKVIAFSGRALGDDTPKYLNSPETPIFHKSKLLYNFHQARPFIRKRGQVVLFEGYADVLAAVKSGVEEAVATMGTALTEEQAKLLRRNVETVVLCYDGDKAGREATMKAGQLLLQVGCQVKVTSLPNKLDPDEYVQQYGTTAFENLVKSSISFVGFKINYLRLGKNLQDESGKEEYVKSVLKELSLLQDAMQAESYLKSLSQEFSYSMETLLNQLHQYRKEQKVQQKQVKQVSKPSQIVQTKPKLTGFERAEREIIYHMLQSPEVAVRMESHIEDFHTEEHKGILYELYAYYEKGNEPSVGTFLSWLSDEKLKNIITDISTDEFINPEYTEEVLQGHLETLRRHQEKLEKMEIIFKIKQMEKTDPVEAAKYYVAYLQNQKA

SEQ ID NO: 3238 - protein, 602 aa, Artificial
  Alicyclobacillus acidocaldarius mutated SEQ ID NO 3231
MMNVPETFIDTLRQKVDIVEVISEYVPLRKSGRSYVGLCPFHNERTPSFSVSPERQVYHCFGCGAGGTVFRFLMDIEGISFAETVTLLAERCGIPLPDSLHAPAPRSPRLERYRQAHDLAAKAFNHILMNTDAGVQALHYLLSRGISRTTMATFQLGYAPPSGRAMMSFLQQKGFSAEELIACGLAVDLGGELVDRFRGRVIIPIADRRGQVVAFGARALDDDAKPKYLNSPEYELFHKGRMLFNVHRARKAIRREKRALLLEGYMDVLAVAQAGIECAVATLGTSLTEEQAQLLKADCDKVVIAYDGDEAGRKATVRAIEVLEQAGVTPVVLRLPDGMDPDEYIRAHGARAFERMLSESTWTAVQFLIEDMRARAEWVSPAGRTEFLRQVLRLLAERASPVEQEYQLRNLSQEFNLSVETLKEEMRGFAKPLRRRSPPREEVTPWVNSPRAAKGKDQVSLRILQAALFSQEAAEYLMEKGVTELAHPLHTALLSHVYSWRLEQPGQPPSAFIDRLEDEELVRLASSLLFDEPPEITVELVEDYLRALELFRLEQELKEKVRAWNEAEAAGDQEKSREIKLQVEWIQSQMATMKQPRALHAE

SEQ ID NO: 3239 - protein, 602 aa, Artificial
  Alicyclobacillus acidocaldarius mutated SEQ ID NO 3231
MMNVPETFIDTLRQKVDIVEVISEYVPLRKSGRSYVGLCPFHNERTPSFSVSPERQVYHCFGCGAGGTVFRFLMDIEGISFAETVTLLAERCGIPLPDSLHAPAPRSPRLERYRQAHDLAAKAFNHILMNTDAGVQALHYLLSRGISRTTMATFQLGYAPPSGRAMMSFLQQKGFSAEELIACGLAVDLGGELVDRFRGRVIIPIADRRGQVVAFGARALDDDAKPKYLNSPEYELFHKGRMLFNVHRARKAIRRERRALLLEGYMDVLAVAQAGIECAVATLGTSLTEEQAQLLKADCDKVVIAYDGDEAGRKATVRAIEVLDQAGVTPVVLRLPDGMDPDEYIRAHGARAFERMLSESTWTAVQFLIEDMRARAEWVSPAGRTEFLRQVLRLLAERASPVEQEYQLRNLSQEFNLSVETLKEEMRGFAKPLRRRSPPREEVTPWVNSPRAAKGKDQVSLRILQAALFSQEAAEYLMEKGVTELAHPLHTALLSHVYSWRLEQPGQPPSAFIDRLEDEELVRLASSLLFDEPPEITVELVEDYLRALELFRLEQELKEKVRAWNEAEAAGDQEKSREIKLQVEWIQSQMATMKQPRALHAE

SEQ ID NO: 3240 - protein, 602 aa, Artificial
  Alicyclobacillus acidocaldarius mutated SEQ ID NO 3231
MMNVPETFIDTLRQKVDIVEVISEYVPLRKSGRSYVGLCPFHNERTPSFSVSPERQVYHCFGCGAGGTVFRFLMDIEGISFAETVTLLAERCGIPLPDSIHAPAPRSPRLERYRQAHDLAAKAFNHILMNTDAGVQALHYLLSRGISRTTMATFQLGYAPPSGRAMMSFLQQKGFSAEELIACGLAVDLGGELVDRFRGRVIIPIADRRGQVVAFGARALDDDAKPKYLNSPEYELFHKGRMLFNVHRARKAIRRERRALLLEGYMDVLAVAQAGIECAVATLGTSLTEEQAQLLKADCDKVVIAYDGDEAGRKATVRAIEVLEQAGVTPVVLRLPDGMDPDEYIRAHGARAFERMLSESTWTAVQFLIEDMRARAEWVSPAGRTEFLRQVLRLLAERASPVEQEYQLRNLSQEFNLSVETLKEEMRGFAKPLRRRSPPREEVTPWVNSPRAAKGKDQVSLRILQAALFSQEAAEYLMEKGVTELAHPLHTALLSHVYSWRLEQPGQPPSAFIDRLEDEELVRLASSLLFDEPPEITVELVEDYLRALELFRLEQELKEKVRAWNEAEAAGDQEKSREIKLQVEWIQSQMATMKQPRALHAE

SEQ ID NO: 3241 - protein, 602 aa, Artificial
  Alicyclobacillus acidocaldarius mutated SEQ ID NO 3231
MMNVPETFIDTLRQKVDIVEVISEYVPLRKSGRSYVGLCPFHNERTPSFSVSPERQVYHCFGCGAGGTVFRFLMDIEGISFAETVTLLAERCGIPLPDSLHAPAPRSPRLERYRQAHDLAAKAFNHILMNTDAGVQALHYLLSRGISRTTMATFQLGYAPPSGRAMMSFLQQKGFSAEELIACGLAVDLGGELVDRFRGRVIIPIADRRGQVVAFGARALDDDAKPKYLNSPEYELFHKGRMLFNVHRARKAIRRERRALLLEGYMDVLAVAQAGIECAVATLGTSLTEEQAQLLKADCDKVVIAYDGDEAGRKATVRAIEVLEQAGVTPVVLRLPDGMDPDEYIRAHGARAFERMLSESTWTAVQFLIEDMRARAEWVSPAGRTEFLRQVLRLLAERASPVEQEYQLRNLSQEFNLSVETLKEEMRGFAKPLRRRSPPREEVTPWVNSPRAAKGKDQVSLRILQAALFSQEAAEYLMEKGVTELAHPLHTALLSHVYSWRLENPGQPPSAFIDRLEDEELVRLASSLLFDEPPEITVELVEDYLRALELFRLEQELKEKVRAWNEAEAAGDQEKSREIKLQVEWIQSQMATMKQPRALHAE

SEQ ID NO: 3242 - protein, 602 aa, Artificial
  Alicyclobacillus acidocaldarius mutated SEQ ID NO 3231
MMNVPETFIDTLRQKVDIVEVISEYVPLRKSGRSYVGLCPFHNERTPSFSVSPERQVYHCFGCGAGGTVFRFLMDIEGISFAETVTLLAERCGIPLPDSLHAPAPRSPRLERYRQAHDLAAKAFNHILMNTDAGVQALHYLLSRGISRTTMATFQLGYAPPSGRAMMSFLQQKGFSAEELIACGLAVDLGGELVDRFRGRVIIPIADRRGQVVAFGARALDDDAKPKYLNSPEYELFHKGRMLFNVHRARKAIRRERRALLLEGYMDVLAVAQAGIECAVATLGTSLTEEQAQLLKADCDKVVIAYDGDEAGRKATVRAIEVLEQAGVTPVVLRLPDGMDPDEYIRAHGARAFERMLSESTWTAVQFLIEDMRAKAEWVSPAGRTEFLRQVLRLLAERASPVEQEYQLRNLSQEFNLSVETLKEEMRGFAKPLRRRSPPREEVTPWVNSPRAAKGKDQVSLRILQAALFSQEAAEYLMEKGVTELAHPLHTALLSHVYSWRLEQPGQPPSAFIDRLEDEELVRLASSLLFDEPPEITVELVEDYLRALELFRLEQELKEKVRAWNEAEAAGDQEKSREIKLQVEWIQSQMATMKQPRALHAE

SEQ ID NO: 3243 - DNA, 1809 bp, Artificial
  Alicyclobacillus acidocaldarius mutated SEQ ID NO 3232
gtgatgaacgttccagagacgttcatagacacgctgcgccagaaggtcgacatcgtcgaagtcatcagtgaatacgtgcccctgcgcaaatcagggcgctcgtatgtcgggctttgcccattccacaatgagcgcacgccctcgttctccgtatcacccgaacgccaagtgtatcattgtttcggatgcggggctggtggcaccgtattccggtttctcatggacatcgagggcatctcgtttgcagagacggtgacgctgctcgccgagcgctgcggaatccctctgcccgattcgctccacgcgcccgctccgcgctcgccgaggctcgagcggtatcggcaggcgcacgatctggctgcaaaagcgttcaaccacattctaatgaatacagatgctggagtgcaagcccttcactatcttctttcgcgcggaatttcacgcacgaccatggcgaccttccaattgggctacgcgcccccgtccggccgggccatgatgtcgtttcttcaacagaagggcttttcggccgaggagctcatcgcctgtgggcttgcggtcgatctcggcggcgaattggtggatcggttccgcggccgcgtgatcattcccatcgcggatcggcgaggacaggtcgtcgccttcggcgcgcgggcgctcgatgacgatgccaagcccaagtacctgaattcgcctgagtatgaactgtttcacaagggcaggatgctcttcaatgttcatcgcgctcgaaaagcgattcgccgggagaaaagggcgctgttgctcgaaggctacatggatgtcctggcggttgcgcaggcgggcatcgagtgcgcggttgcgacgctcggcaccagtctgacggaagaacaggcccagttgttaaaggccgactgcgacaaggtcgtgatcgcgtacgacggcgatgaggccgggcgcaaggcgacggtccgcgccatcgaggtcctcgagcaggcgggcgtcacgcctgtggtgctgcggctgccggacggcatggatccggacgaatacatccgggcgcacggcgcgcgggcgttcgaacgcatgctgtccgaatcgacgtggaccgcggttcagttcttgatcgaggacatgcgcgctcgagcggaatgggtgagccccgccggccgaaccgagttcttgcgccaggtgctgcggttgctcgcggagcgagcgagcccggtggagcaggaatatcagttgcgaaatttgtcacaggaatttaacctctctgtcgaaacgttgaaggaggagatgcgcggtttcgcgaaaccattaaggcgtcgttctcctccgagagaagaggtcacgccgtgggtgaactcgccgcgcgccgccaagggaaaggatcaggtgagccttcgcatcctccaagctgcgttgttcagccaggaggcggcagagtacctgatggaaaagggtgtcaccgagctcgcccatccgctgcacacggcgcttttgtcgcacgtgtattcctggcggctcgagcagccgggacaaccgccatcggcgttcatcgatcgcctcgaggatgaggagttggttcgcctggcttcttcgctcctgtttgatgaacctcccgagatcacggtggagctcgtggaggattacctgagggcgctcgagctcttcaggttggaacaggagctgaaggaaaaggtgcgcgcgtggaacgaggccgaggcggctggcgaccaagagaagagtagagagatcaagctgcaagtggagtggattcagagccagatggcaaccatgaagcagccccgcgcgctccacgccgaatga

SEQ ID NO: 3244 - DNA, 1809 bp, Artificial
  Alicyclobacillus acidocaldarius mutated SEQ ID NO 3232
gtgatgaacgttccagagacgttcatagacacgctgcgccagaaggtcgacatcgtcgaagtcatcagtgaatacgtgcccctgcgcaaatcagggcgctcgtatgtcgggctttgcccattccacaatgagcgcacgccctcgttctccgtatcacccgaacgccaagtgtatcattgtttcggatgcggggctggtggcaccgtattccggtttctcatggacatcgagggcatctcgtttgcagagacggtgacgctgctcgccgagcgctgcggaatccctctgcccgattcgctccacgcgcccgctccgcgctcgccgaggctcgagcggtatcggcaggcgcacgatctggctgcaaaagcgttcaaccacattctaatgaatacagatgctggagtgcaagcccttcactatcttctttcgcgcggaatttcacgcacgaccatggcgaccttccaattgggctacgcgcccccgtccggccgggccatgatgtcgtttcttcaacagaagggcttttcggccgaggagctcatcgcctgtgggcttgcggtcgatctcggcggcgaattggtggatcggttccgcggccgcgtgatcattcccatcgcggatcggcgaggacaggtcgtcgccttcggcgcgcgggcgctcgatgacgatgccaagcccaagtacctgaattcgcctgagtatgaactgtttcacaagggcaggatgctcttcaatgttcatcgcgctcgaaaagcgattcgccgggagcggagggcgctgttgctcgaaggctacatggatgtcctggcggttgcgcaggcgggcatcgagtgcgcggttgcgacgctcggcaccagtctgacggaagaacaggcccagttgttaaaggccgactgcgacaaggtcgtgatcgcgtacgacggcgatgaggccgggcgcaaggcgacggtccgcgccatcgaggtcctcgatcaggcgggcgtcacgcctgtggtgctgcggctgccggacggcatggatccggacgaatacatccgggcgcacggcgcgcgggcgttcgaacgcatgctgtccgaatcgacgtggaccgcggttcagttcttgatcgaggacatgcgcgctcgagcggaatgggtgagccccgccggccgaaccgagttcttgcgccaggtgctgcggttgctcgcggagcgagcgagcccggtggagcaggaatatcagttgcgaaatttgtcacaggaatttaacctctctgtcgaaacgttgaaggaggagatgcgcggtttcgcgaaaccattaaggcgtcgttctcctccgagagaagaggtcacgccgtgggtgaactcgccgcgcgccgccaagggaaaggatcaggtgagccttcgcatcctccaagctgcgttgttcagccaggaggcggcagagtacctgatggaaaagggtgtcaccgagctcgcccatccgctgcacacggcgcttttgtcgcacgtgtattcctggcggctcgagcagccgggacaaccgccatcggcgttcatcgatcgcctcgaggatgaggagttggttcgcctggcttcttcgctcctgtttgatgaacctcccgagatcacggtggagctcgtggaggattacctgagggcgctcgagctcttcaggttggaacaggagctgaaggaaaaggtgcgcgcgtggaacgaggccgaggcggctggcgaccaagagaagagtagagagatcaagctgcaagtggagtggattcagagccagatggcaaccatgaagcagccccgcgcgctccacgccgaatga

SEQ ID NO: 3245 - DNA, 1809 bp, Artificial
  Alicyclobacillus acidocaldarius mutated SEQ ID NO 3232
gtgatgaacgttccagagacgttcatagacacgctgcgccagaaggtcgacatcgtcgaagtcatcagtgaatacgtgcccctgcgcaaatcagggcgctcgtatgtcgggctttgcccattccacaatgagcgcacgccctcgttctccgtatcacccgaacgccaagtgtatcattgtttcggatgcggggctggtggcaccgtattccggtttctcatggacatcgagggcatctcgtttgcagagacggtgacgctgctcgccgagcgctgcggaatccctctgcccgattcgattcacgcgcccgctccgcgctcgccgaggctcgagcggtatcggcaggcgcacgatctggctgcaaaagcgttcaaccacattctaatgaatacagatgctggagtgcaagcccttcactatcttctttcgcgcggaatttcacgcacgaccatggcgaccttccaattgggctacgcgcccccgtccggccgggccatgatgtcgtttcttcaacagaagggcttttcggccgaggagctcatcgcctgtgggcttgcggtcgatctcggcggcgaattggtggatcggttccgcggccgcgtgatcattcccatcgcggatcggcgaggacaggtcgtcgccttcggcgcgcgggcgctcgatgacgatgccaagcccaagtacctgaattcgcctgagtatgaactgtttcacaagggcaggatgctcttcaatgttcatcgcgctcgaaaagcgattcgccgggagcggagggcgctgttgctcgaaggctacatggatgtcctggcggttgcgcaggcgggcatcgagtgcgcggttgcgacgctcggcaccagtctgacggaagaacaggcccagttgttaaaggccgactgcgacaaggtcgtgatcgcgtacgacggcgatgaggccgggcgcaaggcgacggtccgcgccatcgaggtcctcgagcaggcgggcgtcacgcctgtggtgctgcggctgccggacggcatggatccggacgaatacatccgggcgcacggcgcgcgggcgttcgaacgcatgctgtccgaatcgacgtggaccgcggttcagttcttgatcgaggacatgcgcgctcgagcggaatgggtgagccccgccggccgaaccgagttcttgcgccaggtgctgcggttgctcgcggagcgagcgagcccggtggagcaggaatatcagttgcgaaatttgtcacaggaatttaacctctctgtcgaaacgttgaaggaggagatgcgcggtttcgcgaaaccattaaggcgtcgttctcctccgagagaagaggtcacgccgtgggtgaactcgccgcgcgccgccaagggaaaggatcaggtgagccttcgcatcctccaagctgcgttgttcagccaggaggcggcagagtacctgatggaaaagggtgtcaccgagctcgcccatccgctgcacacggcgcttttgtcgcacgtgtattcctggcggctcgagcagccgggacaaccgccatcggcgttcatcgatcgcctcgaggatgaggagttggttcgcctggcttcttcgctcctgtttgatgaacctcccgagatcacggtggagctcgtggaggattacctgagggcgctcgagctcttcaggttggaacaggagctgaaggaaaaggtgcgcgcgtggaacgaggccgaggcggctggcgaccaagagaagagtagagagatcaagctgcaagtggagtggattcagagccagatggcaaccatgaagcagccccgcgcgctccacgccgaatga

SEQ ID NO: 3246 - DNA, 1809 bp, Artificial
  Alicyclobacillus acidocaldarius mutated SEQ ID NO 3232
gtgatgaacgttccagagacgttcatagacacgctgcgccagaaggtcgacatcgtcgaagtcatcagtgaatacgtgcccctgcgcaaatcagggcgctcgtatgtcgggctttgcccattccacaatgagcgcacgccctcgttctccgtatcacccgaacgccaagtgtatcattgtttcggatgcggggctggtggcaccgtattccggtttctcatggacatcgagggcatctcgtttgcagagacggtgacgctgctcgccgagcgctgcggaatccctctgcccgattcgctccacgcgcccgctccgcgctcgccgaggctcgagcggtatcggcaggcgcacgatctggctgcaaaagcgttcaaccacattctaatgaatacagatgctggagtgcaagcccttcactatcttctttcgcgcggaatttcacgcacgaccatggcgaccttccaattgggctacgcgcccccgtccggccgggccatgatgtcgtttcttcaacagaagggcttttcggccgaggagctcatcgcctgtgggcttgcggtcgatctcggcggcgaattggtggatcggttccgcggccgcgtgatcattcccatcgcggatcggcgaggacaggtcgtcgccttcggcgcgcgggcgctcgatgacgatgccaagcccaagtacctgaattcgcctgagtatgaactgtttcacaagggcaggatgctcttcaatgttcatcgcgctcgaaaagcgattcgccgggagcggagggcgctgttgctcgaaggctacatggatgtcctggcggttgcgcaggcgggcatcgagtgcgcggttgcgacgctcggcaccagtctgacggaagaacaggcccagttgttaaaggccgactgcgacaaggtcgtgatcgcgtacgacggcgatgaggccgggcgcaaggcgacggtccgcgccatcgaggtcctcgagcaggcgggcgtcacgcctgtggtgctgcggctgccggacggcatggatccggacgaatacatccgggcgcacggcgcgcgggcgttcgaacgcatgctgtccgaatcgacgtggaccgcggttcagttcttgatcgaggacatgcgcgctcgagcggaatgggtgagccccgccggccgaaccgagttcttgcgccaggtgctgcggttgctcgcggagcgagcgagcccggtggagcaggaatatcagttgcgaaatttgtcacaggaatttaacctctctgtcgaaacgttgaaggaggagatgcgcggtttcgcgaaaccattaaggcgtcgttctcctccgagagaagaggtcacgccgtgggtgaactcgccgcgcgccgccaagggaaaggatcaggtgagccttcgcatcctccaagctgcgttgttcagccaggaggcggcagagtacctgatggaaaagggtgtcaccgagctcgcccatccgctgcacacggcgcttttgtcgcacgtgtattcctggcggctcgagaatccgggacaaccgccatcggcgttcatcgatcgcctcgaggatgaggagttggttcgcctggcttcttcgctcctgtttgatgaacctcccgagatcacggtggagctcgtggaggattacctgagggcgctcgagctcttcaggttggaacaggagctgaaggaaaaggtgcgcgcgtggaacgaggccgaggcggctggcgaccaagagaagagtagagagatcaagctgcaagtggagtggattcagagccagatggcaaccatgaagcagccccgcgcgctccacgccgaatga

SEQ ID NO: 3247 - DNA, 1809 bp, Artificial
  Alicyclobacillus acidocaldarius mutated SEQ ID NO 3232
gtgatgaacgttccagagacgttcatagacacgctgcgccagaaggtcgacatcgtcgaagtcatcagtgaatacgtgcccctgcgcaaatcagggcgctcgtatgtcgggctttgcccattccacaatgagcgcacgccctcgttctccgtatcacccgaacgccaagtgtatcattgtttcggatgcggggctggtggcaccgtattccggtttctcatggacatcgagggcatctcgtttgcagagacggtgacgctgctcgccgagcgctgcggaatccctctgcccgattcgctccacgcgcccgctccgcgctcgccgaggctcgagcggtatcggcaggcgcacgatctggctgcaaaagcgttcaaccacattctaatgaatacagatgctggagtgcaagcccttcactatcttctttcgcgcggaatttcacgcacgaccatggcgaccttccaattgggctacgcgcccccgtccggccgggccatgatgtcgtttcttcaacagaagggcttttcggccgaggagctcatcgcctgtgggcttgcggtcgatctcggcggcgaattggtggatcggttccgcggccgcgtgatcattcccatcgcggatcggcgaggacaggtcgtcgccttcggcgcgcgggcgctcgatgacgatgccaagcccaagtacctgaattcgcctgagtatgaactgtttcacaagggcaggatgctcttcaatgttcatcgcgctcgaaaagcgattcgccgggagcggagggcgctgttgctcgaaggctacatggatgtcctggcggttgcgcaggcgggcatcgagtgcgcggttgcgacgctcggcaccagtctgacggaagaacaggcccagttgttaaaggccgactgcgacaaggtcgtgatcgcgtacgacggcgatgaggccgggcgcaaggcgacggtccgcgccatcgaggtcctcgagcaggcgggcgtcacgcctgtggtgctgcggctgccggacggcatggatccggacgaatacatccgggcgcacggcgcgcgggcgttcgaacgcatgctgtccgaatcgacgtggaccgcggttcagttcttgatcgaggacatgcgcgctaaagcggaatgggtgagccccgccggccgaaccgagttcttgcgccaggtgctgcggttgctcgcggagcgagcgagcccggtggagcaggaatatcagttgcgaaatttgtcacaggaatttaacctctctgtcgaaacgttgaaggaggagatgcgcggtttcgcgaaaccattaaggcgtcgttctcctccgagagaagaggtcacgccgtgggtgaactcgccgcgcgccgccaagggaaaggatcaggtgagccttcgcatcctccaagctgcgttgttcagccaggaggcggcagagtacctgatggaaaagggtgtcaccgagctcgcccatccgctgcacacggcgcttttgtcgcacgtgtattcctggcggctcgagcagccgggacaaccgccatcggcgttcatcgatcgcctcgaggatgaggagttggttcgcctggcttcttcgctcctgtttgatgaacctcccgagatcacggtggagctcgtggaggattacctgagggcgctcgagctcttcaggttggaacaggagctgaaggaaaaggtgcgcgcgtggaacgaggccgaggcggctggcgaccaagagaagagtagagagatcaagctgcaagtggagtggattcagagccagatggcaaccatgaagcagccccgcgcgctccacgccgaatga

SEQ ID NO: 3248 - protein, 76 aa, Alicyclobacillus acidocaldarius
MEEVMTLFSQRLTELLDRTGTTRRSFAQALGVSERMVQYYITGKKDPTVETLIAIADFFDVSLDYLVGRSENPERK

SEQ ID NO: 3249 - DNA, 231 bp, Alicyclobacillus acidocaldarius
ttggaggaggttatgactcttttttctcagcgactgaccgaattactcgaccgaacgggaaccacgcgtcggtcgtttgcacaggcactcggagtctctgaacgcatggtgcagtactacataaccggaaagaaagatccgacagttgaaactctaattgccattgctgatttctttgatgtgagtttggactatcttgttggtcgctcagagaatccagaacgaaaatga

SEQ ID NO: 3250 - protein, 69 aa, Anaerotruncus colihominis; identical to SEQ ID NO: 2672

SEQ ID NO: 3251 - protein, 69 aa, Pelotomaculum thermopropionicum; identical to SEQ ID NO: 2673

SEQ ID NO: 3252 - protein, 67 aa, Caldicellulosiruptor saccharolyticus; identical to SEQ ID NO: 2674

SEQ ID NO: 3253 - protein, 69 aa, Thermoanaerobacter  X514
EKLNPFSQRLRQLREEKGLLQKDVAKILGITPSAYGYYEQGKREPSMEVLKKLSDFFNVSIDYLLGRTD

SEQ ID NO: 3254 - protein, 71 aa, Desulfotomaculum reducens
VMSTIGERLRQLRKEKNINREDVANLLGVTVRSVTNYESGQRNLDPDQLIALADYYDVSMDYLTGRSDNPK

SEQ ID NO: 3255 - protein, 76 aa, Artificial
  Alicyclobacillus acidocaldarius mutated SEQ ID NO 3248
MEEVMTLFSQRLTELLDRTGTTRRSFAQALGVSEKMVQYYITGKKDPTVETLIAIADFFDVSLDYLVGRSENPERK

SEQ ID NO: 3256 - protein, 76 aa, Artificial
  Alicyclobacillus acidocaldarius mutated SEQ ID NO 3248
MEEVMTLFSQRLTELLDRTGTTRRSFAQALGVSERMVQYYITGKKDPTVETLIAIADFFDVSLDYLVGRSENPERR

SEQ ID NO: 3257 - protein, 76 aa, Artificial
  Alicyclobacillus acidocaldarius mutated SEQ ID NO 3248
MEDVMTLFSQRLTELLDRTGTTRRSFAQALGVSERMVQYYITGKKDPTVETLIAIADFFDVSLDYLVGRSENPERK

SEQ ID NO: 3258 - protein, 76 aa, Artificial
  Alicyclobacillus acidocaldarius mutated SEQ ID NO 3248
MEEVMTLFSQRLTELIDRTGTTRRSFAQALGVSERMVQYYITGKKDPTVETLIAIADFFDVSLDYLVGRSENPERK

SEQ ID NO: 3259 - protein, 76 aa, Artificial
  Alicyclobacillus acidocaldarius mutated SEQ ID NO 3248
MEEVMTLFSQRLTELLDRTGTTRRSFAQALGVSERMVQYYITGKKDPTVETLIAIADFFDVSLDYLVGRSEQPERK

SEQ ID NO: 3260 - DNA, 231 bp, Artificial
  Alicyclobacillus acidocaldarius mutated SEQ ID NO 3249
ttggaggaggttatgactcttttttctcagcgactgaccgaattactcgaccgaacgggaaccacgcgtcggtcgtttgcacaggcactcggagtctctgaaaaaatggtgcagtactacataaccggaaagaaagatccgacagttgaaactctaattgccattgctgatttctttgatgtgagtttggactatcttgttggtcgctcagagaatccagaacgaaaatga

SEQ ID NO: 3261 - DNA, 231 bp, Artificial
  Alicyclobacillus acidocaldarius mutated SEQ ID NO 3249
ttggaggaggttatgactcttttttctcagcgactgaccgaattactcgaccgaacgggaaccacgcgtcggtcgtttgcacaggcactcggagtctctgaacgcatggtgcagtactacataaccggaaagaaagatccgacagttgaaactctaattgccattgctgatttctttgatgtgagtttggactatcttgttggtcgctcagagaatccagaacgacgttga

SEQ ID NO: 3262 - DNA, 231 bp, Artificial
  Alicyclobacillus acidocaldarius mutated SEQ ID NO 3249
ttggaggatgttatgactcttttttctcagcgactgaccgaattactcgaccgaacgggaaccacgcgtcggtcgtttgcacaggcactcggagtctctgaacgcatggtgcagtactacataaccggaaagaaagatccgacagttgaaactctaattgccattgctgatttctttgatgtgagtttggactatcttgttggtcgctcagagaatccagaacgaaaatga

SEQ ID NO: 3263 - DNA, 231 bp, Artificial
  Alicyclobacillus acidocaldarius mutated SEQ ID NO 3249
ttggaggaggttatgactcttttttctcagcgactgaccgaattaattgaccgaacgggaaccacgcgtcggtcgtttgcacaggcactcggagtctctgaacgcatggtgcagtactacataaccggaaagaaagatccgacagttgaaactctaattgccattgctgatttctttgatgtgagtttggactatcttgttggtcgctcagagaatccagaacgaaaatga

SEQ ID NO: 3264 - DNA, 231 bp, Artificial
  Alicyclobacillus acidocaldarius mutated SEQ ID NO 3249
ttggaggaggttatgactcttttttctcagcgactgaccgaattactcgaccgaacgggaaccacgcgtcggtcgtttgcacaggcactcggagtctctgaacgcatggtgcagtactacataaccggaaagaaagatccgacagttgaaactctaattgccattgctgatttctttgatgtgagtttggactatcttgttggtcgctcagagcaaccagaacgaaaatga

SEQ ID NO: 3265 - protein, 81 aa, Alicyclobacillus acidocaldarius
MNGERLRALRKSLGLKRDEVAQAIGVTPRIITDYETETKRPTLDTAVKLADFFNVSLDYLVGRTDDPTPPKRSSPSNEPGS

SEQ ID NO: 3266 - DNA, 246 bp, Alicyclobacillus acidocaldarius
ttgaatggcgaacgtctcagagcattacgaaagtcactcggacttaaacgcgatgaagtagcgcaagccattggcgtaaccccacgaatcattactgactatgaaactgaaaccaaacgaccaacgcttgacacagcggttaagctcgccgacttcttcaacgtcagcctggactacctcgtcggccgcaccgacgacccaacgccgccgaagcgcagctcgccgtcgaatgagccgggttcgtag

SEQ ID NO: 3267 - protein, 76 aa, Desulfotomaculum reducens
GERLRQLRKEKNINREDVANLLGVTVRSVTNYESGQRNLDPDQLIALADYYDVSMDYLTGRSDNPKPPQTTTIDDE

SEQ ID NO: 3268 - protein, 75 aa, Bacillus halodurans
ERLRYLRKKHGLTMKELGKKINVAESTISGYENGNRKPDMDTLVKMAEYFNSSTDYLLGRTEEPAPYQKQPPEKQ

SEQ ID NO: 3269 - protein, 76 aa, Geobacillus kaustophilus
GDRLRKLRQEKKLTQEELGKKINVTKVSISGYENGNRTPDTETLQKLADFFNVTTDYLLGRTDHPNPPDQDDIPEE

SEQ ID NO: 3270 - protein, 74 aa, Geobacillus kaustophilus
RLKMLRLQKKLTHQDMADFLGITRQGYSKYENGQSQPDIDTINKLAEFFNVTTDYLLGRTDDPTPPEQDDIPEE

SEQ ID NO: 3271 - protein, 66 aa, Thermoanaerobacter  X514
QRLRQLREEKGLLQKDVAKILGITPSAYGYYEQGKREPSMEVLKKLSDFFNVSIDYLLGRTDIRSP

SEQ ID NO: 3272 - protein, 81 aa, Artificial
  Alicyclobacillus acidocaldarius mutated SEQ ID NO 3265
MNGERLRALRKSLGLKRDEVAQAIGVTPRLITDYETETKRPTLDTAVKLADFFNVSLDYLVGRTDDPTPPKRSSPSNEPGS

SEQ ID NO: 3273 - protein, 81 aa, Artificial
  Alicyclobacillus acidocaldarius mutated SEQ ID NO 3265
MNGERLRALRKSLGLKRDEVAQAIGVTPRIITDYETETRRPTLDTAVKLADFFNVSLDYLVGRTDDPTPPKRSSPSNEPGS

SEQ ID NO: 3274 - protein, 81 aa, Artificial
  Alicyclobacillus acidocaldarius mutated SEQ ID NO 3265
MNGERLRALRKSLGLKKDEVAQAIGVTPRIITDYETETKRPTLDTAVKLADFFNVSLDYLVGRTDDPTPPKRSSPSNEPGS

SEQ ID NO: 3275 - protein, 81 aa, Artificial
  Alicyclobacillus acidocaldarius mutated SEQ ID NO 3265
MNGDRLRALRKSLGLKRDEVAQAIGVTPRIITDYETETKRPTLDTAVKLADFFNVSLDYLVGRTDDPTPPKRSSPSNEPGS

SEQ ID NO: 3276 - protein, 81 aa, Artificial
  Alicyclobacillus acidocaldarius mutated SEQ ID NO 3265
MNGERLRALRKSLGLKRDEVAQAIGVTPRILTDYETETKRPTLDTAVKLADFFNVSLDYLVGRTDDPTPPKRSSPSNEPGS

SEQ ID NO: 3277 - DNA, 246 bp, Artificial
  Alicyclobacillus acidocaldarius mutated SEQ ID NO 3266
ttgaatggcgaacgtctcagagcattacgaaagtcactcggacttaaacgcgatgaagtagcgcaagccattggcgtaaccccacgattaattactgactatgaaactgaaaccaaacgaccaacgcttgacacagcggttaagctcgccgacttcttcaacgtcagcctggactacctcgtcggccgcaccgacgacccaacgccgccgaagcgcagctcgccgtcgaatgagccgggttcgtag

SEQ ID NO: 3278 - DNA, 246 bp, Artificial
  Alicyclobacillus acidocaldarius mutated SEQ ID NO 3266
ttgaatggcgaacgtctcagagcattacgaaagtcactcggacttaaacgcgatgaagtagcgcaagccattggcgtaaccccacgaatcattactgactatgaaactgaaacccgtcgaccaacgcttgacacagcggttaagctcgccgacttcttcaacgtcagcctggactacctcgtcggccgcaccgacgacccaacgccgccgaagcgcagctcgccgtcgaatgagccgggttcgtag

SEQ ID NO: 3279 - DNA, 246 bp, Artificial
  Alicyclobacillus acidocaldarius mutated SEQ ID NO 3266
ttgaatggcgaacgtctcagagcattacgaaagtcactcggacttaaaaaagatgaagtagcgcaagccattggcgtaaccccacgaatcattactgactatgaaactgaaaccaaacgaccaacgcttgacacagcggttaagctcgccgacttcttcaacgtcagcctggactacctcgtcggccgcaccgacgacccaacgccgccgaagcgcagctcgccgtcgaatgagccgggttcgtag

SEQ ID NO: 3280 - DNA, 246 bp, Artificial
  Alicyclobacillus acidocaldarius mutated SEQ ID NO 3266
ttgaatggcgatcgtctcagagcattacgaaagtcactcggacttaaacgcgatgaagtagcgcaagccattggcgtaaccccacgaatcattactgactatgaaactgaaaccaaacgaccaacgcttgacacagcggttaagctcgccgacttcttcaacgtcagcctggactacctcgtcggccgcaccgacgacccaacgccgccgaagcgcagctcgccgtcgaatgagccgggttcgtag

SEQ ID NO: 3281 - DNA, 246 bp, Artificial
  Alicyclobacillus acidocaldarius mutated SEQ ID NO 3266
ttgaatggcgaacgtctcagagcattacgaaagtcactcggacttaaacgcgatgaagtagcgcaagccattggcgtaaccccacgaatcttaactgactatgaaactgaaaccaaacgaccaacgcttgacacagcggttaagctcgccgacttcttcaacgtcagcctggactacctcgtcggccgcaccgacgacccaacgccgccgaagcgcagctcgccgtcgaatgagccgggttcgtag

SEQ ID NO: 3282 - protein, 514 aa, Alicyclobacillus acidocaldarius; identical to SEQ ID NO: 1514

SEQ ID NO: 3283 - DNA, 1545 bp, Alicyclobacillus acidocaldarius; identical to SEQ ID NO: 1515

SEQ ID NO: 3284 - protein, 506 aa, Geobacillus kaustophilus; identical to SEQ ID NO: 1516

SEQ ID NO: 3285 - protein, 508 aa, Alkaliphilus oremlandii; identical to SEQ ID NO: 1517

SEQ ID NO: 3286 - protein, 508 aa, Bacillus cereus; identical to SEQ ID NO: 1518

SEQ ID NO: 3287 - protein, 507 aa, Bacillus cereus; identical to SEQ ID NO: 1519

SEQ ID NO: 3288 - protein, 508 aa, Bacillus cereus; identical to SEQ ID NO: 1520

SEQ ID NO: 3289 - protein, 514 aa, Artificial
  Alicyclobacillus acidocaldarius mutated SEQ ID NO 3282
MTPVSTFPTGLEHVAIYLRKSRADLEAEARGEGETLTKHRRALLELAKQYHYSIDHIYEEIVSGELIVDRPEVQRLLHAVREGKYSAVLVMDIDRLGRGNQIDQGIIQQAFKQSGTLIITPRKVYNLEDELDEEFSEFEQFMARRELKIITRRMQRGRKLSAKEGKSITPYVPFGYKRDENLKLYPDPETAPIVRQIFEWSAEGIGIIKIAKKLNEMGVPAPRSCGWQRTTVQHILKNEVYLGRIVWDKKRDVKTTEGKYRSIKRPREEWIVHENAHEPIISQELWDRVVEIRKVNDHRTKDNYDLKNPFAGILRCKQCGRVMKRQPRPNRNGDTLQCYTTGCPTREVLLSRLEDRVLQSIEEFVQSYAAQSSVKKRADNRQKKLEALHRQKKSIQSKLSKLETQKNRLFDFLEQGIYDVQTFIERSKLVGEQIDQAKEELKICEQAIEREMLQQQHEEELIPAISEAIAMYRTASNAEIKNMALKSVIKEIHYYRPRSWSKSKEFEIDIYFRI

SEQ ID NO: 3290 - protein, 514 aa, Artificial
  Alicyclobacillus acidocaldarius mutated SEQ ID NO 3282
MTPVSTFPTGLEHVAIYLRKSRADLEAEARGEGETLTKHRRALLELAKQYHYSIDHIYEEIVSGELIVDRPEVQRLLHAVREGKYSAVLVMDIDRLGRGNQIDQGIIQQAFKQSGTLIITPRKVYNLEDELDEEFSEFEQFMARRELKIITRRMQRGRKLSAKEGKSITPYVPFGYKRDENLKLYPDPETAPIVRQIFEWSAEGLGIIKIAKKLNEMGVPAPRSCGWQKTTVQHILKNEVYLGRIVWDKKRDVKTTEGKYRSIKRPREEWIVHENAHEPIISQELWDRVVEIRKVNDHRTKDNYDLKNPFAGILRCKQCGRVMKRQPRPNRNGDTLQCYTTGCPTREVLLSRLEDRVLQSIEEFVQSYAAQSSVKKRADNRQKKLEALHRQKKSIQSKLSKLETQKNRLFDFLEQGIYDVQTFIERSKLVGEQIDQAKEELKICEQAIEREMLQQQHEEELIPAISEAIAMYRTASNAEIKNMALKSVIKEIHYYRPRSWSKSKEFEIDIYFRI

SEQ ID NO: 3291 - protein, 514 aa, Artificial
  Alicyclobacillus acidocaldarius mutated SEQ ID NO 3282
MTPVSTFPTGLEHVAIYLRKSRADLEAEARGEGETLTKHRRALLELAKQYHYSIDHIYEEIVSGELIVDRPEVQRLLHAVREGKYSAVLVMDIDRLGRGNQIDQGIIQQAFKQSGTLIITPRKVYNLEDELDEEFSEFEQFMARRELKIITRRMQRGRKLSAKEGKSITPYVPFGYKRDENLKLYPDPETAPIVRQIFEWSAEGLGIIKIAKKLNEMGVPAPRSCGWQRTTVQHILKNEVYLGRIVWDKKRDVKTTEGKYRSIKRPREEWIVHENAHEPIISQELWDRVVEIRKVNDHRTKDNYDLKNPFAGILRCKQCGRVMKRQPRPNRNGDTLQCYTTGCPTREVLLSRLEDRVLQSIEEFVQSYAAQSSVKKRADNRQKKLEALHRQKKSIQSKLSKLETQKNRLFDFLEQGIYDVQTFIERSKLVGEQIDQAKEELKICEQAIEREMLQQQHEDELIPAISEAIAMYRTASNAEIKNMALKSVIKEIHYYRPRSWSKSKEFEIDIYFRI

SEQ ID NO: 3292 - protein, 514 aa, Artificial
  Alicyclobacillus acidocaldarius mutated SEQ ID NO 3282
MTPVSTFPTGLEHVAIYLRKSRADLEAEARGEGETLTKHRRALLELAKQYHYSIDHIYEEIVSGELIVDRPEVQRLLHAVRDGKYSAVLVMDIDRLGRGNQIDQGIIQQAFKQSGTLIITPRKVYNLEDELDEEFSEFEQFMARRELKIITRRMQRGRKLSAKEGKSITPYVPFGYKRDENLKLYPDPETAPIVRQIFEWSAEGLGIIKIAKKLNEMGVPAPRSCGWQRTTVQHILKNEVYLGRIVWDKKRDVKTTEGKYRSIKRPREEWIVHENAHEPIISQELWDRVVEIRKVNDHRTKDNYDLKNPFAGILRCKQCGRVMKRQPRPNRNGDTLQCYTTGCPTREVLLSRLEDRVLQSIEEFVQSYAAQSSVKKRADNRQKKLEALHRQKKSIQSKLSKLETQKNRLFDFLEQGIYDVQTFIERSKLVGEQIDQAKEELKICEQAIEREMLQQQHEEELIPAISEAIAMYRTASNAEIKNMALKSVIKEIHYYRPRSWSKSKEFEIDIYFRI

SEQ ID NO: 3293 - protein, 514 aa, Artificial
  Alicyclobacillus acidocaldarius mutated SEQ ID NO 3282
MTPVSTFPTGLEHVAIYLRKSRADLEAEARGEGETLTKHRRALLELAKQYHYSIDHIYEEIVSGELIVDRPEVQRLLHAVREGKYSAVLVMDIDRLGRGNQIDQGIIQQAFKQSGTLIITPRKVYNLEDELDEEFSEFEQFMARRELKIITRRMQRGRKLSAKEGKSITPYVPFGYKRDENLKLYPDPETAPIVRQIFEWSAEGLGIIKIAKKLNEMGVPAPRSCGWQRTTVQHILKNEVYLGRIVWDKKRDVKTTEGKYRSIKRPREEWIVHENAHEPIISQELWDRVVEIRKVNDHRTKDNYDLKNPFAGILRCKQCGRVMKRQPRPNRNGDTLQCYTTGCPTREVLLSRLEDRVLQSIEEFVQSYAAQSSVKKRADNRQKKLEALHRQKKSIQSKLSKLETQKNRLFDFLEQGIYDVQTFIERSKLVGEQIDQAKDELKICEQAIEREMLQQQHEEELIPAISEAIAMYRTASNAEIKNMALKSVIKEIHYYRPRSWSKSKEFEIDIYFRI

SEQ ID NO: 3294 - DNA, 1545 bp, Artificial
  Alicyclobacillus acidocaldarius mutated SEQ ID NO 3283
gtgacgcccgtgagtacctttccgactggattggaacacgtagctatttatcttagaaagtctcgcgcagatttagaagctgaagctcgtggcgaaggggaaaccttgacgaagcatcgtcgagcccttcttgaactggccaagcaataccactatagcattgaccacatttacgaggaaattgtctccggagagctcatcgtcgatcgccctgaagtacagagattgctacatgctgtccgtgagggaaaatacagtgctgtattggttatggatatcgaccgccttggtcgtgggaatcagatcgatcaaggcatcatacagcaagcttttaagcaatccggaaccctgatcataaccccccgaaaggtctacaaccttgaagatgaattggacgaggagttttcagagttcgagcagttcatggctcgtcgagagctgaaaatcattactcgtcgtatgcaacgtggacgaaaactttcggctaaagaagggaaatcgatcactccctatgttccgttcggttacaaaagagacgaaaatctcaagttatatccagaccccgaaactgcacctattgtccggcaaattttcgagtggagtgccgaagggattggcatcattaagattgccaagaaattgaacgaaatgggtgttcctgcaccacgttcgtgtggctggcagcgaacgaccgttcaacacattttgaagaacgaagtctacctagggcgaatcgtctgggacaagaagcgagatgtgaagaccaccgaaggaaagtatcggtcgattaagcgcccacgtgaagagtggatcgtccatgaaaatgctcatgaacccatcatttctcaagaactgtgggatagagttgtagagattcgtaaggtgaatgaccatcggacgaaggataactatgatctgaagaatccgtttgctggaatcttgagatgcaaacagtgtggacgagtgatgaagagacaaccgcgcccgaatcgtaatggcgacacattgcagtgctatacgacaggatgtccgacgcgggaagtactcctttctagactcgaagatcgcgtattgcaatctatcgaagagtttgttcagtcatatgctgcccagtcaagcgtaaagaaacgcgctgataatcgccaaaagaaattagaggctctgcacaggcagaaaaagtccattcaatcaaaactcagcaagctagagacacaaaagaacaggctgtttgattttcttgaacaaggcatttatgatgtacaaacttttatagagagaagcaaattggtaggtgaacaaattgaccaggcaaaagaggaactcaaaatttgtgaacaagcaattgagcgcgaaatgctgcaacaacagcatgaagaggaattgattccggcgattagtgaggccatcgcaatgtaccgcactgcttccaatgcagaaattaagaacatggcattgaagtcggtcataaaggaaatacattattacagacctcgttcatggtcaaaatcgaaggaatttgaaatcgatatatatttccgtatctga

SEQ ID NO: 3295 - DNA, 1545 bp, Artificial
  Alicyclobacillus acidocaldarius mutated SEQ ID NO 3283
gtgacgcccgtgagtacctttccgactggattggaacacgtagctatttatcttagaaagtctcgcgcagatttagaagctgaagctcgtggcgaaggggaaaccttgacgaagcatcgtcgagcccttcttgaactggccaagcaataccactatagcattgaccacatttacgaggaaattgtctccggagagctcatcgtcgatcgccctgaagtacagagattgctacatgctgtccgtgagggaaaatacagtgctgtattggttatggatatcgaccgccttggtcgtgggaatcagatcgatcaaggcatcatacagcaagcttttaagcaatccggaaccctgatcataaccccccgaaaggtctacaaccttgaagatgaattggacgaggagttttcagagttcgagcagttcatggctcgtcgagagctgaaaatcattactcgtcgtatgcaacgtggacgaaaactttcggctaaagaagggaaatcgatcactccctatgttccgttcggttacaaaagagacgaaaatctcaagttatatccagaccccgaaactgcacctattgtccggcaaattttcgagtggagtgccgaagggttaggcatcattaagattgccaagaaattgaacgaaatgggtgttcctgcaccacgttcgtgtggctggcagaaaacgaccgttcaacacattttgaagaacgaagtctacctagggcgaatcgtctgggacaagaagcgagatgtgaagaccaccgaaggaaagtatcggtcgattaagcgcccacgtgaagagtggatcgtccatgaaaatgctcatgaacccatcatttctcaagaactgtgggatagagttgtagagattcgtaaggtgaatgaccatcggacgaaggataactatgatctgaagaatccgtttgctggaatcttgagatgcaaacagtgtggacgagtgatgaagagacaaccgcgcccgaatcgtaatggcgacacattgcagtgctatacgacaggatgtccgacgcgggaagtactcctttctagactcgaagatcgcgtattgcaatctatcgaagagtttgttcagtcatatgctgcccagtcaagcgtaaagaaacgcgctgataatcgccaaaagaaattagaggctctgcacaggcagaaaaagtccattcaatcaaaactcagcaagctagagacacaaaagaacaggctgtttgattttcttgaacaaggcatttatgatgtacaaacttttatagagagaagcaaattggtaggtgaacaaattgaccaggcaaaagaggaactcaaaatttgtgaacaagcaattgagcgcgaaatgctgcaacaacagcatgaagaggaattgattccggcgattagtgaggccatcgcaatgtaccgcactgcttccaatgcagaaattaagaacatggcattgaagtcggtcataaaggaaatacattattacagacctcgttcatggtcaaaatcgaaggaatttgaaatcgatatatatttccgtatctga

SEQ ID NO: 3296 - DNA, 1545 bp, Artificial
  Alicyclobacillus acidocaldarius mutated SEQ ID NO 3283
gtgacgcccgtgagtacctttccgactggattggaacacgtagctatttatcttagaaagtctcgcgcagatttagaagctgaagctcgtggcgaaggggaaaccttgacgaagcatcgtcgagcccttcttgaactggccaagcaataccactatagcattgaccacatttacgaggaaattgtctccggagagctcatcgtcgatcgccctgaagtacagagattgctacatgctgtccgtgagggaaaatacagtgctgtattggttatggatatcgaccgccttggtcgtgggaatcagatcgatcaaggcatcatacagcaagcttttaagcaatccggaaccctgatcataaccccccgaaaggtctacaaccttgaagatgaattggacgaggagttttcagagttcgagcagttcatggctcgtcgagagctgaaaatcattactcgtcgtatgcaacgtggacgaaaactttcggctaaagaagggaaatcgatcactccctatgttccgttcggttacaaaagagacgaaaatctcaagttatatccagaccccgaaactgcacctattgtccggcaaattttcgagtggagtgccgaagggttaggcatcattaagattgccaagaaattgaacgaaatgggtgttcctgcaccacgttcgtgtggctggcagcgaacgaccgttcaacacattttgaagaacgaagtctacctagggcgaatcgtctgggacaagaagcgagatgtgaagaccaccgaaggaaagtatcggtcgattaagcgcccacgtgaagagtggatcgtccatgaaaatgctcatgaacccatcatttctcaagaactgtgggatagagttgtagagattcgtaaggtgaatgaccatcggacgaaggataactatgatctgaagaatccgtttgctggaatcttgagatgcaaacagtgtggacgagtgatgaagagacaaccgcgcccgaatcgtaatggcgacacattgcagtgctatacgacaggatgtccgacgcgggaagtactcctttctagactcgaagatcgcgtattgcaatctatcgaagagtttgttcagtcatatgctgcccagtcaagcgtaaagaaacgcgctgataatcgccaaaagaaattagaggctctgcacaggcagaaaaagtccattcaatcaaaactcagcaagctagagacacaaaagaacaggctgtttgattttcttgaacaaggcatttatgatgtacaaacttttatagagagaagcaaattggtaggtgaacaaattgaccaggcaaaagaggaactcaaaatttgtgaacaagcaattgagcgcgaaatgctgcaacaacagcatgaagatgaattgattccggcgattagtgaggccatcgcaatgtaccgcactgcttccaatgcagaaattaagaacatggcattgaagtcggtcataaaggaaatacattattacagacctcgttcatggtcaaaatcgaaggaatttgaaatcgatatatatttccgtatctga

SEQ ID NO: 3297 - DNA, 1545 bp, Artificial
  Alicyclobacillus acidocaldarius mutated SEQ ID NO 3283
gtgacgcccgtgagtacctttccgactggattggaacacgtagctatttatcttagaaagtctcgcgcagatttagaagctgaagctcgtggcgaaggggaaaccttgacgaagcatcgtcgagcccttcttgaactggccaagcaataccactatagcattgaccacatttacgaggaaattgtctccggagagctcatcgtcgatcgccctgaagtacagagattgctacatgctgtccgtgatggaaaatacagtgctgtattggttatggatatcgaccgccttggtcgtgggaatcagatcgatcaaggcatcatacagcaagcttttaagcaatccggaaccctgatcataaccccccgaaaggtctacaaccttgaagatgaattggacgaggagttttcagagttcgagcagttcatggctcgtcgagagctgaaaatcattactcgtcgtatgcaacgtggacgaaaactttcggctaaagaagggaaatcgatcactccctatgttccgttcggttacaaaagagacgaaaatctcaagttatatccagaccccgaaactgcacctattgtccggcaaattttcgagtggagtgccgaagggttaggcatcattaagattgccaagaaattgaacgaaatgggtgttcctgcaccacgttcgtgtggctggcagcgaacgaccgttcaacacattttgaagaacgaagtctacctagggcgaatcgtctgggacaagaagcgagatgtgaagaccaccgaaggaaagtatcggtcgattaagcgcccacgtgaagagtggatcgtccatgaaaatgctcatgaacccatcatttctcaagaactgtgggatagagttgtagagattcgtaaggtgaatgaccatcggacgaaggataactatgatctgaagaatccgtttgctggaatcttgagatgcaaacagtgtggacgagtgatgaagagacaaccgcgcccgaatcgtaatggcgacacattgcagtgctatacgacaggatgtccgacgcgggaagtactcctttctagactcgaagatcgcgtattgcaatctatcgaagagtttgttcagtcatatgctgcccagtcaagcgtaaagaaacgcgctgataatcgccaaaagaaattagaggctctgcacaggcagaaaaagtccattcaatcaaaactcagcaagctagagacacaaaagaacaggctgtttgattttcttgaacaaggcatttatgatgtacaaacttttatagagagaagcaaattggtaggtgaacaaattgaccaggcaaaagaggaactcaaaatttgtgaacaagcaattgagcgcgaaatgctgcaacaacagcatgaagaggaattgattccggcgattagtgaggccatcgcaatgtaccgcactgcttccaatgcagaaattaagaacatggcattgaagtcggtcataaaggaaatacattattacagacctcgttcatggtcaaaatcgaaggaatttgaaatcgatatatatttccgtatctga

SEQ ID NO: 3298 - DNA, 1545 bp, Artificial
  Alicyclobacillus acidocaldarius mutated SEQ ID NO 3283
gtgacgcccgtgagtacctttccgactggattggaacacgtagctatttatcttagaaagtctcgcgcagatttagaagctgaagctcgtggcgaaggggaaaccttgacgaagcatcgtcgagcccttcttgaactggccaagcaataccactatagcattgaccacatttacgaggaaattgtctccggagagctcatcgtcgatcgccctgaagtacagagattgctacatgctgtccgtgagggaaaatacagtgctgtattggttatggatatcgaccgccttggtcgtgggaatcagatcgatcaaggcatcatacagcaagcttttaagcaatccggaaccctgatcataaccccccgaaaggtctacaaccttgaagatgaattggacgaggagttttcagagttcgagcagttcatggctcgtcgagagctgaaaatcattactcgtcgtatgcaacgtggacgaaaactttcggctaaagaagggaaatcgatcactccctatgttccgttcggttacaaaagagacgaaaatctcaagttatatccagaccccgaaactgcacctattgtccggcaaattttcgagtggagtgccgaagggttaggcatcattaagattgccaagaaattgaacgaaatgggtgttcctgcaccacgttcgtgtggctggcagcgaacgaccgttcaacacattttgaagaacgaagtctacctagggcgaatcgtctgggacaagaagcgagatgtgaagaccaccgaaggaaagtatcggtcgattaagcgcccacgtgaagagtggatcgtccatgaaaatgctcatgaacccatcatttctcaagaactgtgggatagagttgtagagattcgtaaggtgaatgaccatcggacgaaggataactatgatctgaagaatccgtttgctggaatcttgagatgcaaacagtgtggacgagtgatgaagagacaaccgcgcccgaatcgtaatggcgacacattgcagtgctatacgacaggatgtccgacgcgggaagtactcctttctagactcgaagatcgcgtattgcaatctatcgaagagtttgttcagtcatatgctgcccagtcaagcgtaaagaaacgcgctgataatcgccaaaagaaattagaggctctgcacaggcagaaaaagtccattcaatcaaaactcagcaagctagagacacaaaagaacaggctgtttgattttcttgaacaaggcatttatgatgtacaaacttttatagagagaagcaaattggtaggtgaacaaattgaccaggcaaaagatgaactcaaaatttgtgaacaagcaattgagcgcgaaatgctgcaacaacagcatgaagaggaattgattccggcgattagtgaggccatcgcaatgtaccgcactgcttccaatgcagaaattaagaacatggcattgaagtcggtcataaaggaaatacattattacagacctcgttcatggtcaaaatcgaaggaatttgaaatcgatatatatttccgtatctga

What is claimed is:

1. An isolated nucleic acid sequence comprising a nucleic acid sequence encoding a polypeptide having at least 90% sequence identity to SEQ ID NO: 2976.

2. The isolated nucleic acid sequence of claim 1, wherein the polypeptide has activity at or below about pH 8.

3. The isolated nucleic acid sequence of claim 1, wherein the polypeptide has activity at a temperature at or above about 50 degrees Celsius.

4. The isolated nucleic acid sequence of claim 1, wherein the nucleic acid sequence is present in a vector.

5. The isolated nucleic acid sequence of claim 1, wherein the polypeptide has activity as a Type II restriction-modification system methylation subunit.

6. The isolated nucleic acid sequence of claim 1, wherein the polypeptide comprises SEQ ID NO: 2976.

7. The isolated nucleic acid sequence of claim 1, wherein the nucleic acid sequence comprises SEQ ID NO: 2977.

* * * * *

UNITED STATES PATENT AND TRADEMARK OFFICE
CERTIFICATE OF CORRECTION

PATENT NO. : 8,569,030 B2
APPLICATION NO. : 13/604979
DATED : October 29, 2013
INVENTOR(S) : Brady D. Lee et al.

It is certified that error appears in the above-identified patent and that said Letters Patent is hereby corrected as shown below:

In the drawings:

In FIG. 1, Line 10   change "NTTNATSTCNTANTTASATSNATSNTTGSAPTNPNVLTQKSAVYQLIEVFNTIPSWPTGL" to --NTTNATSTGNTANTTASATSNATSNTTGSAPTNPNVLTQKSAVYQLIEVFNTIPSWPTGL--

Signed and Sealed this
First Day of March, 2016

Michelle K. Lee
*Director of the United States Patent and Trademark Office*